United States Patent 8,071,291 (GENETIC POLYMORPHISMS ASSOCIATED WITH VENOUS THROMBOSIS, METHODS OF DETECTION AND USES THEREOF) - sequence listing, part 5

SEQ ID NO: 506 - DNA, 51974 bp, Homo sapiens
atatatatatagagagagacagagtttcataattatcacccagactagagactgtgatctcagctcactgcaacctccgcttcccgggttcaagtgattcttctgcctcagcctccagagtagctgggattacaggcgcctgccaccacacctggctaatttttgtatttttagtagagatggggttttgccatgttgggcaggctggtctcaaactcctgatctcaggtgatctgcctgccttggcctcccaaagtgctgggattacaggtgtgagctggctgggcatggtggctcatgcctgtaatcccagcactttgggaggctgagatgggaggattgctcaaggctaagggtttgagaccagcctagtcaacatagtgagacccccatctctattaaaataaataaataaatacataaataaagcaaatcttgcatttaccctttttaacaagatgcaaatgatgtcagtctgttgattagagttgatattttctccaatatttccatttactcttcccatgtttttcaccttattattcttgttctttgtagcattaaaacagtcaacttaagagcaatttgaactagttcaattaaaatgctacaattattgcacatccaaaattttttatctgattataaactttctgaaaaactgcactgcaaattcctaaccaaaactcagttgaaagtcatggcaatattgcaaaaaaaaaaaaaaaaaaaaaaaaattccactcttcaattcacaactaactacaaactattttgatataaaattaaataatacacagctgggtgtggtggctcacgcctgtaatcccagcactttgggaggccaaggcgggtggatcacgagatcatgagttcaagaccagcctggtcaagatggtgaaaccccatctctactaaaaatacaaaaattagccaggcgtggtggcaggtgcctgtaatcccaactactaggaaggctgaggcagagaattgcttgaacccgggaggcggaggttgcagtgagccgagatcgcaacaccacactccagcctgggcaacaagagcaaaactccatctcaaaaaaaaaaaataaataaataaataaatactatactattctgccattataacttgatggtcatattgacactcatgtaccagaaaatcaaatgagatgacaattcaccaaataaactgcttttagccaacgtgcacatttttcacatcccctcctctgtctctcccacaatgtaatgcaattagccttgtgcgattagtaatgtgctcctgtcctcagttcttgtcaagaatccacacaaggcactctaatattttcgaatccattctatttcattatttaaaaagttagtgggacacattaaatttatttcttgacccactaaagggtcatgagcaaagtctcaaaaacactactgtaagacactaaactattaactattgcaagggagtttgtaaaaaatacaataaacagaatagcttacctctctgcatgcagaatgttttctttgctaactttatttttcaaggctggatttataccacactgggcttgcaaacttgctgcttcatgggttggtggggaggggtaggagaggggtgtgtggggtatatatgttttcttttttattttatggtctttttaaaaaattgagatataattcatacaccataaaattcacactattaaagtacaattcagtggtttttagtatattcccaatattgtgtaactatcatcactatctaattccagaacatattaatcacccatcaaaaaaatccatacccatgaagagtaactccccattttccctgcccctggtccctgccaaccactaatttacttcctgtctccatagattaatctattctagatattttatataaaaggaatcacacagtatgtggccttttatgtctggcttcttccacttagcatatatttttaaaggtttatccacgttgcagcatttatcagtaggtcattccatttagtggtcaagtaatatgccattgtatgaatattccacattttaatcatttgtaagttgatgaatgctaggattgtttccacttttagctattatgaataatgctgttacaaactgacgtacaaacttttgtgtagacgtaattcattttagttttctcttgggtgagtggaattgctgggtcacatggtaacttaatctttaattttaattaatttatttataggctgaagtgcagtggcgtgaccttggctcactgcaacctccaccccccagattcaagcaattcttctgcctcagcctcccgagtagctgcaattacaggcgtgcgccaccatgcctggctaattttttgtatttttagtagagacggggtttcgccatgttggccaggctgggcaatgtttaatttttgataagccaataaagtgttttccaaaccagctaccccgttttatatccccgctagcaatggatgaaaattccagggctgggcgcggtggctcacgcctgtaatccagcactttgggaggctgaggcgggcagatcatttgagcgcagtagttcgagaccagcctgggcaacgtggcaaaaccctgtctctacaaaaaataaaaaattagccaggcgtggtggcatgcgcctgtggtcccagctacttgggaggctgaggtaggagtatcacttgagccccagaagtcgaggcttcagtgagctttgattgcggcactgcactccagcccgggcaacagagtgagaacctgtctcaaaaaataataaataaataaataaataaaaattttaaaaacaaaattccaaattctccacatcctcactaacatctcccacctcagcctccctaaaagctgtgactacaagtgcgagccaccatgctcagctaatttttttatttttggtagagacagggtttcgccatgttacccaggtcttaaactcctggactcaaactatccacccactttggcctcccaaagtgctgggattacaggcttaagccactgttcctggccttttttttttaaataaatgatttttaaaaatttttatattgacaaggctgggcgtggtggctcacgcctgtaatcccagcactttgggaggctgaggcaggcagatcacgaggtcaagagatcgagaccatcctggccaacatggtgaaaccccggctctactaaaaatacaaaacttagctgggcgtggtggcacatgcttgcaatcccagctactcgggaggctgaggcaggagaagcacttgaaccagggagtcggaggttgcaatgagccgggatcgcgccactgtactccagcctggcgacagagacttcgtctcaaaaaacaaacaaacaaacaaaaaaattacattgacaaataaaattagtatatatttatcaagtacatgttgttttgaaatatatatacattgtggaatggctaaattgaggtaattagcatatgtgattaactttagactttaaggatatgtactcgtcataatggtctctattagccaggaacctgacaggaaacagatggctcattcaaattagaaaaattagtggaaggtttaataaagagactacttacaaaggtgtggacagagtgttagagaaccgcaagggaaaatacagtaatcctatacagccaatcctatccctagcctgaagggaataagagaatggttactgtattagtcagaattacaaaacagaactaatggaatatgtttgtgtaaggagggcgaggtggcttacacctgtaatcccagcactttgggaggcggaggtgggtggatcacctgatgtcagaagttggaggccagcctgactaacatggtgaaacctcgtctctactaaatacaaaaaattagtcaggcatggtggcaggtgtctgttatcccagctacttgggaggctgaggcaggagaatcacttgaacccgggaggcagaggttgcagtgagccgagatggtgccactgcattccagcttgggcaacaagagtgaaactccatctcaaaaaaaaaaaaaaaaaaaagaatatgtgtgtgtatagaaagaggtttatcataaggaattggctcacacagttgcagagattggcaagtccaaatgtgcagtgtgggctggcaggtttgaaacccaggaaagccagtggtatagatgaagtcccagagcgggctgctggagaattccctctcatgtaagggagaggccgtctcttcattctcttcaggctccagctgattgaatgaggcccatccacattatgaagggtaatcttcaccaattaaaatgttcatctcatccaaaaacacccttgcagaaatactcagaataatgtttgaccaaatatcggagtacccagtggtccagccaggttgacacataaaattaaccaccacctgaaaataaaaagttgtgtagagatgggcaccttgggataaaatgatactttttttttattattgtactttaagttctagggtacacgtgcacaacgggcaggtttgttacatatgtatacgtgtgccatgttggtttgctgcacccattaactcatcatttacattaggtatttatcttaatgctatccctcccctatccccccaccccaccacaggccccggtgtgtgatgttccccgccctgtgtccaagtgttctcattgttcaattcccacctatgagtgagaacatgcagtgtttggttttctgtccttgcgataatttgctcagaatgatggtttccagcttcatccatgtccctacaaaggacatgaactcatcaaaaggatattctttttatatacatatatatagagataggatctcactatgttgcccaggctggtcttgaactcctgggctcaagcaatcctcccatctctgcctcccagagtgctgggattacaggtgtgagtcaccatgcccagtcagaaatgataccttttgattgagagatgtagccagcctgaagcaaatcctgcaagaagggagccagagggataaacgcccttgaactcactccactccctttcaccagtctcctgtctgggctccccactggatgaacccaactggaagccaggaagaatgagcccattaattgtagctcataccagaccacgagaacagaggataatgaatttcttggggcaaagaatagggtgaaaaagggtgaaaagcacatccacagggggaaatggaagatatcctacacacaagattatgccacagtaataagcaattccagcggactcaaagaaagtagaaggaaggaaataagatcaaagcagaaattagcacaacagacaaacatacacttgacagcaacaagtcagtcccaagtttgttcttcaaaaaagagaaatacaataagaaatatctggcaagactaatcaagaaaaagagaaggcatagataattaataataaaaaacaggccaggcatgatggctcacacctgtaatcccagcacttttggaggctaagtcaggaggatcatttggatgccaggagtttgagaccactctgggcaacatggcaaaaccctgcctccacacaaaaaatttttttaattagccaggtgtgatggtgcatacctggagttccagctacttggaaggctaaggcaggaggattgcttgagtgtgggaggtcaaggctgcggtgagtcgtgatcacaccactgcactccagcctgggcaacagagcgagatcttttctcaaaaaaaaaagaacaaaacagataggacaacttcatgccaatgaattcatagaaaagtacaactttctaagttagggaagagcagggtttaggaaaggactttctttcgtctctctgatctggcctggaatccggggtgttgactaatgatcaagggtatccctgggtgtggggatgagctggccttggccacaaagaagcctgaataatgaagtggactgtggttctaagagtagtcatagctaatagtagctgttagctagtagatgatgtaatttccttccattatgcctcagttttcagtcaagacttcttcaaagttatagcagttctcgtctaggttatggggaattatgtgtaggcctgagtctctatttgaggcaaagtaatagaagagagggcaggaggtatatccctgcctatcaaggtagccagaggtttgccatggtactgaagaaaatgatcagcagctgaattagccaaggttcatgggcaaagatgaggctggcagataaagccagacaaattcctggttaaaagtcacctcctgagctatttagagaaacagttgattcagggctgggataggaacgggatcagctgagcttggaacatcttgtaataccagaaagcaggacactatcaaagactattggggttgtgttaacaggactcagggctaacttgaagagaggcttccactggccagaaatgggacaatttgagctttgataagaaaaataatttcaatgaactgaaaaccatcaaatgagtttaaatccaagagttcacaatacttgaaaaacaaaacttcattgtcacaattggaagatgctaggaaaatgatgcattattctggaaaataaaaaataaaagttaagaatcaaatatttatcctggctttcctgaatgaactgtgccccaaggaacccaaatagttgacgagaggaagtctttctttagagaagtagtctagccttggctgggcatggtggctcacacctgtaatcccagcactttgggaggccaaggtaggtgtatcacctgaggtcaggaggtcgagaccagcctgactaacatggtgaaaccttgtctttactaaaaatacaaaattagctgggtgtggtggcgcatgcctgtaatcccagctacttaggaggctgaggcaggagaattgcttgaacccgggaggcagaggttgcggtgagccgagatcaagccattgcactccagcctgggcaacaagagcaaaacttcatctcaaaaaaaaaaaaaaaaaaaaaaaaaaagagaagtagtctagactaattaaaatctcactattttgaaacccctgttgaaataatggatccaagcaatgaccaacaaatggctgttagtaacaggcaaggagacatcatgtgtctcttgaccaaaagaaacaacagtgcttattcttgaaaaataaaaacaccagcctagacaacatagcgagaccccatctaaacaaaaaatttaaaaattagccaggtgtggtggtgtgggcctgtagtcccagctattcgggaggctgaggcgggagaatcacttgtgcccgtgaggctgcagtgaactgtgatcaccccactgggtgacagggtgagacgctgtctcaaaatacataaatacacaaataaaaataaaaacaaaagtaaaaatccaaatctgatgatgtctctagatcttaatatcaactttaaaaaacagttatataataaatacctcagagatgcaattaacaaaatccataatatggaaacctacaggacatacaactgttgtcttcaacaaacaaactgcaatgaaaatagaggaggagtgggaaaggagggagggagggagagggaaagaattcctgtaaattaaaagacatttcagagatatatcatctaatttcaaatatataaatcaaccctatgtgggtcctgatgcaaacaaactataatacaaagttatgaaacaaaacattttgaacattggagaggatatcaaggaataatgatttatttttataggcatgctttggggatgcattctgaaatacttttaggaataaaatgtttggaatcctaaataatctagtgtggatataaatgaaataaggttggccatgaattcatcatctttgaagctagtttgttgaaattgggtgatgagcacacaaaggatggatgtcctgttcgctccatttttgtttatttaaaattttacttagccaggcatggtggcatgcacctgtggtcccagcttcttgggacgctggggtgggatgaccgcttgagcctgggaggtggaggcttcagtgagctcagatcatgccactgcattccagccagggcatgagtgagatcctgtctccaaataaataagaaaataaataaaaataaaataaaataaaataaaataaaaataaaaaaataaaaaataaataaaataaaataaataaaaaataaaataaaaaaataaataataaaaataaaaaaataaacaaaataaaataaaatagtacatcctggccaggcacggtggctcatgcctcctagcactttgggaggccaaggcaggcagactgcttgagctcaggagtttgagaccaccctgagcaacgtggcaaaatcccatctcaacaaaaaatacaaaattaggaaaattagccaggcatggtggcatgctccagttgtcccagctactcgggaggctaaggtgggaagattgcttgagcccagaaggtcagggattgcaaggcttgcagggcttgcagtgagccgtgattgcgccactgcactccaggctgggcaacagggtgagaccctgtctcaaaaaaaaaaaaaacaactttgtggccagggacagtggctcatgcctgtaattccagtactttgggaggctgagatgggaggattgcttgagcccaggaattcgagaccaccctgggcaacaaagcaagatcccatctctaatgtttataaaaatgtaaaaagaaaaaattaaagttacaagaaaataaaattttaaaaagcaataaaattttacataattaaaagctcacgtcctcagggaggctttttccacccaccctatctaaagcagcttatctttccccattattttctagcacagccccgtgttttcttcatggaactgatcacaatgttactttatctatttactaggttatttctttctgctagaaatttagtttcacaagaataaaaactgtttgccttgtttgctgctgaacctctggggctgcggctggcacacaaaggtgcctgcccagccccatggctcacgcctgaaatcccagttaatcaggaggctgaggcaggggattgtttgagcccaggagtttgagatcagcctgggcaacatagggagacaccgtctctgcaaaaaaatttttaaaaatcaggcaaattatagtggtgtgtgcctgtggtcccagctactccagaggctgagatgggaggatcacttgagcctgggaggtcgaggctgcagtgagtcgtgatcatgccactacattccaacctgggtgacagagggagaccctgtctcaaaagaaaaaaggtgcttaataaatcttcgttgcttggaaggacaggtggatagataggtcaactaaagagtaagaagcagccggggcatggtggctcacgcccataatcccagcactttgggaggccgaggcgggtggatcacctgacgtcaggagttcgagaccagcctaggcaacatggtgaaacctcatctctactaaaaatacaaaaaataaaaataaaaataaaaaaattagccagatgcggtgtagccagatgcacgcctatagtcccagttactcaggaggctgaagctggagaattgcttgaacctgggaggcagaggttgtagtgagccgagatcacaccactgcactccagcctgggtgactgagtgagactctgtctcaaaaaaaaaaaaaaaaaaaaaaaagtaagaagcacatgttggagcaagaactaacaaagaaatacatttatgacaacactttccacaaagacaccagaaaaggaagggagattcaactatcgacccctaggatctttggagccagctaaccgcatttagccgtctctccagctgcatgagaaaattaactagagtcacaattgcccgtagccaccaatcctttctttgaatgaaatctcatgagacagcccaatatgtaaaacatgataaccaaaatatgatagccaaaagcaatttattatagtttagcctcaaaaaaataaaaataaaaaaattatccagtggttatgaggagtctaggaaaacctgtcccagtaatgccaacttggaggtgaagggctgactggggcagctgagaagtgggaccttctgtttggcaggcttcctctcccttgcctggtcatggttttctggtgagaagagtgttcctggccttgctggaggttcccatggccccgaactaacagtgtttttctgaaatttcgacctgctccgtttgagagagtagaattccctcatcaagtcctccacctcccactgctcttccttcagcctctggcagcagtgcagggcggcagggtcgatggggtgagcttctgtgttgaagatgtaccccccagcccccaggatgcactccccatagggggtgatcaccgcgtcgaaggtggacccattgttgtggatgaagttggttgggtcaaacaggaggtagaggtatttcacagtctcggccaggaagaacgactccatgcggttgtccagcttgtggtctcgcagatctttgatctgacatgtgggagaaggaagcaagctggaacaccatcacaatttagtagtaagggtcaggcaatcccttaagaaggcctgttctgccacaaagcagctgagggcctgtgagcaaatcactgaacttttcagaacttcactctttcccaagccaccatcatctctcacctggattatcacataagcttccaaatgggctcccagcttccaatcttagccctgcagtttatatacacacactattttaaaaaatagggacagggtctcacaccatgttgcccaggctggtctcaaatccctgggctcaagcaattcctcctaccttggcctcccaaagtgccaggataacaggcgtgagacacacaccaagctcctacagtatctgtataacataagtcttcctgtcaattctctactcacaactttctgtgagccctccatttcatgcaggataaaaatgcaagtcatgacctggcccctgctcccttcctgccctcacctcttaccactctaagagctccagctgctgcctttctgtcctgagctagcacagcaccctcctgcttcgggctctttgcatctgtggttctttcagcctggagcactccgcctccagtttttctcatagcttgttccctcccttccttcaggtctctgctcaaatgcttcctcaccagaaaggtctccgctaaccttgctctatgacatgacaatctcctatcccctttatcccaactttttgtgactataaacatagagctaatcgtcccttttaatgatggcagagtattccatcgtgaaaatggatcaccatttacttggctaatcctccttggaagggcattcagatgattaccaagtttttttttttttagagatggagtttcactctgttgcccaggctggagtgcaatggcatggtctcggctcactgcaacctctgcctcccgggttcaagcaattctcctgcctcagcctccagagtagctgggactacaggcacatgccaccacacccaggtaattttttttgtatttttagtagagacagggtttcaccatgttggtcaggctggtcttgaactcctgacctcgtgatccgcctgccttggcctcccaaagtgccgggattacaagcctgagccactgcgcttggccaattaccaagtttttgtaagcaactaataaggggtctttttttctccactcagacccaaagtatcgacacttactaggttcaactgctgttgatgaaaactattgacattgttttagtaaggagtcttatttagagaatttcaactgagttttcaggcatggatgactaagattacttgctacaaacatttattttagcttctcagaattagtaatacttctaaacaaaacattctcagtggactctatcttacatttaaaaatatgactcaaatatggtcttgatgtatcaagatgattatttccttgccctgtttgagaaaggtcagacccctgttcccatcattcaccatggaagacctccaaagggcttcatgttcatggaaatgagcccagcattcctaggaaggccccagtgggcttatcattttggtttttcacacaatacagcatattagaaaccaaatcatatcaggggtttattttttcccttccacatgtaggtcttctctcttcccctacacatatctatattttacttatagaatataatcacattacaaacttttgcaaaataagtgttttgttgttgttttgaattccataccccaacactgtaggcttttcaggggattttcttccagactattttcttctactttcatatttatatcttgcctgcttggttcctgcatggatgtgagatggctctcacctttgaccctttcaatctattcttcacaaagcagccaaagcgatctttctaaaatacaaatcagatcatgtcactgctctgctgtaaatcctaccaagggttcacattccaagtagaaaaaaaaacccaaactctttcctgtggcttacacaaaaccctacatgatctagcccctgcctacctctgggaccttatctcttcccacttttctccttgcttgctccgctccagccacactggccttctgtctaccagatacacattcatggtttttttctcattaaaatgtaagctccatgagagcaaggccactgctgtaacccttgggcctagcagagtgcctggcatgtgaaagacattcaagaaatatctgtgagactaagcaggactgctttgttaaggagtcccaggtttgaatatagggctatgggactctggattccccttaaaatctattttagtgtctcacaaaacttttcgctaaactcaccttttcaaagtcacctattcaaacagatcaaagatctccactgtgggaggaatgccaagggccggggtcaagatcccaaggaactaattctagctctacctctactagctgtgagatctttagcaaggcacttagcttctctgttctttggtctccccatctgtaaaatatgagcattatgtatatctccaaggtcccttctagtgctgatatgtcagaactcccaaagctctacccttaaagaggctttttagcagcaaggggagactcttcccagttcttggggccatgcaaacacttactgttgcaaatccgcactccaccttgctgattttttcaatggattccacagcatctcttccgagttctaggagggtgggatcccccgtggcacggtagaggtacattgcgctttcaataagttctgcaaagtccaaagcagaccctcctcactcagtggctgcacagagatggcctggggcctcttagggccgtgagggactactcccctccatatcttgtccataaggccccaactagcaggaacacaggatacctcacccagtgctgagtttcagagccagtatacccaaagcttgaagctcagtggagaccagcattaaggctgaccagtgacttccaccacaagggagagaaaggtggccaggttctggcatagagaaggtggcggaggttgttgcctaattcccaatatctgttccccgcttcctccttagtagcaggattcctaactttagctaagcacaggctgcctggctgccaacactaactattctaacagctaggtgggattaaggacaccatggcgagccatataagcccagaacatgagagagaaatacatttctatcctaattaagctactattttttttcctgtcactcagagtctaacctaattctaaaactcaaaagaagagtaagagcttggcatcataaggctcgttctaagataggatggaccaaaagaaaaggctgagatatccaagagcaggccaggcatggtgggtggctcatgcctgtaatcccagcactttgggaggccaaggtgagaggatcgtttgaacccaggagtttgagaccagcctgggcaacatggcgagatcttgtctctacaaaaattaaaaatgattagctgggtgtggcatgcacctgtagtcctagctactcaggaggctgaggtaggaggatcacttgagcccaggagtttgaggctgcagtgagccatgattaagccactgcggcactccagcctggatgacaagagtgagaccttatctcaaaaaataaaaattaaaaaaataaaataaaataaaccaccaaaccgtcaatctaacaaagacgtagtcatcagttcactgtggccagaaaaagtgatgttttgtcttgcccaattctatgccacaactggaacttgatgttaagacatgagctctaccttaagatgaatattagccaacaggagtgggtccagatgagaatatttattctagagataaggaaatccaaaaaaaatgtgtttattgctttcaaatacctgaagaactgttgtagagttgacttcaagggtggcctcagctcagtatgtttttctacttcatccatcttttctaagagacagaagaacccctgtctcctttctataccatcatctccccctgaccttctcctgtcctgtttcctcctgggcttgatcagtgcttctgtcccttttggcttattgctgcaaactctggttcttattttattccgttaattacttttttgtgacagagtctcactctgtcacccaggctggagtgccatggtgcgatctccgctcactgcaactctgcctcctgggttcaagggattctcatgcctcaacctcccaagtagctggaattacaggcatgcgccaccagccctgactaatttttgtatttttagtggagacagggtttcgccatgttggccaggctggtctcaaactcctgacctcaagtcatccgccagtcttggcttcctgaagtgttgagataacaggcgtgagtcactgcacccagcctctagttcttattttagagaaaaggtctctgcctatctccccagttctctcttacttcctcctcccctctcctcacaggcctctagacaattgctaatctaattgctcatattctaaggcacagactagggtacattcattactagatgaacacattctgtgtgttcaaaggcagaaaagacagtgccctcatgggaggcctcctcttctgcttcttttttcggcttcttcttttttttttttttttttttttgagagggagttttgctgtgttacccaggctagagtgcaatggcatgatcttggctcactgcaacctctgcctcccaggttcaagcaattctcctgtctcagcctcctgagtagctgggactacaggcacatgccaccgtgcccggctaatttttgtatttttagtagagacagggtttcgccatattggtcaggctggtctcgaactcctgacctcagttgatccaccgccttggcctcccaaagtgctgggattacaggcgtgagccaccacacccagccctcttctgcttctagcagctggtgggccagtgccctcatgaccagccatcacgcttctctcctcacatgtgggcctcctaagcatgttagttattgctttactttcctgtgcatctgaccaactctgtcgagcagtggtccccaaccgttttggcaccagggaccagtttcatggaagacaatttttccatgaactgggcttgtaggagatggttttgggataattcatgtgcattacatttattgtgcactttatttatattattattacattgtaatatataatgaaataattatacaatccaccataatgtagagtcagtgggagccctgagtttgttttcctgcaactagacagccctatctggggttgatggatgacagtgacagatcatcaggcatcagcttctcctaaggagcacacaacctagatccctcacatatgcagttcacaatagggtttgtgctcctatgaacgtctaatgccaccacggataagacaagaggcggagctcaggcagcaatgtgagcgatgaggagcagctataaatatagatgaagctttgcttgctcacacgcagctcacctcctgctgtgtggcctggtttctaacaggccatggacttgtaccggtccacggcctgggggttggggaatccctgctctagaggaaggagacagcccaaagttcagatttggacttagaggaaggtaaaagcctgcagaggcctttaggctaggctctgtgctccaacactgctgatcagagagacatatacgaaagtacagggctctggccaatttagtgaaagagtagtccttatctcctatttgccattgttttggggtaggagggatgactggattaacgcactcctggattcctgacagcggtgccttatgttttttttttttggagacagggtctcactccattgcccaggctggattgcagtggcgccatcatggctcactgcagctacgaccacctgggctcaagtgatcctcccaggtagctgggatgggactacaggcatgcaacaccactcttggctaatttatttatatttcttatagagacaaggtcttgctatgttgcccaggctgatcttgaacccctgggcttaaatgatcctcctgcctcaggcttccagagtgctgggattacaggcataagccactgcatctggccagtagtgtcttactttccatgaatgccttcctgccagcctgtcccaaatggaacaggttgcctctgttaagtagcaagctccttgtcactcgtggtaactaagcaaaaactagataaccacttgacagggccatattaggaaaattccaattagaacacctctcaggttccctctaaccctaagattgtgcaagcctatgtcttacatttagttccaaaccctaatctttacctgttggtaacaccagatacgataccttctcagagcttcttatttttaaaatttacttatttatttttttgagatggagttttgctcttttttgcccaggctggagtgcaatggcgtgatctcagctcactgcaacttctacctcccgggttcaagcgattctactgtctcagcctccccagtagctgagattacaggtgcacgccaccatgcccagctaattttgtatttttagtagagatggggtttcaccatgttggccaggctggtctcaaactcctgacttcaggtgatccacctgccttggcctcccaaagtgctgggattacaggcgtgagccaccatgcccaaccaagtttcctgttttaaaaacatgccatgagaacaaatgcatgagaaacatcaataacagtggcctctaaggagtcaaaagttgatgaatttgctctttattccctctcctggtcccctctacacctcctacgataatcacttgagttagaagaggaaggaaatggggtagaggaaggcaggataaccagaaggcctgtcccatggctaaaaggcaattcaggtgggaaagtgggaagtgtctaagacaatgggctcatagcctgttttggggtgggggatgactatgtgtgctgactaagcttccttcctttgtccctctttttctttccctcctcacaattttcagcttccctgaagtgaatcaaatgacattagggctagaaaggaacctatgagagtgtctcaaatatagtcctttgcttgattctgagctgcaaatggggaggtggaagagactaggtaattcctaaggtccgccccaaagttctaacattccatacacgtaagcataatttatctgacccatggacttaggaagcttgcctacacttctgaaatcctgatggcaggagctcaaaaggagtcaaccttggccttttccttctcactcatttcctgatttgaaagagcatatggggccagtcgcagtggctcacatctgtaatcccagcactttgggaggccaaggtgggcggatcacctgaggctgggagttcaagaccagcctgaccaacatggagaaactccatctctactaaaaatacaaaattagctgggcatggtggctcatgcctgtaatcccagctactcgggaggctgaggcaggagaatcgcttgaacccaggaggcggaggttgcggtgagccgagatcacaccattgcacttcagtctgggcaacaatagcgaaactccatctcaaaaaaataaaaataaaaaagagcatgcaatttagttaggagccctgggttccaggcctagctcctgcacttaagagccagaggcgagccatttcatcccactaggcctcagtttccatatctgaaaacatggggataattaactcctagtaagaaaaccacccagagccactgaaaggaacagatggaaagaaatgaacttgtgggcagttgtggaggatggagccttgtagaggggatttggggtttcagcaaccagagcctgtgggcagatgacaagccagaaatgctgctcacctggccgaagtgggtagccctctcgcttctccactgtgtatccctgaggaatgttgtagaattccgggagccccccaaactgcttccatacagtgtagtagttgaggaaggtcctcatggcattgtcaatgtctccaatgaggctctgtgggagaaagtggctgtcaggcaggtagacaccaggcataaaaccccacagacaaccttaagaaaagacaaagtaaaatctgtggggccaaaaaggccttgaatcaatccctgagtctgccagttactcagtgtggtgctgagccaggcactggacttctctgagccccatctataaaacgtaaaatacaccacctatctcatgcattgttggaaggaacaaagattgtatattaagtccctaaatcttcagagtcaatgtcagctaacagttttggaattcggccagccagttaaaaattctaagaatagagaaaagtttgtgctaaggctcactcccacaccacacccccaaaagataaccatttttgtttttgtttttgagacagggtctcgctctgtcacctaggctggagtgcagtggcacaatcacggttcattacagccttgacctcctgggctcaagagatcctctcacctcagcctcccagtgctaatttttttattttctgtagagatgggggtctcactttgttgcccaggctggtcttaatctcctgggctcaagtgatcctcctacctcagccttccaaagtgctgggattacaaccatcacccatcttgcctggcctcagataaacattactggtttcttgtataacctttcagagtttctttatgcatgagtatatgttattttccccacactaaaaaatagcctttggttctttattaatagggatattaattatctccatatttttagatatggaaatttggctttcagatatttttatttgaattggttccaacaactaatgtggcaataaataattctgtatatatgtcacatcaaatagatgtaaaatgttatgtgtaagatacattttcagaattaggatcactgggtcaaaggatatatgcatttataattttaccactattgctaagtagccattactattaatgtaatctcacagggaagcagctgaccctgacatcttcattggatgtctcatggacagaacaaacttggcacttcctaaacaaaattcttggttcccttactttcccacgaaattgcctccctactttggcctttttcccttcttggtaaatgacacaatgtctacctggttattctggatagaaacccggtggccactttttttttttttttttgagacagggtctcactctgtcacccaggctgcaatggcatgatcatggctcactgcagccttgatcttctgggttcaagcaatccttccactgcagtctcctgagtagctgggactacaggcatgtgccaccaccctaggctaattttttatttttatttttatttatttatttttatttttttgagacggagtcttgctctgtcatccaggctggagtgcagtggcgcaatctcagctcactgcaagctccgcctcccaggttcatgccattctcctgcctcagcctcccgagtagctgggactacaggcgcccaccaccacgcccagctaattttttgtatttttagtagagatggggtttcaccgtgttagccaggatggtctcaatctcctaaccttgtgatccgcctgcctcggcctgccaaagcgctgggattataggcctgagccaccgcgcccgacctaattttttattttttgtagagatgaggtctcactatgttgcccaggtgggactactttttcttaaaacttttaaaaacgtagattataaaaacattttggtacatgcactattttggaacaccaaagtggggtagattagataagctctaagatccttccagctgcaactctaccagaccatgtaatggaaaaacaacgagatggcacagcggcacaagctgcttcctgcccttcctgaggcccactgtcaagaatgagattggacagaaacgcccagtggagaaacacctgttgccaatggccattcctgcccagactggaaatgcactgtcgactttaagtactgtaacactccatggcaaactggaagctcagttcctgacactcaatttggcagaactctaaatctatctaattcactctaggtctctcttccatcctcaacctgtccctccaaaaaaagtactcaagcaattaacaaagtacattatttgacttatacatcagaatgagcttgctttgccagactcatagaaagatgatcacattctttgatcattcctacctgaagaccaggccagtaggcctccaaggactggaagactggcatggacacagtccccttgtacatctgaacccacaggtaccagtcatcgaagcgggtgtagttccggatggctttgttatactctgcagtgggggagatgggataatggacatatgagtgattagggagaaaaaaggcaggcctggacagcggaagcgagaacttacactttggaaagagcaccaggatgcaatgaggcaaggaggctagacaagagcatggattctggagtcaaacttccagctcaaattccagctccagctctaccacttgctaaccgtgacctggggtgggtttttcccttttaagcctcagccttatgatctataaaatggggaggccaggcgtggtggctcacatctataatcccagcactttgggaggccgaggtgggcggatcacctgagattgggagttcgagaccagcctgaccaacacggagaaaccctgtctctactaaaaatacaaaattagccaggtgtggtggtgcatgcctgtaatctcagctacttgggaggctgaggaaggagaattgcttgaacccaggaggcggaggttgctgtgagctgagatcgcaccattgcactccagcctgggcaacaagagtgaaactccatctcaaaaagaaaaaagcagaaaataattgatgtggtttggctgtgtccccacctaaatctcaccttgaattgtagctcccatatttctcacgtgttgtggaagggacctggtgggagataattgaatcatgggggccgtttcccccatactgttctcatggtagtgaataagtctcacaagatctgatggttttataagaggtttcccctttcacttggctctcattctctcttgcctgcaccatgtaagatgtgcctttcgccttccgccacgattgtgaggcctccccagccatgtggaactgtgagtccattaaacctctttttctttataaattacccagtcttgagtacgtctttatcagcagtgaaaatggtctaatacagtaatgttaggtatctgtggaatttttcagtcatttatttataccacaaacattcgctaagcacctactaggttccaggctcctatgagtttgtaaacaagacaaaatccagccttcagagaacttacattctagtaggaacttgaatttatccctcatatctctcccctagattgtaaatccatgaggcctgggactttgttttgtctactgcagaatcccccacactagtacaatgagcaataaacattttctgaatgaacaaagtaccaaatatacatgcaaataaataagataatctcaaacaggagttgtaaggattatatgaaacagtccatgttcagagcttggcacaatgcttggtacatccgtggtattcaataaatatttgttgaataaatgagtaaagtagtccccccttatgtgaggagaatacgttccaagaccctcagtggatgtctgaaaccatggatagtactaaataaactctatatacagtcatgtgccatataacaacatgttggtcaacactgaactgtagagatggtggtcctataaaattataatagaggtgaaaaatcaccacagcctaaagatatcacagctgttgtaattttataatgcaatgcattacttacttgtttgtggtgatactggtgtaaacacacctactgtgctgccagtcataaaagtataacacatacaattatgtatagtacgtgatatttaataaacaaccatttacgcgtttatgtatttactatattattatcattagataactccttcctcttatataaaaaaagtcggctgggcgtggtggctcacacctgtaatcccagcactttgggagggcgaggtgggcggatcacgaggtcagtgttagaccatcctgcctaacacggtgaaaccccatctctactaaaaatacaaaaaaattagctgggtgtggtggcgggcgcctgtaatcccagctactcgggaggctgaggcaggagaatggcgtgaatccgggaggtggagtttgtagtgagcggagatcacaccactgcactccagcctgggcaacagagcaagactctgtctccaaaaaaaataaaaacaaaaacaaaaattagctgggcgtagtggtgggtgcctataatcccagctgctcaggaggctaagacaggaaaatcacaggagaattgaacctgggaggcggaggttgcagtgagccgagatggtgccactgcactccagcctgggcaacataagcaaaactctgtctaaaaaaaaaaaaaaaatgaaacagcttcaggcaggtccttcaaggaattccagaaggcattgttatcaatcatctgagataacaacagttctgtgagtgttactgcccccaaagaccttctagcaggataacatggggaagtggaagacagtgatattgatgatactgaccctaggcctaggctaatgtgtgtttgtagcttagtttttaacaaaaaagtctaaaaggtgaaaacaaaataaaaaactaaaaacagaaaaaaacttagagaataaggatataaataaaatatttctgtatagctgtacaatgtgttttaagctaagcattattacaaatgagtcaaaaagttttttaaaattttaaagttcataaagtaaaaaagttacagtaagctaacgttaatttattattggaggccaggcatggtggctcacgcctctaatcccagcactttgggaggccaaggtgggtggagatcacctgagatcaggagtttgagaccagcctggccaacatggtgaaaacccatccatctctactaaaaatacaaaaattaggccaggcacggtggctcacgcctgtaatcctagcactttgggaggccgaggcgggtggattgcctgagctcaggagttcaagaccagcccgggcaacacagtgaaaccccatctctactaaaatacaaaaaattagctgggcatggcagcgtgcacctgtaatcccagctactcgggaggctgaggaaggagaattgctagaacccgggaggcagaggttgcagcgagccgatattgcaccactgtactccagcctgggcaacagagtgagactctgtctttaaagaaaaaaaaaatcagccaggcatggtggtgggcgcctgtaatcccagctactcaggaggctgaggcaggagaatcacttgaactggggaagcagaggttgcagtaaaccaagatcatgccactgcactccagcctgggcaacagagcaagactctatctcaaaaaaaaaaaaaaaatttattactggagaaagaaaaaaaaatttaaataaatttagtatagcctaagtgtacagtatttataaagtttacaatagtgtaatgtcctagaccttgacattcactcaccactcactgactcacccagagcaacttcctgtcctgtgaacttcattcatgtgcccttttatactgtatttgtactgtactttttctatgtttatatacatacttaccattctattacaattgtctatagtattcagtagagtaacatgctgtacaggtttgtagcctaggagcaataggctacaccatatagcctaggtgtgtagttggctataccatctaggtttgcttaagtacaccctatgatgtttgcacaatgatgaaatcacctaacgatgcaattctcagactatatccctgtcattaagcaatgcgtgactactgttttcctatacatacacatctatgagaattcttaattcattaaatttttaaaaatttttatttttgagacagggtcttactctgtcacccaggctgaaatgcagtggtatgatcacggttcactgcacccttgacctcccagggtcaagcaatccttcaccttggcctcccaagtagtggggactacaggcacgcaccatcatgcccagcaaatttttttttattttttgtagagacgaggtctcaccatgttgcccaggctgatcttgaacttctggggtcaagcaattctctcgcctcagcttcccaaagcactgggattaaaggcatgagccactgtgcctagccgaaaaagtttaatttataaattaggcatgggaagagattaacaacaataactaataataaagcagaacaagtataacaatatatgttatagaagttatgtgaatttgtctttttggtaagagacaggaaaaaaagaaattatgtaaatttagtgcctcaaaatatctttgtttttttagagagggggtcttactatattgcccaggctggtctcaaactcctggcctcaaacaatcctcacttccaaaaaactgggactacaggcgtgagccactgcacccagcctcaaaatatcgtatctgactgtactcacctattttcagactgcagttgaccatggataactgaaaccatggaaatcaaaactgtggataacgggggactactgtagctataataataatagtaattaggtgctcaacaattcctcaagattgctagtgtctaagggcctggcgggtaagatgtatttattcaacaggtattaatctattacctaccacatgtaaagcactgtggggaacataagatgagtaaggcatggattctgcattcaatttgtagagctgtaactgttgatgagagctaactgcaagaaagatgctgaaggtcccaaattctgtagaaggatcaagctacttcctgggcaaggcgacatttaagttaggctttgaagggtgaaaagaatttggacataggaagacaggaaaaaagacattctaggcaaagaagatgccatgtgcaatggccaggagataagaaatccagggctacatacacagaatgcagcacgcttcagttggcttttgcaagaaggcatcaagtgctgtagtgggcatgaagtgggcagtgtaagtccatagtgactctgaattcagaactgattctgcaggcactcaggccaggcgtggtggctcacacctgtgatcccaacactttgggaggccaaggcgggcagatcacctgaggtccggagtttgagaccagcctggccaacatggtgaaaccccgtttctactaaaaatacaaaaattagctggatgtgatggtgtgcgcctgtagtccacaccatcacatgcccagctactcaggaggctgaggcatgagaatcacttgaacctgggaggcagaggttgcagtgagcctagattgtgccactgcactccagcctgggagatggagcaagactctgtctcaaaaaaaagtttttaaacaaatcacacatcagcaagaaaaatgaggggaaaagctcccttactctgccatttttacctaggaacatggccatgagcttcttatcctgaagcaggatggctcctttcaccaagtactcaaagtaggagtccacgccagccccgatgcctgcgtcctgggccacccacttgccagtgagcacatcaatgtggttgccgacctgagagagagaaagacacacggtcccaacgggaaggccgatggccaaagaaggatctactcacccccaaccctgactgcccagggagatgcagggcaggtgccccagtgcttcttgggaaacatgcagaccctgagagggaagggcaatgctggatcatggccagccttcctgtacatctgcatagtagagatgcatctcatgcacatttatgaggacttaattatacacattgagcaaaaaatgaaaaagaaaaatgatttggagtgtttatgtcctgcctagagtgagtgtgagatgggagatgagaatttgctgttgccgcaatctgtctgatttctcagcacccagcatgtgattccactatctgaagacacagacgtgctttacgtatttccataaattaactcaataagaacatccaccaagaagctgacagagtggttctaaggagagaaaccgaatagctggagacaggggcaaaaggggacttcaccaatgtcactgagtacccttttttgtatcctttgacttttttttttttaattgttcagtctctgtagagactgtgaaaaattggcaatgccggccaggcgcggtggctcatgcctataatcccagcacgttgggaggctgaggggggcaaaatcactggaggtcagaagtccgagaccaacttggccaacatggtaaaaccctgtctctaataaaaacacaaaaattagccaggcatggtggtgtgtgcctataatcccagctactcaggaggcagaggcatgagaatcacttgaacccaagagggggaggttgcagtgagccgagatcgtgccactgcactccagcctgggcgacagggggagactctgtctcaaaaaaataaacaaagatacgtatttttctattttattgtatttattttattttttgtatttttagtagagacatggtttctccctgttggtcaggctggtctcgaactcccgacctcaggtgatacgcctgccttggcctcccaaagtgctgggattacaggcgtgagccactgcgcccagccaaatatatgtatttttcatatggcttagaccctcatggaagctggtaacttcatctggtactcaaagaaatagctaactgttccgcgttggtttgtgtccccccaggagcacaacctcattctgcctgaaagtagttgatttggaaggtaagtccttgtaaacaccagtagaggagggggaagtgaggcagggcaagggaggcggcatttaaggggtatgccatcaggcaggtttccaccatgggaactggagttcaatcttgctggggagcttaggaattcagtgtagagctccagcttcggagtgatcccacccaaggggcagggaactggaatgtttatccaccaactcccatcagtatcagttaccggcttgagagctactcatgggtagcattaaatcctggtaccctcagccaaaggcaagcagagtggctccaggcaccagaggagacccacaggcaaagaggcgcaggtgatggcagttggaagactggccagtgtgcatggaaatgttaagagttgagaggatatgggcatggcaccaacagagtctactacggtcccactgctggagcaaaacctgcctgagatggactaagggatttactacaggtctccagcggggcaccttttttttttttttgagatggagtttcgctcttgttgcccaggctggaatgcaatggcgcgatctcggctcatcccaacctccacctcccaggttcaggcaattctcctgcctcagcctcccaagtagctgggattacaggcatgcaccaccacgcccggctaattttgtattttttagtagagatggggtttctccatgttggtcaggctggtctcgaactcccaatctcaggtgatccgcccgcctcagtctcccaaagtgctggaattacaggcgtgagccaccgcacccagccttaggggggcaccttcttaagggattttcggggagtcctcacacaagctttacttttcaagctggattagcaccagactgcataaaatgtgcctagacctaaatgcagtcttcctaagtcagagtgactcagcaaagttggtattaatatattaacgttactgctgaagtaactgaggaccagagaggttgagtgacttgctcagggtcacacagtttcgatgtagcaaggccagggcttgaatccagttctgactaaatccagtgttatgtcctggatggctttggctcaattactgttaatcttattgattatcccatttagaagctgaaactgaccttagagatcatctggtccaaagtgtgttcaatttccatgggttaatagtactggaagataaagggaagctctggtgttaaataagtttgggaaatgttaaattaaacaaagttgaatagatttctttactagaggatttttattctgctcatgtgcattctgactctccaaaaaagggggggatattatatctaatattcccctaacttaattggccaagactcattttttcatgcaactgccactcagtatctctcagaaccggtgtcctaagaaacacagcaaatacagatagacgctaaaaatgaaggccggacgagctgatgatctgaagccgtcaagtgagtcaggggcatgaaacatacgaccctcttcctagaaatcagagaatctcaactggtcaaagctgaatgcagcccctgctgcctgccagaaacgtgctttcccactctcctccccactccaagccaaacttgaattggaggcttggtctatttttggtgtcctgagcccaaatcctggaccactcccaaggtcaccctaagttttccttggcttgactgcaacttattgctcagagccctgggcctcgtaagcagggactcaaacaggaagggcagcagcgaacctaccagcccgatatctgaccggctctcccagaggcgcatcaaagccactctggccacatcttcgaacaccgggtcaccagtgaggctgctcagggtggcaaattcaacaatgaaggtcccaatccctgccgtacaggtgacaggggtctctcctgggttcacgccatgaagtaagttcactgttccatatggcatgccagtgggggtctgaaaggctgaacaatcgacaaattatgatcccggacaggagcagggggatagggatagttctgatacacgcccaaagcctgggaccttagccagcacttccctctttctcctgggtatcctgctagagtctgagccagagaaagataaatgtcataactggagggccctgagcagccacccagcccagatgctgtcaaacactgctctgcataaccttgggttcctgctcatcatgagggggcagggagcaggctgtgctccacacacactcgctttagctagagagctttacctatttttatttattttacactacgccttcaaagcccaggcaggtaacttattgtgatgcaggcagggtttaagccacagaaagtggtggggcttgtggcacaatgacaagagtaagccccgttcaaagccattcatagacttttggctcacgcctataatcccagcactctgggtggccaaggcaggcagatcacttgaggccaggagttcgagaccagcctggccaacatggtgaaaccctatttctactaaaaatacaaaaattaggcaagcgtggtggtgcacgcctgtaattctggctatctgggagactgaggcacgagaatcgtttgaacccaagaggcgtgggctgcagtgagctgagattgcaccactgcactccagcctgggtgacagagcgagaccctgtctcaaaataataataataataaacaaagccattcatagactttaaataaagatctctgctttaaataaagagtataggggctaaattatttttaaagggaagcaaaataggatataaaccactaaaccacggatatagtatgaccctcgatttataggtagggaaaaccatgcctgtaaagaagtaattcagccacaggtcacacagagagagtcaaacagagctgggatgggaacgcctcccctgtgcccaccccagccccagtccagttctctgcccgccccacccaagtggcacccaagtgccttctggttcaagacgagaactggacaaccagccagaggcagagatttcctctctgggcctaaaggtcaaacaactccagagcagcctatgcgtcaccaaactgtgaacaaaggtgtcgacacttccaagaaccacagggtctagcaactgtgtctgccacagacaagaaacttgcaatctggcaggcaccagcgggagagcaagtcacaaccaggaagggctctaagcaatatttcagaaaaagtcaggctgtaataaaaagaagaggagtgacaaaatcctgtttcttgacctttttttataaaatgaccaatgaccaaaaataattaaattataaaggaggagcagctaggcagagtttccagagtttcctccagggatgaatcacacaggacacaatgtctgcaaggagacgctcaagccatgagccatgagccatgagtgagacctgaacctagctcacccgctatcctcagctctcccccaaaggagaggcaagtgctatgtgagaaggataaagaggccgggtgtggtggctcacgcctgtaatcccaacactttgggagtccaaggcagatggatcacttgatcccgggagttcaagaccagcctgggcaacatggtgaaaccccatctctacaaaaaaaaatttagccatgcatggtggcatctgcctgtaatcccagctactcaggaggctgaggtgggagaatcaactgagcccagaagttcgagaggctgcagtgagccatgatcacgccactgcactccagcctgggcgacagagcaagaccctgtctgaaaaaaaaaaaaaaaaaaaaattaagaaagaaaagggataaataagtgagatggccaagaggtgatggaaagcacagtgtgacgtgtctgggtgtgaacagtcctcagagcctccaccacaccctgaagggaacacagtgtacagttgatgctactgagcctggtgttactgccccactagacaaaaacatggaggcttgacctgcagccctggacacagcttagccacaaaacaaatccctctcgttttaaaagtgttggacgttctctaagcagtttctccttcctgacctcattttagcctctccaaaacccgatgtggtagggaagtagaaattatgattctcatttgatagatggggaaaccaaactgtggagagaggccagacacagtggctcatgcctgtaatcccagcactttgggaggccgaggcagccagatcacttgaggtcaagagtttgagaccagcctgatcaacgtggcgaaacttcatctctactaaaaaatacaaaaattagctgggcatggtggcaggcgcctgtaatcccagctactcaagaggctgaagcaaaagaattgcttgaacccaggaggcggtggttacagtgacttgagattgtgccactgcactccagcctgggcgacagaacaagactccatcacaaacaaacaaacaacaaactatgaagagaaagagtggcttggtcacgatgttggctggcagagctgagtctagaatccagggctgctaatgctcacaccaacacccttccctgggcccctgttactccagcagtgtgtggaataactgtagtacctggaaggggacaaatgggctcattcaaaataagggtaatggccttccacccaccaggctggccaccttcaaccatcccctgcaaacaataatgaggtcaactcatccatccgggtcagggccccagcaggcccttaaaatgcccaggacactcctgatttccatggtgggtgcctggtgggtagaaagaccaaatacacctggtgagaaataccaggaattaattcagcactgccactctcatcttcagcaagggaagcaggacctactggacttcgtctctgccccatctctgtgtgggtcttacctgggaggagttttcgggccgcctcctcagccattctcaggagaggcccggaacagggccatccagcctctacttccaccccagccttcttggagagcagatgagcagacaggagtcctcctaccactacagatggcacagaaagcaaatggcacagtccaaagggaaagaccaagggatcaaggatctttcccctgtgcgagttaaacataaacactctattgtggggcgcatgttctcaggacctcctgaagctatttcacgggtaaaaacaaacaaacaaaaacctcactctgttggggtggctcactgggaaggagctagagccacccagcgaaaaaagagtcccttaatcccacatatttctatggtgttaagtttatggggttttcttctcttggttcatcacaggaacagtggctattttttgtaagtccctattgtgtaccaagcactaagtactactgtcccctcttcgtatgaagatactgaggttccatgagataaagtgacttgccccaggtcacccatctagtaggtggtagggctgagtatctttgattccaaagcccatgctcattccatttgtcactctgtctgtctcccagtcacctgtcatacctggggggaaggggtaatgatggttattacctttattttactaatttatctatttcaacttattatgcaatatgtagaactttttttttttttttttgagacggagtctcgctctgtcacctaggctggagtgcagtggcgcgatttcggctcactgcaagctccgcctcccaggttcacgccgttctcctgcctcagcctcccgagtagctgggactacaggagctcaccaccatgcccggctaatttttttggattttttttttgtagacacggtgtttcactgtgctagccaggatggtctcgatctcctgacctcatgatccacctgcctcagcctcccaaagtgctggatttacaggcatgagccaccgcacccggcctacttagaacttttaaaaagacacaaaggttcttggaaatacagctaaatagatatcctgagtggccctctcaatgaaaataactggtgaccctaagtttcaaaattcccctcctccctgcagagggggaataggagaccaaggtcagacctgccccaagtggaagtctgataaaaggtccctatgcaggccaggcatggtggctcacatctgtaatcccagcactttgggagccgaggtggagatcacgaggtcaggagatggagaccatcccggctaaaatggtgaaaccctgtctctactaaaaatacaaaatattagctgggcgtggtggcaagcgcctgcagtcccagctacttgggaagctgaggcagaagaatggcttaaacccaggaggtggaggttgcagtgagccaagattgcaccactgcacttcagcctgggtgacagagtgagactccgtctcaaaaaaaaaaaaaaaaagtctgggcacggtggctcatgcctgtaatcccagcactttgggaggctgaggcaggtggactgcctgagctcaggagttcgtgaccagcctggtaaacacggtgaaaccctgtctctattaaaaatacaaaaaattagccgggcatggcgttgtgcgcctgtagtcccagctactcgggaggctgaggcaggagaattgcttgaacccaggaggcggaggttgcagtgagctgagatcatgacactgcactccagcctgggcgacagagcgagactccatctcagaaaaaaaaaaaaaaagaaaagaaagaaagaaaagaaatctacatgtatgtaccttatggtaaaactgcagaacaccaaagggaaaaatgatctcgaatgcagccagaatccatgtaataataattattaatgctgggtgatgggcacgtctggttcattatgctattttctctacttttatgtttgaagttttccataacaaaaagtttttaaaaggagaagacagccaaagtgaaaaccaaaacaagattctctacaaataaataataattacattgacagattacttcttaacaataatgaaaccagaagataatggaaaaagtttttaacacaataagagaaagtaaccatcaacctagaaccatacacccagcaaaaatatcactcaaaggccaaccaaaggcagttgaataaagacattttcatataaacaaaagctgggaatgtttatgaagcacacacctgcattaaaggaaattctaaaggaaatactttagagaaaaggtctgagacacgaaaagaaaaaatagtcaaaaaagtggtaaataggccaggcacagtggctaaacctgtaattccagcactttgggaagccaaagcaggtggatcactcaagatcatgagtttgagaccagcctggccaatgtggtgaaacaccatctctactaaaaatacaaaaattagcctggtgtggtggtgcacaactgtaatcccagctactctggaggctgaggcaggagaatcgtttaaacccaggaggtggaggtgagccaagatcgcgccactgcactccagcctgggtggcagagtgagactctatttcaaaccaacaacaacaaaaaaagtggtaaatttatgtgtaaatgcaaaacttcaacaatatagaacaaaaattataatgtatggaaggtttaaaacaaataactaaaatatataactgtagcatataggtcaggatgttctctaagtcaggttttgcattattcaggaggagaacaaagattttcattaaatttagactttgataagttatgtttgttaaatttgcttggaaaactatgtaaaaagctagatattgtgcataatttccatattagtaagaggaaaatggaatggggggaaaacaatctaaagaaggcatgaaaaaggacagaataaaggaacataaagaagatggcacagggccaggtgcagtggctcacacctataatcccagcactttgggaggctgatggggggcggatcacctgaggtcaggagttcgagactagcctggccaacatggtgaaaccccatctctactaaaaatacaaaaattagcagggcacggtggcaggcacctgcaatcccagctacataggaggctgagacaggagaatcgcctgaacccgggaggcagaggttgcagtaagccaagattgcaccactacactcccgcctgggcgacagagtgagactccgcctcaaaaaaaaaaaaaaaaaaaaaaaaaagaagacggcacagagagcacaatactgtagaaatgagtgcaaatatatcagtaattacagtaaatgtaaatggattaaatgtgccagttaaagattgtcagaatggataaacaaaatataatacactatttgcaaaagatgtatctaatcataaaactacagaaagatggaaaggatagaaaaagatacatgggaaaatgtcaaccaaaagaaagctggtatcacttatattcctatcagaaataaaggtataagaatgaccttcatttacagatgacaaactgggctcagaagctgggagacatagcagcaagtacagcctcaaactcaggccggattcctaaaccaggattttagaccatgttgtccctctgctctcttctcttttttaatcttttatggatcatatgtctggaatataagtttcattgcagaaaacatacaaaataatggggaaaaatagaactctgccatccagaggtgacagctgttaagtggtctagaggttcgatgcaaataagggctgtgctggcttcacaagaatcactggaagtctgctaaaaatactgattctaggacccaacacagagattccaattcattaggtttagggtggagtctcaacatctgaattttttaaccacttgggagtggttcctatgggctgccaagtttggaagattaatgctgtagatttgcactgtccaatacaataatcactaactacatgtgactacttaaatttaatatcattaaaattaaatgaaattaaaaattcaattccatagttgtagtagatacatttcaaatgctcaatagctcatgtggttcgtggctaccatactggacaaaacacagctataagacatttccatcactgcagaaaattggattggacagacaataagttccaagaaggcaaggatcatatctttcttgttcatagctgtatgcctagtatcaaatacatattaaagaggtgagtaatctggtgtatttctttccagtctcttagtctcctgctcactttcatatctgaaactgatggggaaatcctgagacttccccacctcaccctccaggagggaagaagagctctgtcggtcagaggttttggccaagggtcctggcatggtcagtccttaaaatcctatttaccacttcttggtttacagaggcaacttcacactcttttttcttttaaaggtcctagagagcagcccttacctcgaatgtttgtttcaaacacagaggcgttcacatcaatatcaaagtccacgctgtcctggagcacttcaaccactctttggaattctgagacattccccaaaatctggaaataaaaaagagacctgacaatgaggctcttacatgcatggaggcagattcagagtctgggatcctatgttgatgtggccctcactaattccacttaagacctccagtttctgtcctaggattggtgacagcagaagaaaacactgagagctagaaatcatctagagacttcataccaagagactggttaagtaaattcctaggtcccaattaagagtcacgatgttgtcatttaaatggacacaatataaagaacgcaaactacgcatagaagtcttaggttttttgtttcgtttttttgagacagagtctcgctctgctgcccagggtagagtgcagtggcgtgatcttggctcacttcaaactccgcctcctgggttcaagcgattctcctgcctcagccccgagtagctgggattatgcaccaccatgcccggctaatttttgtatttttagtagagacggggtttcaccatgttgatcaggctggtctcaaactcctgacctcatgatccacccgccttggcctcccaaagtgctgggattacaggtgtgagcgaccgcacctggccaaaagtcttagtttgacatttgcagtagataccagttgtcaccttcaaccttgtggaaaacagaacaggttggttggcccaaaacaaattcattcctaccctctttacctcatggcctcccaccagaggttggaaatccagaagctttctcggcctcctttgctgctgcagttgattgtgttacccagtcaattctgacccttgagaggtctactgggggcacttctgggaaggcttctgttttcttaataccaagggacaaacacagctaacatggcttttagtctctctctttctgccttgaactcagactcgatttctgaagtgatggcagctatgtgagaccatgacgtactaagcattagaataaaagccaaaacactaacgatactagaatgcaaagctacaaagaggctggtctctaatgacacagttgcgtagctgacccaatgctagaaattacctctagactttcttttacttgagaaaataaaccctctttatttaaaccgttagccaaatgcaatctcaatctctcttcttttgatagtaacatctcaatttaccctcgaggaatcactcttccccggcagtcactcctgtggtttgggagaggctgatcccatccctctagctgtggagtgggtacttgacctgaaccagtccaagtcttttttttgagacagggtcttgctctgttacacaggttggagtgcagtggtgtgatcatagctcatcacagcctcgaactctgggacttgagcaatgttggcctcccaaagtgctgggattacaggcatgagccaccacacctggccctttttacctttctaagcatcaggtttcttttatatcttttttttgtttgtgtgagacagggttttactctgttacccagaccagagtgcagtggtgcgatctcggctcactgcaacctctgcctccctgactcaaacaatcctcctacctcaccctcctccctaacaaatggagccacagacatgtgccatcatgcctaattttttatatttttggtagagacggggtttcaccatattgcccaggctggtcttgaactcctgtgctcaagcagtcctgccgccttggcctcccaaagtgctgggattacaggcgtgagccactgtgcccatccctaagcatcaggtttcttaacgataagaaggagtaaaggtactaacctcaagaagttgttagaagaattaatacatgtctgtactaagccctacagaaacatactaactagtcactgatattatttctttataattttttttgagatgaagtttcactcttgtcacccaggctggagtgcaatggtgcaatctcggctcactgcaacctccgcctcccgggttcaggcaattctcctgcctcagcctctccagtagctgggataacagacatgtgccactatgctgggctaattttttgtattttaatagagatggagtttcaccatattggccaggctggtctcaaacccctgacctcaggtgatctgcctgcctcggccttccaaagtgctgggattacaggtgtgagccaccatgctcagcctgatacccttttattatcattgaacatggccactagaatgtaagcctctgaaaacaggagatgtcaaagtctctgtatcccccatagagctatgcaagcctatcacaattctccgtacataacaggtcctctataaatgtttgctaaataaatgaatctgcataagttgtagttcgtttttcccctatctagctaggcaaccacagccggacgcttcagaatcatgagatgcaaataaaaggcctaggagaggaattcatttttcacccacagtcacgctgccaaaagaggaaggatgttggttatgtaacagtggaaaggaaaagaaacagacgagatacttaccagcaaggtgtccagtgcatcaattagagtcagagaaaaactgcaaaaggacagaaatcccagccgcttagtaagaaaatcaaataccagatattatggctgccctagatctgatccccctaaaactaaatgaggcaaagtaatgcctctgcctgtcccacttacagtcacaacagagaaaccacagtgaaaatcgcaggtattctctgacccacttaatgcacctgggagggttggctgatgtagctcaattgtaattaaatacatcacctatagtctggcattctcctctaccattgggaggcagtataagattgcagcttaaagcacaggcctttcaccaattttcacctctaggaatttaattcacagtgaacagctgtttgagagtgttcatggcagtattgcttagaacagcaagaggctggaaagaacccaactgtccacccattaatgggtgattaaactgtgttataaacagtgcaaaactatgagttatcaaaaagattgttatcaagacttctatgtgctgatggaaagacattcgaattgtttttaatgaaaaagtcagggtggtttagtatgtttccatctgtttcaaaaagacatgctgacagaaagcagacagcaattgttagggtcagtggtggtgcagggatgaactataaagggccacaagggaactttttaaagtgacagaagtgtttcatatcttgactgtgatggtggtcacttcaaacgagtgtaggctgggcacagtggctcatgcctgtaatccgccagcactttgggaggcctaggtgggtggatcacctgaggtcaggagttcaagaccagcctggccaaatgacaaaaccccgtctccacaaaaaaattagccgggtgtggtggtgggctcctgtaatcccaactacttgggaggctgaggcaggagaatcgcttgaagccaggaggcggagtttgaagtgagccaagatcacgccattgcactccagcctgggtaacaagagcgaaactccatctcaaaaaaaaaaaaaaaaaaaaaagagtgtattttattatatgtaaattatgcctttaagaagttcattttaaaaagatacacatacacacatctatatatataatggtataaaccaagaatatttctggacagatacaaaggaaagttaatagttggaattctagggtatgggagatatttattgtatataatcttttaccacttgaatttgccatttgtatttactttgtttcaacttaaaaaaataaaaaccatcacaagttttgagtttaatttctcccgaccttagcacattcgtgtgtaaaacagggataatggcacctaactcgtaggggtattaagatactgagctgagatctgaatgacaagcagcagccagtgatgggaggaaaatggggagtgtatttcaggcacggggcacaccaactacaaagacttaagttttaggagtgtcacactccttcctggatctgaatgcccacctacataatgaaaggggtgggttttctaattcttggagcccttccacggtatctcgttactccagaaattgcctatgtccccacagctgatgcctgttactgctggggctgagctcagcgatccagcccacccggctaatccaggactttttttttcactgcgagaggctaagtggatcctggaggtgatagtaagaattgcggggagcgcggctctagctcagctgggagctttctggtgccggtgaggagaccatgaagccaccagccccagctgacccgcccgccgaggcccagagagtcagaccctggccgccccttgcccctccgctcgcactacctgccccaggtgtcgtgcccgtcacaggtgagaggtcgcagctcatcgaagggaaaggcattctccaggtagctgtcgtaggcgtggtagaacatggccttgactcgctccctgggtgggggacgagaaatcaggcatggggcaagaacacaaaaacaagcgggggaagaacaagatacagggcggaaagtgggaatcactagctgatttctccctgggacctagcggctgtgtcggagcaagtcggggtctgggatggacggaaagggaaaggaccgggttcacgcttcccattccccaactgcgaaagggcgggtcacagttcacctgtagtgggcgggatctggcgcggagccgtcgggacctggcgcaccatggtgctgaggcagcagcgcgcacaggaggccgagcgggatgagcagccggaaaggcatagagctcgtgtcctctcagcgcccccgcagcagcagcagccactgcaaccagttcatcctgggagctgctgcgggttcttccgggaatccgcgccactgcgcctgcgcgctgagaaatcagcctctcacttccggactacaagcccctgaatgcaatgggcagcgaaacgcggccgaagagcaacttcggatgtacggtttcggcaacactgatcaacgtgtcttaaagtcagtggctgttgttactactgttattaattaatgttttaataataacagctagcatgtattgagcacttattgtgtactagtactgtacggagcatttaaaatgcattctctcattcatttttttcaacaaccttattaagtatgaaggcagggtaagcatgagaaatgttcagcctttaccattattacctagcaggacaagccgcagacaaaactcctcagacaccgggttaaagaaggaaggagctttattcggccgggagcgtcagctgactcacttctcaaaaacggagctccccgagtgagcaattcctgtcccttttaagagcttacaactctaagggggtccgcgtgagagggtcgtgattgattgagcaagcagggggtacgtgactgattaccggtgcaccggtaatcagaacggaacagaacaggacagggattttcacaatgcttttccatacaatgtctggaatctatagataatataaccggttaggtcaggaggggtcgatctttaattaccaggcctggaatgcatcgccgggctgtctgactactgatttcacttctgtctttcttttaactcctacattttctttgaggcagaaattgggcataagacaatatgaggggtggtctgctcccttatttagggatattgagtttcccaaaccagttacttgttgattgtataagacacaactcacatttatttgtccaaaacttccactcttttttttttaaaacctcttgcattttccgatgctgtcactcttgaggtttcctgaaatcccgtcagttctaggaattcatgacacttctctcctcccaatttgggatgtggttacacaatcatggtcccttcagtctccatctcaaaccggaagctttacccctgtcagccctgtagaatgtcttgggtaagaatgaataccctggttgggcgcggtggctcacgcctgtaatcccaacactttgggaggttgaggtgcgtggatcacctgaggttaagagatagagaccaacctggccaacatggtgaaaccccgtctttactaaaaatacaaaaattagccaggggtggtggcgggtgcctgtaaatcccggctactcggaaggctgaggccggagaatcgcttgaaaccggaaggcggaggttgcagtgagcgaggatcgcgccactccactccagcctgggcaaaacagcaaaactccatatcaaaaaaaaaaaaaaaaaaaaaaaaaaaaagacaaatgactaccctggggcactatagctttcaggaggtttgtgatccatttctccattccccttattcccaagtttctaaaatttggtcagcaccttagaccacagcaacacccatgactttggtcagtgtgacatgcggtagaaccaacactggatttgaagtcagatctaggatccagttaattacaactctgtcactcatctataacctgtgtatgtgaccctctccttctctggggctagcatccttgtctataaataatgaggagtttgaacaaatggatctttaagatccttttcggtcgagctttctatgattctaggattggctatctcttatttgctgaaaaagtcagatggaagtgatagctcagtttgttgagccagagtgcagccaggcctcccaaagtgctgggattacaggcataagccactgtacccagcctgggatgtttttagaaactcttcttggccgggtgcagtggctcacgcctgtaatcccagcactttgggaggccaaggcgggcggatcacgaggtcaggagttcaagaccaacctggccaatatggtgaaaccctgtctctactaaaaatacaaaaattggccgggagtggtggcagacgcctgtagtcccagctactcaggaggctgaggcaggagaatcgcttgaacccgggaggtggaggttgtagtgagccaagatcaagatcaggccactgcactccagcctgggagacagagcgatactctgtctcaaaaaaaaaaaaaaaaaagaaactcttcttggggcttccaaatggaagggaaaggagatgacagtaagctgagacctggataacaacacaggagcactgtattcgtttcctgtgattcctgcaacaaattaccacaaaccaagtggcttaaagcaacagaaatttattctctcgcagtttgggaggtcaggagcctgaaatcaatttcactgggctaaaattaagttattgacagggccacacccactccaaaggctctaagggataatccgttccttgcctctctagattctcctgactgctggcattccttggcttatggttgtatcactccagtatctgcccgtgccttcatatcgccttctctgtggatgtgtcacatctccttctgcttttctcttataaggacatttataattgcatttaggaccccccccgcgccccccccaacccagataatacaggataaactcccattccaagatttttaacttaatcacatctagggggaaaaaaaaaaaaaaacaccatttttccaaatagagaaacatttacagtttccagagattaggacctggactttaggtggctgtttccagcctagcgcagggactaaatatttttcagacctgggcctttccctgtgacgaaattcaccttctccatattataaatcctatagcttatctttttgtctcccattcaaaattctagtgtggataaaacttttgcaggaagggtgggttcaggttgcctggatttggtaacgataggtctctctttatgagcaagattgaaacactcatgattttcctttatattctttttctagcttgatgtcattctccacactgtcactgaacaaataaaaccatgacttacgttttcacaattcatgtgactatatgttctctaatgagaataaaaaaattgttttaccctctggaaagtatcaggactcttctttctctcactctgtgtttatgatattggattctagaaggttatgacccaccagtgaagtgtcacacttgagcatttacttgtgaagagactcagggtaagttgcctacctctctgagactcaatttcctattgtaaaatacagaaattgatgaggccataaaggaattctgggaattaaatgggataatgaaagtgaacattctcagcacagtgactggtatatattaaattcttgatacatattaattctcttccctgcctccccaactcttcttttttttttaaggcagggcagttgtttccatttactgagcatctgccccgagtcatccaaggtgttataggcaatagttcctaccctcaaaagtttgaggcacagtgctgagcatataactaagattccaaaataatcaagtcatagtcctttcccttgaagtgcttgcaattttgttagaaggggaagatgtcaattggagaatacttggaatcatagggtgttcaagtcttccctgtgggtgaatagagtttggagggagctcagatcacatcagtatctgaggccaatgtcctcggactctgtgttcagtggaacaagacttggactggttgtcggaaacccttggtcttgttacttgtttatccactatctctgtgtgatctcgggcaagtcattttcccttttggggactcagtttccatatctggaagatgaaagagtgagactatctctcagcacaaggaaaatattaacagatccatacagttattgcaaaaaatcagaaaacagaattcaacacacatcgactgcacaaatttcccccagaaacatccatgaagcagaataaaacagtgggacagcattccaaatggaatttgactatttgccaactaaacaaggaagaggagggggatggggagggggacaagaagaagaaggagaaaatagtcacgtgtattgataatagcgaacatttacatagcaagtaatgttctttgtactttacatccatcaacaccattaatccttaccacaaccctctgagaaagtgtcattatcaccattttataaaccaaaaacctgaagcacagattctaagaattgaagaaagatttagcaacttaatcaatgtctcataccgaataagtagaagagtcaagatatggacccaaacagcctatactctaacgcattaatgaaaataatgacaaatatataaataaaaggccaacacagaattcaacaatggagatctggcgaactgctacagtgtcctctagctttagcttcatgtggttttagggtcaacatttccttcccttttgctagaaagttagagggaaaagctcagttccctgaagttggaagccaaggcattttagatcccctttggccaagtacactcgacctcttttagcagggaagaatcctttttgtagcatctggaggtcatttggttctcccaactcccaaagcagggcttgcacaatacatacttttgacttgccaaaaaataagtttatccctgggaaatttcccatccatctgttgctttgtagaaatgcttgaactttgcatgcagtatgtccaaacatttcgatcgactccctggttagagtctcagacctcgttattattattattattatttgagatgagagttttactctcgtcacccaggccatagtgcagtggcgcgatcttggctcaccacaacctccacttcctgggttcaagtgattctcctgcctcagcctcccgagtagctgggattacaggcatgcgccactatgcccggctaatttttatatttgtggtagagacagggtttcgccatgttggctaggctggtctcgaactcctgacctcaggtgatccgcccacctcagcctcccaaggtgttgggattacaggcattagccaccgtgcctgaccttacacttttattcttattttatttttcttctttttgagatagggtctcgctctgtcacctaggcactatcaccactcacttcagcctcgacttcccaggctcaagtgatctttccacctcagcctcccaagcagctgggaccacagatgcgtgacactatgcccagctaatttttaatttttttgtagagacaaagtctcgctgtattgccgaggccggtcttgaactcctgggctcaagcaatcctaccgccttggtctcccaaagtgtagagattacagaaatgagccaccacacctggcctcagaccacgtttttattatgctcatattccaagtgaactcagacctgtagctaaatctgccacagaattgtgcactttaaaatggttcagatggtaagttgtgtcacaagtattttgtcacaatttcttaaaaattaaaaagtgagccctctccctctccctctccctctccctctccctctccctctccgtctccccacggtctccctctcatgcggagccgaagctggactgtactgctgccatctcggctcactgcaacctccctgcctgattctcctgcctcagtctgccgaatgcctgcgattgcaggcacgtgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcgctacaacctacacctcccagccgcctgccttggcctccctaagtgccgagattgcagcctctgcccggccgccaccccatctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagagtctctgcccggccgcccatcgtctgagatgtggggagcgcctctgccccgccgccccatctgggatgtgagagcgcctctgcccggccgagaccccgtctgggaggtgaggagcgtctctgcccggccgccccatctgagaagtgaggagaccctctgcctggcaaccgccccgtctgagaagtgaggagcccctccgcccggcagctgcccctactgggaagtgaggagcccctcagcccggccagccaccccgtccgggagggagatgggggggtcagcccccccacccggccagccgccccgtccgggagggaggtgggggggtcagccccccacatggccagccgccccgtccgggagggaggtgggggggtcagccctccgcccggccagccgccccgtctgggaggtgaggggcgcctctgcccggccgcccctactgggaagtgaggagcccctctgcccggccagccgccccatccgggagggaggtgggggggtcggccccccgcccggccagccgccccgtccgggagggaggtgggggtgtcagctccccgcccggccagccgccccgtccgggagggaggtgggggggtcagccccccgcccggccagccgccccgtccgggagggaggtggggggggtcagcccccctgcccagccagccgccccgtccgggaggtgaggggcgcctctgcccggccgcccctactgggaagtgaggagcccctctgcccggccagccgccccgtccgggagggaggtgggggggtcggccccccgcccggccagccgccccgtctggtgggggtgtcagccccccgcccggccagccgccccgtccgggagggaggtgggggggtcagccccccgcccggccagccgccccgtcagggagggaggtgggggggtcagccccccgcccggccagccgccccgtccgggagtgaggtggggggggtcagcccccctgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcagctttgtgggatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaattaaaaaaaaaaaaaaattaaaaagtgaggctgggcacagtgcctcaagcctgtaattccagcactttgggaggctgaggcgggtggattgcttgagcccaggaatttgagaccagcttgggcaacatggcaaaaccctgtcactacaaaaaaaaaaaaattagcagggtgttgtggcatgtgtccataatcccagctactcaggaggctgaggtgggagggtggaataaatggaatgtgatccaacaaaattattattattattattttgatgatgtctattgcccttttgaaatacccaattctggcagggtgcagtggttcacgcctataatcccagcactttgggaggccgaggtgggcagatcacctgaggtcaggagtttgagagcagcctggccaacaaaccccatctctactaaaaatacaaaaattagccagctgtgttggtgagcgcctgtaatcccagctacttgggaggctgaggcatgagaattgcttgaacctgggaggtggaggttgcagtgagccgagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaaagcagatactttctctgcctatttgatgatacaaaactagccctaccacaccaggctaagggagagaagaggatccgtgtcctacagaattccccctattagcctacctgccccatagcccccaaactctgctgctaatcaactgtgccaggtcaggaagaaagaaactggagggaaagaagaagcctaatagattgaaaatcccttcagcaaacattttttgagagccttataactgttagtgtctactgaattaaacttactagtgttaagaaaaattatctgaaacatgttactaaggtaaaaagatgattgtgtgactttttgctgtcatgataaagcattgactagcaagtctacttgtcatctgtccctgaagagaaacgtgacactattttcatattaattacggcccagacattgtacaattctgtaaagtaataagatgtgacaatttcctttcctgcctggtagagaagataatcccaaaggttatgatattattactctgtaggacattaacccatttagtatttaatttagcaatcttacttcaatattttccttttccattgactataaaaactcaagttcttttttcttttttttgagacaggtctcacattgttgcccaggctggagtgcagtggttcgaacacggctcactacagtcttgacctcccacatcccaggctcaagtgatcttgcctcagtccctcaagtagctgggactataggcatgtgccaccatggccagctaatttttgtatcttttcgtatagacggggttttgccatgttgcgcaggctggtctcaaactcctggctaagcgatccacccaccttggcctcccaaagtgctgggattacagatgtaatcccaccatgcccagccaaaactctagttcttatattctattttgaactggctttgtcgtcctgcttgtcccttcattaatgagttaaatgaaactctgacccatgctcactgtctatttcaatgagaattatggttggttttgtttgtttgtttgtttgttttgagacagagtctcgctccgttgcccaggctggagtgcagtggtgtgatcttggctcactgcaatccccgcctcccagattcaaatgattcttttgcctcagcctcccaagtagctgggattacaggcacctgccaccactcccagctaatttttgtatttttagtagagacggggtttcatcacgttggctagactggtcttgaactcctgacttcaagtgatccatccactttggcctcccaaagtgccgggatttacaggagtgagccactgcgcctggccaagaattacatttttaacatgctgacagttgtccttgacactaagtgtcagaccctggattaagtaatttatagacccatgatactcctttgagatagtttttgtccccattttccagatgagaaagtgaaggcacaaaaagataaaagaaattttctcagtgccagttttgtgccaggagctttactaagttacagtttttttctccttccctcgaagtcctgtttatctattcattgattaaaaaaa

SEQ ID NO: 507 - DNA, 41608 bp, Homo sapiens
tcttgtcccgcgcgtggtttttgtgaagacacgtgggcgggatgggcgcagggtttcggtagccttggaactctcgccaaagaaaatcgcgggcgccggtgcctcagccgtcctgcctgagagactcgcctccgagaggaggaagggacagaccaaagcagtaaatcggccatcctgcagaggagccgccttctgctgtctgtgggtacagccagaactcccatacgcgggcgctgaagtgccaaaccttcgtgcgtgttctctagtaattaggtgcattgttttgaaggaataaagaatggctactccataggcaggacagcctctagtaaccaggtttgttttgtgtattttcatttggttaaaaattaagtttaggttgggcgcagtggctcaggcctgtaagcctgacagtttgggaagccgaggctgcaggatcatttgaggccagcctgggcaacatagcaagaccccctctataaaaaaaaaactgtaaacatcagccaggcggtggcgcacccctgtgggccaagctattctggaggctgaggctggcggatcacttgagcccaggaggtcgaggttgcagtgagccgtgatggcgccactgcactccagcctgggcgacagagcgagacccccttctacaaaaaaaaaattaaaaattaccccggggaaggccaggcgcagtagctcacgcctgtaatcccagcactttgggaggccaaagcgggcggatcacctgaggtcgagggttcaagaccagcctgaccaacatggagaaaccccgtctctactaaaaatacaaaattagcctggcgtgatggtgcatgcctgtaatcccagctacttgagagtctgaggcaggagaattgctcgaacccggtggtggtggtggggggggtggggtgcggaggttgcagttggccaagatcgcaccattgcactgcagcctgggcaacaagagcgaaattctgtctcaaaaaaaaaaaaaattacctcagggagcctgtggtcccagctacgtgggaggctgaggctggcggatcactggagcccaggaggttgagactgcagtgagctgtgatcaggccactgcactccagcctgggcaacagagcaaaaccctgtctctaaaaaaactaagtgtataccaaaacaagatttcttaacacatcttgtccattacatcagggaaaacacttgttctctttcacttccatgtttaacttctgcctgacacagctattcgtagccacattgtgattatagtaagtcactgacaaaaaatgttgtcctgaaagccaaggctacgttcggtcagaatgagctcctgcaggtctggaattgttagaacagcgtatctggttatagccgcccttcatattaattattaaaatgttacatcacttaaggcttttatacagtttttcccccaagccccataacttcaatctataacagtgagcaactagcagacacattggaagtgtttaagaagccagcctttaagaaaaggaacagaagggacaaaaaccccaattaatgcgaaatcatcacagataatgacaggtatttaggtggcctggtttagctaaggcctggaaaagaacagatcgggtttaaagagtggcctgccgggaacgcgatgcggcgtggtctgccgtgcacttggcttcctgcttccatcctgtggtgcctcttccaggagcccagttctgagtctctgatgccgatgtcctgtatttactggcttaaaactcttgcctgtgtgagattccacaaactctggcacagaaggccccagatctgcccaagaagctgtgggatcagccacaaaatctcaccaacgccaggtttctgtcctgccctccctggcgctgaaggggaaatagaacagaggctgtgttcaggttgctgtcctgcctgccgcccagcggtgcagcttgagcctccttttatgagaggtttccacccaattctagatgtgtattgaggtatctacacatggagggacgtgcacatatcacacgtgcaactggcctgagcccttttcagacaattagtccgctccaggtcagcgtggatccagggtgagtcagaggcgtcttcagatgcaaaacctcagaatcaaaaaggaggaaagagactccactcactcctcgggcttcctgtcatctctcaggtgggggtgggagaaggcccaagaggttgcatgataaaaagactggacagctgcattgctggtttggaaaatccttatttttggagggatatttggggataaaatttcagaggaaagcaaatgtctcatcaatcatgaaaaaagatttgttacaacctaagtcagaaaaggttttcatctagtcatatatgtgtggcaaatacggagaagccacagacggtgagccacagacaatgagagcagctgttggggtgggctccagggtgctgctttccctgagggccagctgggtctggcccaggttcacttcccaccccggtgcccccggtactcgctgtctccagcctcaggttctgaaaggcagagactcctagcctcattgaaggatggttagagaggcacgggagctatctagtggcaggcccacggtatatgtttgctgctttctacaaatacgagatcaaaggaaaataaagcaggggtggttcctgtcagtgtggagcgagacccgggaaagcatcctggtggctgtcaggccttgctcacggcccctttctctttcagggagaggatcctccacagtggtatcctgctgcgtgcccctccaggacagcacccagaggcccgaattgctgctgcacagagagcactcggcctcaccccacgttttccctaagttctgtctagtaattccactttggagaggggggtgttccttgacagatttagagagttgatgtaacttcctcggatcagttctgctggctccatcccctacctgctcagccctgcacaaagtggctaagcacgccacactgccggctcccaaggcgatggccacctgcctctgtctcggccgctagtggcaggaagatggaaatccctcactttgtccctagattcattttattttatttttgtttgtttatgtttttttaaggacagagccttcctctcacccaggctggagtgtggcaatcacagctcactgcagcctcagcctcctgaagctctggcatcaggcgggagccactgtgcctggccccatagactcatgttagcataaacaaataggaaatgtacacagctcaggaaatggctactagatacttaagtcccccaaacagaaatatatttcctctgaagaaactgaaaaaagtggccgggcgcagtggctcatgcctgtaatcccaacactctgggaggctgaggtggacagatcacttgacaccaggagtttcagaccagcctggccaacatggtgaaaccctgtccctactaaaaatacaaaaaattagctgggcatggttttgcacgcctgtaatcccagctactcaggaggctgaggcagaagaatcacttgaacccaggaggcggaggttgcagtgagccaagattgtgccactgcacagtgtccagtctgggcaacagagcaagactctatctcaaaaaaaaaaagaaaatgacaaagttattttttctctcttaactcataactggggccaaaggcagggtgacatcactggggatgccagtgtgtggaggctgtcccctgaccagtcctgtccacagtcaggagggcaggggctgcagtgcacagaccgcattgttgtggcatggaggggggtcccacaaaggccttgtcagctcatgggaccacattggcagccagcatagtgacagaagcctcagataggcagtgagccattgccaagactccatggtcccttggtgtctgtggccaccaaacagatgacagaaccagcccctcttgttcagccacctgggaggctgctcccaagcctgttgagcttgaggatccttaaccactcaccagctctcttcagttccccttcaaatgctgttttatctcagcggaacgtactacgccctgtatttcctcgccacgctcctgatgatcacgtataaaagtaagtcagggacgggcacagtggctcacgcctgtaatcccaacattttgggaggctgaggtgggcggatcacttgaggtcaggagtttgagaccagccaggccaacatggggaaaccccatctctactaaaaacacaaaaagtagccgggcgtggtggtgggcgcctgtagtcccagctactcgggagactgaggtgggaggattgcttgaacccgggaggtggaggttccagtgagccaagattgcgccactgaactccatcctgggtgacagagcaagaccctgtctcaaaaaaaaaaaaaaggaaaaggcaagctgaggtggctgctgctgctgtgccaggttacttatgttccgtccgcgcctctgctcttcaggtcaggtgttcagctatcctcaccgctacctggtcctcgatcttgctctgctgtttctgatggggattctagaagcagttcggttatacctgggtgagtggactgttaacaccgtgaagaacctgtcctaagagttgctatctgtttccacagcctttcaagagtaattattttatagtgtggttctcagagacattttttatccaaactgcttacccagttgctttgcaggctcaccttacagtgtcattaagtattaatcaagaagttttgtcccagagacaaataacactgggggcatcgttgggagagactctgtgtttggaagcatgtcttgtagaagccactgggtaatggcactgagatcagaaaagcccagcccaccaccacatctggagctccggaatattcaccagcacccctttccttccccttgcccttagctgtctgaggagagagccctggagagttctgccaggtcccaaaaggcagcagagtctggaggggtgggagcccccagcctccccactccagctctagggatccccaagtctgcaaccccttccagtgacctactttttttgagacgaggtctcactctgttgcccaggctggagtgcagtggtgcagtcacagctcactgcagccttgacctcctgggcttgagcgatcctcctgcctcagccctcccctcctcccaagtagctgggattacaggcacctgccaccacgcccagctaattttgttttgttttgttttgtttttttttggtagagacgagacaaggtttcttttttttttttttttttttttgagacagagtctcgctctgtcgcccaggctggagtgcagtggcgtgaacttggctcactgcaagctccgcctcccgggttcacgccagtctcctgtctcagcctcccgagtaactgggactacaggtgcccgccaccacgcccggctcatttttgtatttttagtagagatggggtttcaccatgttagccaggatggtttccatctcctgacctcctgatccgcccacctcggcctcccaaagtgctgggattacaggcgtgagccaccgcgcccggccggagacagggtttcgctatgttaccctggttggtcttgaactcttgggctcaagcaatctgcccaccttggcctcccaaagtgcctggcctcactcccctttttttaaccacacaatttgttcaagggtatgttcttgtacaagattcaaggggtgcagaagtaaaacatggaaattcgccctccccagagctcacctctgtggccagcggggtgcagacttccagccctctgcgtgctcatggtcgtaacatgtgcacctaaacacacgtgtttgtgaaacattgtcctgccgtggggaacgcaatgggcacttccagggcgctgtgcccctgccaggctggaatcttgggcccctcttgttcacatacagatacacccctgatgcctgatgtccagtgaggaaccaaggctgcggggaagggtggcccccacccttcctcttgttatcaggcctcagacacactaggaggatggaggcgagttctctcagctgcccatcccactgaggggtgcccggccgtcagtgtcttgtctgcacttacgtcccagaacctctagagcttgccccccagggcgggcactgctgggagggtgcgagcaccgctgcggcacagaggcccggttcttggctgatcttctggggcctgggcctgccctgaggtggtggggacagggtgtggcctggccctgctgggggctgctaggccaacgggaccctccccaagcgcgccgcacactgcagggtctccaggcacctgggctcagctagtgactgacccatttgtttgctaaatacgcagttttgtttttaatacatactcgtgaaattttccagaactggccttggaccagagaaaaatactttgggaatttttcaaaaaaatcccttcagttccacttggaattaggaaaacgtggcagatgcacttgaatcattttagaaaccaaattcacccccgcccacacagccgacccagaagacccagagacagatcaaaccatgctgttgcaggggcacctcccccaggaggggctcacgcctgtgttgcccatgctctctggctctcctgagttctgggtggccatggaggctgtttccctggaattccccaggccccggaggaacgtagggcaaggagctgctctggtcccagcagccctccaggcacctgtgggcggtgggctccagggagcgcctcgcaccaccttccctcccctttgctctgttctccaggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaattctcctaattatggccacctcccccaccccatctccagttctcctgccctgcaagagagcacaccccacttgccagctggtcagttcctggctggcctcgccctcgggccctggctgccgggcgccttccgctcggtggactcctgagggcaggaggctgcgggactgtcctgggcctccactggggctccctcggctggggtggctgtggctgtggcacctggacagtctttcctgcctgtcttcgtggaagcggtgggagcacccagttgtcctgggccgacttcctttgacctgtctgtggcccccagtggccacggtgagctgcaggacagccctgaggacccacttcacacaccagcgcctgagcgcctcgggccacctccctcaccagcgcctgcactcgcagaagaccagctgggcacacctgccatctggaggacccagcccacaaaccatgcagaccagggaaggaccccctccctgaagctggagacctgttgccttcatggttaatggatcctgatacctccagtctcagcgagcacacaaaggcagtggtcacctgttccacagggaacgccatggctccaggtgacccggagtggatggggcccgagaggccagcctggactgtctcctgagggcaggctccgcactcaaaatcgtgttgacaggcacccgtttaggagtggagagggaccccaccccccagctgtcctctccagcgcctgtttcccacttggccactcccagctctgcctccaggaagggtgagggcacgggtgcaccgaggggttggcgtgtgtgaccctgagctctgggtcagggcaagctcatgcatggagcaggatcacggcaggttcctggagatcaaacggcaaaggctgtaaaccaggaagccaggtcttgcctgggctcaggggcaggcactgggcccgaaggaggagggccacttcctgccagccctccaccgagctcacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggtggggcctgggcctgaccacggggcagtgcaaggagagaggcatcctgagagggcctgaggtgtccccacctcccctgacaccccatccctcagtgcccaggctgggcagaaaggggggcctggaggagcagctgcactgtgaactcagggctccaggcctggggtgggcatggctgggtcctgcctgacacccacccactcaccgaagcctctgcccctgggcctgcggtgggcccggtaagggaagtgactctgccccatgcctggggcacctgaggggtgcacctggcccggcggaggctctgacctccccagggctggagccctccccagcaatgcgccagcgctgcccccgaagtcccattggcagcgttcccccgtcccccggcctgctggggcgcagctaggccctgcccaaggaagagctcgaggcctcgccctgctcatcccgcggaggcggccctgcgccccgcctgtccccagcgccccagctctaggggctaggcccgcggaggggcacaccaggcgggtgttggggaggacgcagagggctggggctggagcccaggcggggcagggggcggggcggagctgggtccgaggccggcgggggcgcctccatcccacgccctcctcccccgcgcgcccgcccgctctcgggtgactccgcaacctgtcgctcaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgagcgctgcggacacgggggagcgcgcccgcccgggcctcagtttacccggtggcgatgggacgcggggcttctggttcaggacaccgggacgaacgcggcgtcgcagggcgcggggcacttggagggcggccgggccgagggcgcggggcaaggggctgggggcctggtcgagtccccacctctcctggacgggtcctgctgcagcccggcctgcccccgtcggtcctgggcggcggccggcgagcaaggatatttttaagccagcgatgggtgactcacctgccccgtcctgcccactcccagctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtcagtctccaggtcagggttgggggtgggagtttcagggaggaggggaggctgggacaggggctgcagaggccctgccaggagaggcaggagggtgggctggcaggagcctgtgggcacgcgaacttcagccatcctagattcctggtccctgcgtccagctgcctggcgttgccccttgctgcggggtgtccctggtggcaggggagggggaggcagggccgggcatgcccggacctctgcccccacccaccccgtgctcagtcctgggtcggctgtgctgggaggcaggcccagctggcggcggcccctcccctcgcggcccctcctcccctcgcggcccctcctgggtcccagcctctcccgggcctgcttagcacccaggccttgttggcatagctctcccaccgggccttctccgcctgcctcggtctcctttcccaccctcagcttccccagcttatcccttcctccctcaagccatagcttccaaacaaggacagggccagggcctgaggggcctccccattccagggccccacccagcgcctatgagggcagcctggagcccctgtgactcagctgacccctccccaaggtcactcagcatgtggagctggaacttgaacttggagcccgtccctctaccctcctgccctgctgggacctcctcccctccacagcccgactgaccgggcaccccgctctgcctcacttcacaccgggaaaatgaccacagtacaaagtgcagcctgggcctccagggcttcgtccccaccaccagtgggccaaagaagcctccccaggggggcggggctcccacagggcaggaggcagccccatacccatgtgcttcagacccagacaccacacctggacccaccccactgctgcccggccctgcctgggcctgaggtccccgatgccctgcaggcaaccgaaggccaggaacctggccttccccaggggggtcgcgtgtcacagccctccatgtttgcgtgcccccaggcctgagtctgcaagggtgcgttggtgtctcgcccaggtgtgtgcctggacacacgtgcctggcgcccttggtggagcccgccaggaatcccattaagcaaacactcaggctcgccactgagcccgtgaacattccagacattctccacggatagatggatggaggaagtggccataccccctggtgcacccagcccctcatgtcagcggcagtgcccccgggcctcccagaccctcccactaggccagacctggtcaaaccagaaagtcccgggtgctccgagccactcccttgaccctccataccaacagcagtggctggtgacccccaccgtggcagacccaaactctgaagccacaggggacagccctgcagccctggcaggaggcagatggtgtggacctgtggggagctgatcacagagccacagaacagccaggtccccacagggcatagtccccttgggacaagtcagcctggttcagggccatcaggctctgtccatccccccgggaagcccctagggtccagcccaaatcagacccacctgtctgccctggcggctgggccttagtttccccaaaatgctcggggaagaggtcagcactaggagcccagagacaggctctgaggattctgcccctgggggaggccagaggcacctgccccatagccaccctacctcgttggaggggcagtgatactgtgtgttggggccactggactggctcccagtctcagcccccaccacacctgccctccagtccctcccctaggcttggctgctgccaggggttctgcgctggccacctggccgcatccctgccctcgaggtgaggaaacactgcaccccggggaccccagggtttcctgcccgcacagcctcttccctgccaggtctcccaggcccaggaaagagccaagggccagcctctttgctggggcctggacagaggtggcatgtgtgggtggcaagtccacatgtgggtgcaggagccccttggggtgcaggcctggggtggggcaggagtggcggctagagccgggctccctctggacttcaggacctaccccaactccagcctcacctctcctgccatcctgcagctcccacccgccctcccccaacccccaccgcacccccctccccccacactcccacctcatccccctccccttacccatcccacccccctccccacagcaccagggccttaaactccatgctgcccagcttggaaggcgccttctgcccccagggcccttgtcagagcctcccagtcagcctctggggggtccctgtggagcacctagggtctgaggcatgacgaggctgatcgactgtcaactgggacgtggggccaactgggacgtggggccaactgggatgtcgggcaggggctctgccccccaagggacccccacccaggccaggccagtcagggatctggcccagggaaggaggggaggaaccagccaggccggaggaagtgtcagcgcagcccttctgtccacccaggtgtgggacaggcactggcctcagaccggggccacactgaggtctgcccttctcccgctggccgccacccaagacaccatgagccagtccggggccgtgagctgctgcccgggtgccaccaagtgagccctcccacccatcccgaataccccaccctcaccctctgaacagtccccagggaggggtgcagtttggccctgccctgacagcccctcccctgcagtggcagcctgggccggtccgacggtgtggccaagatgagccccaaggacctgtttggtgagtgaggtttgagaacgggctggacgtcacaggggagaaatgggcactgcatccaggtgggggacagctgctcctgccccacagctgtgcctggtctggcccaggggatctccgggtgcccagggaggcctctggaccctaatcaaccttccgaaagctcctggccactggatcccctcccccacacccgtaaggggagaggcctttactaataattcagggagcatcaatattgattccgctgcactcattgctgtaacctgatcacagcgaggttcaggcaggataagccgccaggtgtctgctccaggaggggggcctggccagcccccacctccccccactctgcccttccccagagacgaccctgccctctcgctagctagatgcacccttcacttatgtctttggacaaggtgcctagtctggaaagcgagaagacctgggagggcagggagagtgaagctggcagctctcagagtgggaagaagccgggctgggacccccttcctgtcccctcaccctccgggacagaaaccccccgggcacaggctgctggtccccactccactcagagcaagcccatcgccttctccgagctgcgtccttctccaagggggcttccctggagggagggagggggcttcctgcaggtcctgatttcacacccacatccttcctggtggccaagaggtccacggagcagcctccctccgcttgactccaccttcccttgtgggtccagtcccaactggacgggaggctgtgggtcctgcccgtcgggggagtgactggtgtctcccggttcagagcagaggaagaagtattccaactccaacgtcatcatgcacgagacctcgcagtaccacgtccaggtaaggccccgcccccaggtaggctccgcccccagggagcaccctcaggacatggctgtcctcaggttctcgtctccacaaaaaataaaataattagacgggcatggtggtgccggcctgtaggccctgctactggggaggctgaggcgagggggtcacttgagcccgggaggcggaggctgtagtgagccaagatcgcaccactgcactccagcctgggcacctgggtgacagagctagaccctgtctcaaaacgaaagagagaaagagagaaagagagaaagggaggaagggaggaagggaggaaagctccagggagagtggtcagcccagcttctgacacccacggggccgggggaggccagagccagaactgcccacactgtcccgggctcagccacggggccggggaaagcgcccctctggttccagtcctgggaactcgcggcctggggggtgaggcagcccagggtgtgccgggaaaacactgtggctgctgcccagccctggatgggaagagcccctggaggagatgatcatcctggccccaaaacgaggaactgtatcgggagggagcaggcagaacaaagacgcccttgatgggggattcagggaggcccgggctgcttctcagggctcagacggggctgcctgcacgcgccggaccagccgccagccctgagggcttttctgttctcctaggtcagtttcattgacacggagaactcaggaaatgtttttttggggggttttgtgtgcgtgtgtgcgtgtgtgcgtgcgtgcgtgtgtgtgtgtgtgtgtgtgtctttttttcttcctttctttctctctctctctgtctctctcttttcttttctttctttcattttgagacagggtctagctctgtcacccaggtgcccaggctggagtgcagtggtgcgatcttggctcactacagcctccgcctcctggactcaagtgatcccctcacctcagcctccccagtagctgggcctacaggctggccccaccatgcccatctaattattttatttttttgtggagatggaagtctccctatgttgcccaggctggtctcaaactcctaggctcaagcaatcctcccccctcctagccaggcctggtagtgtgagctcgtagtccagctacttgggaggctcaggcaggaggatcccaccacggccctccagcagcctgggcaacagagtcttaggccaggcgcggtggctcacgcctgtaatcccagcactttgggaggctgaggtgagtggatcatctgaggttaggagtttgagaccagcctgaccaacatggcaaaacctcatgtctactgaaaatacaaaattagccaggcgtcgtggtgcatacctataatcccagctactcgggaggctgaggcaggagaatcactggaacccaggaggcggaggttgcagtgagccgagatcacaccactgcactccagcatgggcaacagagcgagactccatctcaaaaaagagaaaaaaaaaagggaccaggcgcggttgttcatacctgtaatcccagcactttgggaggccgaggcgggtggatcacctgacgtcaggagttcgagaccagcctgaccaacatggtgaaaccccatctctactaaaactacaaaacttagctggacgtggtggtgggagcctgtagtcccagctacttgggaagctgagacaggagaatcactagaacccgggaaatggaggttgcagtgagccgggattgcgccactgcactccagcctgggggacagggcgagactccatctcaaaaggaaaaaaaaaaaggcccctgcgcctgggtacgagctgggctcccggttgtggtccaagcctgggtgcgagctgggctcccggttgtggtccaagcctgggtgcgagctgggctcccggttgtcgtccaagcctgggtgcgagctgggctcccggttgtcgtccaagcctgggtgcgagctgggctcccggttgtcgtccaagcctgggtgcgagctgggcttccggttgtggtccaagcctacaggactaggaaaaggagggagggtgagggagcctggagctgggtcctcctgcaggaccagtcctttctgccacaaacagccctggctgggggcccaaaatgccccctggttcccccttgctgtcctccacacctgcagaggtgagacaggtcactactctttgagcctcagtttcctcgtctgtacaatgggtccaaagagccatcaggagtccctgagctcttgaatcgggctgttttgggtgaccagggccctcccagcagcctgggcagctagaccctgcatacagccaggctggtgacttcggccagctcagtgtccaggggaaggcacagagcagtggccgagttcactttagtcccctcttcctgggcagctccaccacctttctcagggactctgccctcttcgggaggagcctggggcctctcagcctggctcctggactttggccccagctggcctggcctggcccccagccagcaggagcctcgtctgcccagaggccaacagagtgaggagtggagggtgggtggggctttcctgcctctccccgatgaggacactggggaccagagagagggtgagagtctggtgggaagtctctccagccaggtgggggccggatcagattggccctgacagtgggtggggggcacctgagcccgggtccatggtttgcttttttctaagttatcacacagtaaaagccatgtgtacgtgggggtgtggttctgttgccaccatagtcgacccatcagccccatcactccaaacctgtgaatccccgaccttggtggctacccccaacctctggcaacacctgcctgccttcatcaccacagtttctgtttgtttgtgtgtttgagacggagtctcgctctgtcacccaggctggagtgcaatggcgcgatctcagctcactgcaacctctgcctcccaggttcaaaccattctcctgcctcagcctcctgagtagctgggactacaggcgcccgccaccacgcctggctaaatttttttttctctgagacagagtctcaccctgtcacctaggctggagtgcggtggcgtgatcttggttcactgcaacctccgcctcaagggttcaagtgattctcctgcctcagcctccccagtacctgggattacaggcacgcaccaccacacccagctaattttttatatctttagcagagatggggtttcaccatgttggccaggctggtcttgaactcctgacctcaattgatccacccacctcagcctcccaaagtggtgggattacaggcgtgagccaccgtgcctggcctaatttttgtatttttagtacagatggggtttcaccatgttggccaggctggtccccaacgcctgacctcaagtgatccacctgttttcactatgttggccaggctggtccccagtgcctgacctcaggtgatccacctgcctcccaaagtgctgggatgacggactgagtcactgcgtccggcctccatcattgtggtttgataagtggaaattaatttttatgatgtccattcgtatgtgtttttcttttatggtttagggtttttggcatcctaagaagtcatcctttgaccaaatttctggagatttcttccgtgttttcttttattttttgtaaattaggaattcactgtggaagttcctgtgttttctttttcttttcttttttctttttttttttgaggtggagctttgctgtgtcacccaggctggggtgcagtggcgtgatcttggttcactgcaacctccacctcttgggttcaagcaattctcctgcctcagcctcctgagtatctgggattacaggaatccatcaccatgcccggctcattttttgtattttcatcagagatggggtttcaccatgttggcaaggctggtctcgaactcctgatcccaggtgatccaccagccttagcctcccaaagtgctgggattacaggcgtgagccgccgcgctgggccagttcctgtgttttcttttggatgcttcccagtgtaggcttttgcgtttagggccaggatccattttattttattttattttattttatttatttttttatttaatttttaaattttattttatatttattttattttattttatttttttttgagacagtctcaatgtactggaccacactgattgactgttttgaatgttgaaccagcctaatcctcatttattccaagtgtgtgatcctttttcctgtgttgagggactgatgtggtaatattgttgttaggggtattttgtgttgatgtccattagaggtactggtctgtaattttcgtataatgcctatggcaggttgtgtggcagggttatgttggttttataaaatgggtggggaagtattccctcctcttctgttttcagaaagagtttgtgggccgggcgcggtggctcatgcctgtaatcccagcactttgggaggctgaggtgggcagatcacaaggtcaggagatcaagaccattctggctaacatggtgaaaccccgtctctactaaaaatacaaaaaattagccaggtgggatggcgggtgcctgtagtcccagctactcgggaggctgaggcaggagaatggcgtgaaccccggaggcggagcttgcagtaagctgagattgcgccactgcactccagcctgggagacagagtgagactctgtctcaaaaaaaaaaaaagagtttgtgaaagcttgttattgtttcttccttagatatttgttaggatttgccagtgctgccctcggagcacaggattttctttgtgggaaggtttcggttattaatcccctctcctgcctgtaagatctgtagtgatgccccctcttttgttctggtttttgagaatttgtgttttctctagtatttttcttgatcaggcttgctagggatttaccaagtttattaaccttctcataactaactttgggctctgttgatttgtgtctgtcagtagtctgtgtaaagtgcgttgacctcctcttaattttctaccttccacttactgtgggttttatttgattcactttatctttttcttttgttttttttttttttttttttgaaatggagtcttgctctgtcgcccaggctggagtgcagtggcacgatcttgattcactgcaagctccgcctcctgggttcacgccattctcctgcctcagcctcccaagtagctgggactacaggtgcccaccaccacgcccagctaattttttgtatttttagtagagacggggtttcaccgcgttagccaggatggtctcgatctcatgacctcacgatccgcctgcctcggcctcctaaagtgctgggattacaggcatgagccaccgcgcccggcattgattcacttttcctacctgcttaaggtgaaaccttagattatttatcttttttttttttttttttttctgagatggagtctcactctgtcacccaggctggagtgcactggtgcaatctcagctcactgcaacctccgcctcctgggttcaagcgattctcctgcctcagcctcccaagtagctgaggttacaggcatgcaccaccatgcctggctaatttttgtgtggggttttttttttttttgagacagagtctcgctctgtcacccaggctggagtgcagtggcaccatctcagctcacagcaagctccgcctcccaggttcatgccattctcctgcttcagcctcctgagtagctgggactacaggcgcccgccaccccgcccggctaattttttgtgtttttagtagagatagggtttcaccgtgttagccaggatggtcttgatctcctgactttgtgatctgcctgcctcagcctcccaaagtgctgggataatttttgtattttcagtacagacaagagttttgccatgttggcccagctggtctcaaactcctgatctcaagtgatccaccctccttggcctcccaaagtgctgggattacaggcgtgagccaccgtgcctggccagattattgatcttaagtctttcttcttttctaagatattcatggaaagctctacattctccttgcagcactggtttagttgtattccacaaattgtgatatgtatgttcagaatgctttctagttttcttgtgacttcatctttgatgcatgggttatttagaaatatgttgctttgtttctaaacatttggggattttctggttttatttttattatgggtttctaccttaattctgttatgatcaaaaaacatattctgtactgttgcagtcacttgagatttactgagacttgttctgtggcccagcagcctggtttttcttgtttggttgtattgtgtgtttcaggttttactctgcctctcgcagagagatgagtggcctcatagtcccttgcgtgtttctgcacacttattttatttatttatttatttttgagacagagtctcgctctgttgcccaggctggaatgcaatggcacgatctcggctcactgcaatctctaccttccgggttcaagtgattctcttaactcagcctcctgagtagccggggttacaggcgcccaccaccacgccgggctaatttttgtatttttagtagagacggggtatcaccgtgttggtcaggctggtctcgaactcctgaccttgtgatccacctgccttggcctcccaaagtgctgggattacaggcatgagccaccgtgtctggccctgtgcccactgtaacctgttggatctgcccacttctttaacctgttgatggacatgtaggctgggtccagtctttattattacaaatagttctgcattgagcagcctggtaccgatgccacattttgcacgtgtgcagattacctgtagtagaattgggaggggatggtgtgtgcagctttagaggtgccactggcctctccccagagaggctgggcaggtgctggatgagggcatcctttctccacatcctaacccataagtaaaacccacaatgactattagtattgggcaatagaataggtaaaaaaacacaattcctggctgggcgaggtggctcatgcctataatcccagcactttgggaggcacaggcaggaggatcgcttcagcccaggagttcaagaccagcctgggcaacatagcaagcccttgtctctagaaaaaataaataggcagggcacagtggctcacgtctgtaatcccagcactttgggaggccgaggcgggcagatcacaaggtcaggagatggagaccatcctggctaatatggtgaaaccccatctctactaaaaatacaaaaaattagccgggcgtggtggcaggcgcctgtagtcccagctactcgggaggctgaggcaggagaatggcgtgaacctgggaggcggagattgcagtgagccgagatcgcgccactgcactccagcctgggcagcagagtgagactccgtttcaaaaaaaagaaaaaaaaaattgttaaccaaaaaccaaacagaggctgggcatggtggctcacgcctgtaatcccagcactttgggaggctgaggcgggcagataacctgaagtcagtagtttgagaccattctggccaacatggagaaaccttgtctctactaaaaatacaaaaattagtcgggtgtggtggtgggtgcctataatcccacgtactcgggaagctgaagcaggagtatcacttgaacccgggaggcggagcttgcagtgagccaagatcacaccactgcattccagcctgggggacagagcgagactgtctcaaaaacaaaacaaaaactaacaaacaaacaaaaaaacccgccaaaccgacaaaacactaaaataaaagaggctcagagtttcaaattgtaattctttcattcaatggtgttgcatacaattttttctttgagtttttgcatgcttttttaatttttttttttttttttagtttgagacagggtctctctctgttgcccaggctcagtgcagtggcacgaacatggttcactgcaactttgacctcctgggctcaagcattcctcccacttcagcctcccaagtagctgggatgacaggtgtgtaccaccacacctggctaattttttaatttttttaatttcttttttttttttttgagatggagtctcactctgtcgcccaggctggagtgcagtggcacgatcttgattcactgcaagctccgcctcctgggttcacgccattctcctgcctcagcctcccgagtagctgggactataggcgcctgccaccacgcctggctaattttttgtatttttagtagagacggggtttcaccatattagccaggatgatctcaatctcctgaccttgtgatccacccgcctcggcctcccaaagtgctaggattacaggcatgagccactgcgcccgatcttttttttttttttttgagacagagtcttcctctgttgcccagcctggagtgtagtggtgcaatcttggctcactgtaacctctgcctcctgggttcaagtgattctcccacctcagcctcccgagtagctgggattacaggcgcccgccacaatgcctggctaattttttgtatttttagtagagacagggtttcaccatgttggctaggctggtctcgaactcctgacctcaggtgatccacccgcctcggcctcccgcagtgctgggatgatagatgtgagccaccgcgcccggccacacaaacttttatgttttgcgttttgtggttgtctttgactgtcctgtagttcaagttagtgtttatccagctgtgccagcattgtgcaccgaacggccaacccttcgtgggagggttttacttagtgaacacggcagcttggctggaggagggggcctgagccaggcctggaaagaggagaggtgaagggcacagggcaggggccaggctggccgcagatcctcagggatggacgcatcccgcacacacttgtcgagggtcctctgtgcaccaggctttgccctggacctggggacacagcttagcaagtggcaaccggaacagtgccttggagtagcgagcacgctggacgcacagcacaccacgtgcagcgcgacgttgggtctgattcagggaattagggcaggtcgggatggggtgacggctggcattgtagccaggtggccacagaggggacgtctgagaaggaagagagctggggaggctggcaaagctggtgcagtgggcgggtactgagcctgcaccaggaggtgggcgggtgaggatggtggcgcggggccgggcagcagttggaattcctttgaggatagtttcaggacacaagcatggcccctacagatgcctgccaaggcagaatagagactccccccaccaaaggcggggccggtccccgttctagccccctacccagggttggctgtggcccctcagcccctcaggctgtggcccctgggggctgggctttcgacacaaggagggctctgcccagcagtgaccacctgcccacccccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggtggggcccagcgccacgggggacagggagcacagtgggtagaggcggtggcagccaccggctgcagcccggatgtgcggccggtcctctctgcagggccggccatgccctatcattctggtccctggaagaggatgggacaagggtgggcagagggccgcatagagctgagagtccagggaagtttggaagccggggtcagccttgcggtacagctgcggggtgtgtcccgggcctagtcctcatctttgggagcccattccccagcggcgccagaggggcctgtgctccaggcttgtccacagctccggccactccctgccagagtgcccagaccccgggtgcgagtcgtgtccgcgcgatgtacccgcaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggtgaggcggtgccgggcggggcagggtggggccccgccgcgccgcgccccgccctcctggccgcctgacgcccgctttcccaggcagagctggtgcacgaggacatcgagagcgcgttggccgactgccggctgggcaagaagatgcggccgcagaccctgaagtagggcagcgggcggagcggggtcgcagggggcggggaggggaggagcccggcaggggaggggaggagccggcaggggaggggaggagcccggcagggagggagggtcaggtgcgttcccggcggggctgagcaggaccccctcgccctccaggggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtgggccgaggggctggagggggctccacagggctcgttgtggggggctcggtgagcagccgccgtgtcccccatcaggtttccgccgtcgggagtcgcaggaggagccgcgggccgtgctggctcagaagatagagaaggagacggtgggtgcccgggcccggcaggtggcccctctcttccccgcccccagcagtggacactggtccttgctgtccctccggccagtccccagcctgtggctgcccctccgaaggtgtggggcccagctcctcccatcatctgtggggctgtccctgcagcaaggcggggcggtggggagtgtcaggggctgacccctgaccccctctgaccccagcaaatcctcaactgcgccctggacgacatcgagtggtttgtggcccggctgcagaaggcagccgaggctttcaagcagctgaaccagcggaaaaaggggaagaagaagggcaagaaggcgccagcaggtgcaggggacagggacggggccggcaggtgcaggggacggggccagcaggtgcaggggacagggacggggacggggccagggacatccatgggggctactcatggaggtggaggaaggtccagcccacacagatgggctgcgtgggacagaaggcgcaggggccggggagatcagggccagcctggctcacgcggtgcctcccatgccagagggcgtcctcacactgcgggcacggcccccctctgagggcgagttcatcgactgcttccagaaaatcaagctggcgattaacttgctggtgggtccggtggccccagccctgccccactgtctgtgctgaggggagggtggaggccccgccccgccccggcacctgctcacttgttcccacccccaggcaaagctgcagaagcacatccagaaccccagcgccgcggagctcgtgcacttcctcttcgggcctctggacctggtgcctggggccgggcggcaggggcgcgcagggtgggggcccagaggcctctgcagcatctccccggggtcggggttggggcagcaggtgcccgccttgggcagcccggttcacgctgtgtggccactctccctggggtccaaagtcccttcccgagggccagcctgtggagctacgggggtgctgggccagggtctgtgggcctcagtcccctctgaacctcactgtgccccagatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccggtagggcagggcagagcagtgccggggcttcatggggggccagcgctgcatgggggccagcaagggggtcctggtgggccagttctggagaggcagggctgacttcaggacctctcaccccagttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagagcaccagcagcccccatccctaccccagccccaacacccactcctcaccagagctcccccccagccctgacacccacccctccccagagctccccccccagccctgacacccacccctccccagtgctcccctccccagccccgacacccacccctccccagagctcccctccccggccccgacacccacccctccccagagctcccctccccagcccacctccacccaccgccccttcagccacagctcagctgcccctagcccctgccaggagaggcaacccatgctggcatcaccgggcatcaggctccatcaccctcagtgatgcatcagtcacaggacattagcccagcccctgtcatatgccccctcgtcctgggacccagccccgccccatgtctaactcaggtcgcccaccttccccacaggtgagtccagtgagccgacagtccataagaaactcccagaagcacagccccacttcagagcccacccccccgggggatgccctaccaccagtcagctccccacatactcacaggtaagcccccctcaaagtgagggagcatgaaagtgaaacccttcagaacctacagtctctaaaaacatatgggtacgctgccaccaggtggtggcaagtgcattgttcaagtggtttaaaatacttttccagatttgaagcggttttcatttcaactgcatgatatataattaaaggaaacatttcaaaagtcatgcacaaattctctaccctaatatatcagctttttctgtgcatccacatgtatgttttagaaccaaggttagaaactactaaaccactgaacttgagtggtttcaccaaacactggcaccctgttggggctgttgggactgattcaggcccaacctctggtagagccaaaagaggagactggggttctgggctagtgaagcctctcccctcctcccacccccagccccacctgtttccaaagaggacaaagaacaagcctatggcactaggggagtcccgtctttccttgcctctcctcttcccttctgtgctcattcctggtccaatctgcatgggaagcccctgaccctcccacaccccaggattcaattttggggtaaagaggggccagcaatccatcttctaagcaagcatggcctcccctcacccacagtgtcagcctggctcccgtggtccctggcctaggaccacacttaaaaacatttccaccctttgacttcagctcctggtctgtccaccctggccatgtcctgacagtccatggccacttcatttccctgagcacctggacacgggagctgccctgatgaccagggccacactgaccaggatggacggcctggccaggtgacagccacaggcctgctacatgccaaagccaggacccctcagccagggccagcccccccgcgcttttgaggtgcaggtcccaccccacagagaggagcttgagacccgtcctccactggaccatttgggctgtgttcagtcctcagaggggccacggctctgaagacatgctggccctcactggccagctgcggggagctgtgaccctggcgtttcccaggaacgcccctggctctggttcccctggggtgccggactggagacccctgaggtggcctgggatgggccagccttgctgtaccacaggcccctgcgccacgcccacctcctgcctgccccgcctccacgcagggccccaaagctctggggctgtcacagtttccattccgggctgacgctgcctgcagcctctctccacggtgacctccagaacagaaaagaggcagccagtcgtgcacctgggaagctgctgccccccagccactgcccaggtctcagaggagacccccaccagactgggcctcagcccctcctgttcctcacaggggctaccagccaacaccagccatggccaagtacgtcaagatcctgtatgacttcacagcccgaaatgccaacgagctatcggtgctcaaggatgaggtcctagaggtgaggggctggaggacggggtccaagagggggaaacagggcagggcttcaagggaggggctaccaggggaggtggggagcggtctagggccaggctgggtgatgccaggacggggcacagctgctggcccctttctccagggtccccgcccttggactctgatcaggatccccagcctgttggaggggccttcccatcttggggctccccaaaggcatgcagagacccctgtgccaggctggggggagcatctgcaccacgtggactcagcgggggcctgtcattcacacccacccaggagcccccacatctgcactggccgcatctgccagccggaatccaggccacccactgggggacagaaagtggagcaggctaggggggagtgggccacatccacagcctggctcggcggctcacgcctgtaaccgcagcactgggaggccaaggcgggaggatccctttagcccacgagttcgagacaagcctgggcaacacctcaaaaccccatctctacaaaaaacataaaaattatctggatgtggtggtgtgtgcctgtggtcccagctactctggaggctgaggtggggggatcgcctgaacccaggaggtcgaggctgcagtgggcagtgattgcaccactgcattccagcctgggcggcagagtgagaccctgtctccgagaaaaaaagggtcccccagactccttgaggcagggtgggggaggagcagcccagcgagggatggaggggtggaaacaggggtgcggagagaatggagcgaagcggggctccgggagaccctagggcgctcccgacctctgtaaagcggcgccagcgggtggtcccagccccgcagagcctgggtgtggggaggggctgacggcgcgccccgcaggtgctggaggacggccggcagtggtggaagctgcgcagccgcagcggccaggcggggtacgtgccctgcaacatcctaggcgaggcgcgaccggaggacgccggcgccccgttcgagcaggtgagcccgcgggggtccctggggtcgcagcccccagcttcctggagcagccccgcctgcgcctagccccgccccaaggccagccccgcggctggagagactggggcaggtgcagggctccctgggcagaaggaaagggctggtccgcaggccggggctgtagggggattggcggggtggggaggtcccgggcaggtgctgggaggcgggggcggggcgtggggagcctaatcgccccccgcccccgcaggccggtcagaagtactggggccccgccagcccgacccacaagctacccccaagcttcccggggaacaaagacggtgagaggtgctgcttcgaggcgggggtcccgggcccagggccacctgggggaggaagtgtggggggggtccctgggccgggggcgggggcaggggcaaggcagcggcgggcctgagtcgcgcgccccctcagagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggtgagcgggggcgggggatgagctggggcccgggcgaggggtgggaggtgcggccgaaggtgcgcagctgtcggggcgggcgccaggcagcctcgctcacagcgcggccctgacgcccaactgcccgcccccaggatcgtggagaacctgggcatcctgaccgggccgcagctcttctccctcaacaaggaggagctgaagaaagtgtgcggcgaggagggcgtccgcgtgtacagccagctcaccatgcagaaggccttcctggaggtgagcccgcctgcgctccggcgccacgcccctcctgcccctgcgccctcctctcccccgcccgttcctggggtcgcagagcaagggggaggccggcacccagacacgtgggacccccggctgaggatgcccccatttctcctccctagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccaggagccgtgtgtctcagttctctgggagtcggagtgggtcctggagcccccggaaactgcaccttttctaagcagtgccgggcagagggctggccgtccgccaggctgctctgcccctgagcccagaggggaccctgcccacttctcttcctgtggccctcccaggcccagcgaccagaaggcccaaagcgtgtcatccaagcccggctttcgctgggcacaaccctagtgggagcggtggggacagagccagctcggccagacggtcggcaggccccaggagggccatgagtcagagggcaaggctgaaactggatttggagatcttagcccaggctgacggaggctcccaagaagggggagcaggccacactcagcaccctgcgtgggaggggcacctgaccgccagatgggcggtccacctgagccgcacccttggaggggcctttggtgccctctgccggccgctccatgtgctgccgtgagtggccgccaggggtgccctcgccctggattggtggcagggggcaacccacaaccatgtgtccccatagcagccgtgaacccaaccctggtgcggagcatccggggacacagtcctggggtcttggcctgggcaggggcgactgtggggctgggctggggggggcgtgtcccttgcctggtccaccacccagccaggcctggacaccaggccacagaagccctgactcacagctcaggccacactaggccaagtcttaaccacagtgtctggtcggggcagcagggattgtctggtgccctctgagccacgacccgggcttgatggccaccaccactcctccaggcccccggaagaggcccccccaccctgtcagatggaccctgcagtgagagagacaggtccaagaggaaaaggggagggatgggggcaccggccctcctccctgcaacctgcagctcccgctgcctgctgagccaccacctcaggacggggataggcaccggggctatatctgctccaaaaggggcctctgtgggccccaggatgccagtccttggaagtgagggaggctgcccactccccaaccactcccagcaacaggacccttcctccaccaggatggtctgggcttcatatgcagcctccaggctgggctgctcagcttctgagggccccagatctacacctgcttcttcagccttctccctgtccacctcccccagccccatttagagccccctacctgctgtgccccactctgccacctgcacagctgaggagccccaggaagccagacccccagactccagcccccagatcccagccctaggccccaagcaggctcccaccccaggagccctgagtccgaggcaccctggccccagctgcctgctcggacctctgggcttccagaaattacctcccgtttcttccaaggggcttcctgccacctcctgagacccccctcaagagcagatgggaccaccgacctcaccggcctggtgatgggcacagggtcacctggcatcgggtgggctggctctctgtgtcctctctggccacccgccccaggggtgaggattgccccccttcctgccctgagggcatcactcttgggggcctgtggtgttttgagtgctgcccgcggcctccggaggccccagtggcagccccgtgaggcaggcgtggataagaatgacccgtagaggggccaggtcacctgctcgaggcccgagtttggggcaggggctggggttaacatgcaatctctcttagttccaacgtgtccttaaccactcactccctccccggcctccctacccacttccccatcaggcaggtccacagaaagaaggagggtctgctggtgctggccctggtggggccagggttgccgagggtctggccgtgagtgtgggagagtccacactgggcgaggagggagggcggggctttgaacatcagacctcagggtgggtggcctgagctgccagtggggccaccagtagccacaagcaaatatctccaccaacaaggcccgtctgtctcgggacaagcatgtctttgtggcgcttgctccccttctgtcctcccccacagctggccctgtccgcccgtgcccagtcaggccccgcagaacccaagaggggcttcccatgccatttaggaagggctgtctctttaaaaaaaaaaaaaattacaaaacggttgatttcccaagaggttgacacagcagcacgtacagtaagatgttcctcacacctgcggggatgccatggtcccagcccggggcacccgttacccaggaaggtggtgagagtggtgctgggaaaatgtgtggagaaacacaacagggacccccactaaccccacaaagctgaaccagccccagcagtactagacgtcatgagaggcaaaacgaccaagttcacagaagatgccaggatatccatgtgacaaaggggaagaagaattttctgtacaaaacttcaaaagcagtggataccaggcgcggcagctcacgcctgtaatcccagcactttggaaggccgaggcaggtggatcacctgaggtcaggagttcgagactagcctggccaacatggtgaaaccccatctctactaaaaatacaaaaattagccgggcatggtggcgcgtgcctgtaatcccagctacttgggaggttgagggaggagactcacttgaacccagggggcagaggttgcagtgaaccaaaatcatgccacttcactccagcaaaagagcaaaactctgtttcaaaaataaaataatgaaaattttaaaaagggagtcaatgagtttgattttggcaaaattaaagacttgcagccgggcgcagtagctcacacctgtaatcccagcactttgggaggccaaggcaaaaggatagcttgagcccaggggttcgagaccagcctgggcaaatggctagaccctgtctctacaaaaaaaaattattaggccgggcacggtggctcatgcctgttatcccagcactttgggaggccaaggtgggcagatcacgaggtcaggagattgagactatcctggctaacacggcgaaacctcgtctctactaaaagtacaaaaaattagctgggcatggtggcgggcacctgtagtcccagctactgaggaggctgaggcacgagaattgcttgaacctgggaggcagaggttgcagtcagcagagatcacgccactgcgtgagcagagatcatgccactgcactccagcctgggcaacagagagagactctgtctcaaaaaaaagaaaagaaaagaaaaaaagttattaaattagccaggcgtgctggtgagtgcctgtggtctcactgcctgtgctactcgggaggctgagtggggaggatccctcgagcctgggaggcagaggttgcagtgagctgagatggcaccactgcattccagcctgggcgacacagtgagatcctgtctcaaaaaaaaattttttttttttttagatagagttttgctctgtcacccaggctggagtgcagtggcgcagtctcggctcactgcaacccccgcctcccaggttcaattgattctcctacctcagcctcccaagtagctgagactacaggtgggtgctaccacgtccggataattttttgtatttttagtagagacggggtttcaccatgtagtggtctcaatctcctgacctcgtgatcaacctgccttggcctcccaaagtgctgggattacaggcgtgagccactgcacccagccaaaaaaaaatttttttaatgaaaacatttttttaaaagactcgcattcactgacggccacttggaggggatgctgactggcaagcagagcagacaccaaggacagtctctgggagacctaagaccctttcagggcattgtgagctccagacggtgtttgtttgtttgcttgttttttgagacagagttttgctcttgttgcccaggctggagtgcagtggcgtgatctcagctcaccgcaacctccggctcctgggtcaagtgattctcctgcctcagcctcccgagtagctgggattacaggcgcttgccaccacgcctggctagttttgtatttttagtagagacggggtttctccatgttggtcaggctgatcttgaactcctgacctcaggtgatccgcccaccttggcctcccaaagtgctgggattaaaggcgtgagccaccgtgcccggccctctacactgtttttatagcaagacttgagaagcaggccaggcacgtggctcacacctgtaatcccagtgctttgggaggccaaagcaggtagattgtttgagcccaggaatttgagattagcctgggcaacataccgagaccctgtctctactaaaaatttaaaaattggtgaggcgcagtggctcacacctgtaatcccagcactttgggaggccgaggcgggcggaccacaaggtcaggagatcgagaccatcctggctaatacagtgaaaccccatctctacaaaaaatacaaaaaattagcctggcctggtggcgggcgcctgtagtcccagctactcgggaggctgaggcaggagaatggcgtgaacccgggaggcagagcttgcagtgagccgagatcacgccactgcactccagcctgggcaacagagtaagactccgtctcaaaaagaaatgtaaaaattagccaggtgtggtgatgtgcatctgtagtcccagctacttaggaggctgattcgagagaattgtttcagctcaggagttcaaggctgcaatgagctgtgatggtgccactgcaactccagcctgggtgacagagcaagacgctgtctcaaaaaaaaaggtgctctgggttgaattatgtccttcagaaattcatatttcagtccttgtcccagcaactcagactgttgccctatttgggtcactgcagatgtaattaagatgaggccatgctggagtacggtagccctaatatatcaaaaggggaggccgggtgaggtggctcacacctgtaatcccagcactttgggaggccaaggcgggcagatcacttgaggtcaagagttcgagaccatcctggccaacatggtgaaaccccatctctactaaaaatacaaaaattagccgggcgtggtggcgggcacctgtaatcccagctactcaggaggcttgagacaggagaatcgcttgaacctgggaggtggaggttgcagtgagccaagatcccaccactgcactccagcctgggcaaaaaaaaattaaaacaacagataaaaaggggaaacgtggacacagacacgatcggggtgatcaccggaggagggggaggtttctacatgctaaggagcaacacggagcggcagctcccacagaagcctggagaggcccagagcagagatttccacacagcctcgaaggaaccagccctggccacgcctgcatctcagactccagcctctagaaccaagagaggagacgcgtctgttgttcacaccacccagtgtgcggcgtttgccatggcagccccgtgaaacacagaagcctgccttctcaaccgcactcacctttgctcgaatatgagcagcccccattcttccccgacacacacagtcaaatcagcaaacgtcactgatttgatgcagtctcacctggaagcgtaagcatccggcgtcccgggcgcctgctgcctaggtgttggggctgcccggggaagagctgggagccatgtcccagccgtgactgacctggccagcttccccaggttacttgaaagaacctcttgtgtcgagacgtgggtagtcattgtctccaaaatgaacaaagtgaaaacaacggaccctcttcgctgccgtgataaatctgcattttccagtggacatttgagttttggaaactgccatcataggcaaggctgctccaccacctgaagctcttttttttttttttttttgagaccgagtctcactctgtcacccaggctggagtgcagtggcccgaccttgtagctgggacctcatgatctgcctgcctcggcctcccaaagtgctgggattacaggcgtgaaccaccgtgcctggccctgaagctccttctgataggctcagttagggagcgtgcatgttccttattgaaattggaggggtcagcacttgggggtctgggaaaccccacgaccaaggcgggacattccagcatcactcatgggcctaagagccagtcacagaaggtccacaatgatccagaaaggctatcagggtgcccttccctgttccgactacaaatctggatgaagccagattttcctcacatacttctcctagaacaatgattcccagaggcctaggcaggccccgggaggaggacccctgggcctaggaaaccggcatgatggagattttgcaaacgtggataccagtgccactctgctcactagattttttgtttaacaaagatgtactgggccaggtgcagtggctcacacctgcaatcctagcactttgggaggctgaggcagatgcattatttgagctcaggagtttgaaaccagcctgggcaacatggtgaaaacccgtctctactaaaatacaaaaattatccaggagtggtggcaggcacctgcaataccagctacctgggaagctgaggcaggagaatctcttgaacccgaggtgtggaggttgcagtgagccaagactgcggcactgcattccagccttggtgacagagcgagactctgtctagaaaaaaaaaaaacagacacacacaaaaattagctgggcacggtagcacgtgcctgtagtctcagctacttgggagactgaggcaggaggatcacttgagtgcaggagatggaggttgctgtgatcacaccactgcactacagcctaggcaacccagccagaccctgtctcaaaaaaatgtataactatttatagaagtgtgcaagcgtgaaagcgctggctcccaggacagccacgaagccacgggtcgttgacacagccgagtgggcgccattgccggagcgggaacccgcctgagggtcttcacggggtctgagtgggcgccattgccggagccggaacccgcctgagggtcttcacggggtctgagtgggcgccattgccggagcgggaacccgcctgagggtcttcacggggtctgagtgggcgccattgccggagccggaacccgcctgagggtcttcacggggtctgagtgggcgccattgccggatccggaaccccgcctgagggtcgtcacggggtctgagtgggcgccattgccggatccggaacccgcctgagggtcttcgcggggtctgagtgggcgccattgccggatccggaaccccgcctgagggtcttcgcggggtctgagtgggcgccattgccggatccggaaccccgcctgagggtcttcacggggtctgagtgggcgccattgccggagcgggaacccgcctgagggtcttcacggggtctgagtgggcgccattgccggagccggaacccgcctgagggtcttcgcggggtctgagtgggcgccattgccggagcgggaatcccacctgagggtcttcacggggtctgagagggcgccattgccggagccggaacccgcctgagggtcgtcacggggtctgagtgggcgccattgccggatccggaaccccgcctgagggtcttcacggggtctgagtgggcgccattgccggatccggaaccccgcctgagggtcttcacggggtctgagtgggcgccattgccggatccggaacccgcctgagggtcttcgcggggtctgagtgggcggcattgccggatccggaaccccgcctgagggtcttcgcggggtctgagtgggcgccattgccggatccggaaccccgcctgagggtcttcacggggtctgagtgggcgccattgccggagcgggaacccgcctgagggtcttcacggggtctgagtgggcgccattgccggagccggaacccgcctgagggtcttcgcggggtctgagtgggcgccattgccggagcgggaatcccacctgagggtcttcacggggtctgagagggcgccattgccggagccggaacccgcctgagggtcgtcacggggtctgagtgggcgccattgctggatccggaacccctcctgagggtcttcacggggtctgagtgggcgccattgccggatccggaacccgcctgagggtcttcacggggtctgagtgggcgccattgccggatccggaaccccgcctgagggtcttcgcggggtctgagtgggcgccattgccggagcgggaacccgcctgagggtcttcacggggtctgagtgggcgccattgccggatccggaacccctcctgagggtcttcacggggtctgagtgggcgccattgccggatccggaacccgcctgagggtcttcacggggtctgagtgggcgccattgccggatccggaaccccgcctgagggtcttcgcggggtctgagtgggcgccattgccggatccggaacccgcctgagggtcttcacggggtctgagtgggcgccattgccggatccggaaccccgcctgagggtcttcacagcatctgagtgggcgccattgccggagccggaacccgcctgagggtcttcgcggggtctgagtgggcgccattgccggagcgggaatcccgcctgagggtcttcacggggtctgagtgggcgccattgccggagcgggaatcccgcctgagggtcttcacggggtctgaggggaaagcagggccggggtgggcgtgtggaaggttttggggtgtggcttcaggtgagtcttcaggaggcttcgttaggattgggcatgtttgggacggaagtggttcgggactgatggacataagaagggtttggagtgagtctggagactgagcccagctgtgctgtccgctcacaggtcctaggcaacgactgtcaggaagttcccaaaataagtcactcacaacctcatcgtcctgggtaagtttcctgatatgttccacagctcaatggtccatcattgtttttggttttgttttgttttgttttgttttgttttgtttttgaggcggagtctcgctctgtcgcccaggctggagtgcagtggcgcgatctcggctcactgcaagctccgcctcccgggttcacgccattctcctgcctcggcctcccgagtagctgggactgcaggcgcccgccaccacgcccggctgatttttttttttgtatttttagtagagacggggttttactgtgttagccaggatggtctcgatctcctgaccttgtgatctgcccgcctcggcctcccaaagtgctgggattacaggcgggagccaccgcgcccagcctgttgtgttttgtttttgagacagcgtctcgctctgttgcccaggctggagtgcagtggggcaattggggttcactgcagcctcgacctcctgggttcaagggatcttcccagtctccacctcccaaagtgctgggattacaggcgcgagtcactgcacccggctccatctttttttccccccaaaactggctgtcaagaacaaggaaaattaaaaaaaaaaaaaaacacaaggaaaatttaccatcttaaccattttcaattgaacagttcagtggcattgagaaagtggaaaaactcaaaccgtgttccctctggtctcactgcacagtaataatcagcacagagaacttctgtttctcccgcacaccaagcaagcagccagctttgcaacagacacagaggagttctgtttctccccgcacacccagcaagcggccagctccgtttttcctgcacacggagcaggcagtcagctgtgtctcccgcacaccgagcaagccctcagctttgccacagacaccggctgggtgttctccctttcagttcgcttctgaggctgtctacctgcagttagccccagatccacaggctgggggctcagtcccacaagactgccc

SEQ ID NO: 508 - DNA, 430507 bp, Homo sapiens
taatttttaaggcagggtatctttaaattcttcaaatgatattcaaataaactttgtcaagaaacatgattgcatctgtttgtctcgtaatagccatacattccatttgctggatttgattattttatcatattaatgaatcatacgtgatctggcaaagtctgagtgcttatttaaaaaggtagttttggctagacgaggtggctcatggctgtaatcccaacactttgggaggccaaggcagacggatcacctgaggtctggagttcatttgagaccagcctggccaacatggtgaaaccccgtctctactaaaacataaaaattagccaggtatggtggcaggcgcctgtgatcccagctactcgggaggctgaggcaggagaatcacttgaacccgggaggcgaaggttgcagtgagccgagatcttaccactgcactccagcctgggcaacaaagacttcctctcaaaaaaaaaaaaaaaaaaaattaaaaaataaaaaggtagtttataaaatctacatttatagaaaataaactatttacttttttgttttgttttgttttttagacagagtttcgctcttattgcccaagctcagtccaatggcgcgatcttggctctgcaacctctgcctcccgggttcaagcaattttcctgcctcaacctccgagtagctaggattacaggcttgtgccaccatgcccagctaattttttgtatttttagtagaaatggggtttcatcatgttagccaggctggtcttgaactcctgacctcaagtgatccgcccgcctcagcctcccaaagtgctgggattacaggcgtgagccactgtgcctggcctatttacttctaaaagataaatttaaagacagttctacccatgtatctaggtcacagtcagtggtgtgagatcgagaggcatttagagcttttgggtcatagtgttcattggatcattattctcgtagctaaagtaaaacgaactttcaggaggttaaatggcttgaacatacataccacaggctagtggcagagagataacagaatgcatacatacaacttgattcctagctcagtccttttcccattaaactacatggctcattattcagttgttttttattttctggctatgacaaattactaatgaggtcaaggatgtgaattcgattcttttactgaccaattaggcttacaaagaaaaaaattgttaggtggtcatagcagactacatgcctcattctgactggctgatgtgtgtgggataatggtcagaaaaggaatcaggcaagtgagtcacaaatcttgaaaacagccatcatcatgactaaaacccaactcaaagtaaaaggcctgcacatagcatgccagtgggttgttgaagtccacagagtagaaactgaactggaaccacctccttaggatggattctaagcagaaaaaccctattttcattcttcaatggttgtctcaccttttctttgaacctagaacataaatatgaatacagacctgctcatgattacacatctgaacacactttgtttttaatgccttcccctcagaaaataggcacagcatttctgaataaaaaagaatgaaagagtatctactcttaagaaatcatttttgccaagattttttgcacataaatcaaaagtgacaatactgtttcttcagaaacagtagagactctttgaaatcaatatagaatctagtataacccaagcaaagttaaatatgttccagagactgaagtgatgttttcattagtaaaccccaaatcttaagggaatgtgcattctaacaagttagaatagttagttactttttaaaactttcattttaaaatcaagacatttaaaaaacagatgctttggccatttgcttattaaactataaatattaaaccaaaagttatttataggtatgatatactaacggcactctattagcttttttcatttaaatagcaaattcagacataataaacactcataatctttttggtttattattctagtttgcaagattttccatttttaaaaattgtacttatttacatcctgccttgttccaaacaagattcaaggtggggtattcaattaagtttataaaataccataccctccaaattttactgagtcaagaaaaaaagctaaaagctttttatcataaccttttaattttatcctcctgcttgcgggcatgctgtttaagtaaaatgttctcatcatgcaaacgcaaaaatctgtcttccagttcctcacgactgacacgtgacactgcctggcgagacttcattgtccgtgttgttgaagtttctgcaaaaatgccaagataattaattgtgaggttacttaaaatagtctctagaaactcttgatattaatataatctctgatgcactcatctgagattttttcctttgtgacctacagttaagattgctttagaaaatgttgtaccattgtttacatcaattatttaaggtgagaataaaaatctttgctattaatactttatatacagttttaggaatttgaataacaatagtatccattcaaaaatgtattcaagtgccgttctttaagaatataagatggaattctgattcaataaagacttttgaatttacctgctgaatgttgtgacaactaaaagagtatccgaagcttatttttttacaaaggcaagagtaagagtaatttggtaaacataatataactaagatatttttctgtgctatgagtgtcttagaaaacaaactataaaagttgtaagaccaaatcaaaaaacccctaaatttaaaaattttcatttaaaagcttcacaaataatttctctttacactaccttatataaattttaagaacgtttatactctttagcatgtgtttatgatttctttttacagacgcttaaatttggtattttccgagccaggcttggtggctcacgcctgtaatctcagcactttggggggctggggcgggtggatcacctgaggtcgggagttcaagaccagcctggccaacatggtgaaaccccgtctctactaaaaatacgaaacttagctgggcatggtggcggacacctgtagtcccagctactcaggaggctaagtctggacaatcgcccaggaggcggaggttgcagtgagctgagattgtgccactgcactccagcctgggtgagagagcgagactctgtctcaaaaaaaaaaaagaaagaaaagaaagaaaaaagatgactcaataaaaaatgagcaagctgcttgaacaggaacatcactgacagaaaattcatatgatcattaaacatatgaaaagtttatcaatctccctctccctctccctctccctctccccacggtctccctctccccacggtctccctctccctctccctctctttccacggtctccctctgatgccaagccgaagctggactgtgctgctgccatctcggctcactgcaacctccctgcctgattctcctgcctcagcctgccgagtgcctgcgattgcaggcgcacgccgccacgcctggctggttttcgtatttttttggtggagacggggtttcgctgtgttggccgggctggtctccagctcctgaccgcgagtgatccaccagcctcggcctctggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaagagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctttgccctgccgccccgtctgggatgtgaggagtgcctctgcccggccgcaaccctgtctgggaggtgaggagcatctctgcccagccaccccatctgagaagggaggagaccctccgcccggcaaccgccccgtctgagaagtgaggagcccctccgcccggcagccgccccgtctgagaagtgaggagcccctccgcccggcagccaccccgtctgggaagtgaggagcctctccgcccggcagccgacccgtccgggagggaggtggggggtcagcccccgccaggccagccgccccgtccgggagggaggtgggggggtcagccccccgcccggccagccaccccgtccgggagggaggtggggggtcagccccccgcccggccagccgtcctgtctgggagatgaggggcgcctctgcccggccactcctactgggaagtgaggggcctctctgcccggccagccgccccgtccaggagggaggttggggggtcagcctcccgcccggccagccgccccgtctgggagggaggtggaggggtcagccccccgcccggccagccgcctcgtccaggaggtgaggggcgcctctgcccggccgcccctactgggaagtgaggagcccctctgcccggccagccgccccgtcgggagggaggtgggggggtcagccccccgcccggccagccgcaccgcccgggagggaggtgggggggtcagcaccccgcccggccagccgccccgtctgggagggaggtgggggggtcagccccccacccggccagccgcctcgtccgggaggtgaggggcgcctctgcccggccgcccctactgggaagtgaggacccctctgcccagccaccaccccgtctgggaggtgtgcccaacagctcattgagaatgggccatgatgacaatggtggttttgtggaatagaaagcggggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccgcaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgaggaaggcctcagggtcctctgcctaggaaaaccagagacctttgttcacttgtttatctgctgaccttccctccactattgtcctatgaccctgccaaatccccctctgtgagaaacacccaagaatgatcaataaaaaaaaaaaaaaaaaaaaaaaaattggtattttccatatcattgtgaagaaggtcgattttcaacaattctccaatagaaacaaagaacaactgatagagactaaggtcctgtgataggttactgagcacaagaattgaacttatagagtatcaaaacccaataaatcactttgcacacttacaagttatttgtataatacttgatactccctgaaagatctgcagagcaaagcttacacatactttttacttctaacaataaaatctgtgtagccaaaaattagccggcatggcggcgaacacctgtaaacccagctacatggcaggctgaggcaggagaatcgcttaaatccgggaggcggaggttgtagtgagcggaggtcgcgccactgcactccagcctgggcgacagagcgagacttcgtctcaaaaaaaaaaaaaaaaaaaaaaatttctgtgtagccaaattttatctttttcaataaacaatacattgaccacttttctggttttcacagtggccatttacactgttctgattgaaaagtgtatgtagattcctaaatggaatgtatcttaaatccctagccttctcaggctagagggggattttacgttttctatgagctgttgataatcgatacatgcatgacagcatagctgacacaatggacacacaaagataaacacagctctctgttctaaattgttctttaaagtagtgcttttctttctcaatttgaaagtgctttttagctctacagcaactactaagtgataaaaggataaagaaaacctttaatccatattaattcgataaaaaagtcactatcatgtgagatattccacttaaaaggcaaaacacttaaaatacggcctttcctcccatataaaatttaaacacaaagaaatgttttaacactgaatgtaatttaaaccaggcaattcagtttggaggcttgatactctctatgtagtttctactgatgtgaggaattttaaaaagatgatttatgttaattctttatcagaacagaggggggactgtacattttctatgagctgttgataactgatgcatgtagtaaaataccatatgtgttctaaactctccatctttttgtttagtccaatcaaggactatatagttacttaaatggtttggtttgtatgagtataagaaatactttaaattaaaagtagtcagtgatcaaagttcataactgtaataaataacagctggccataccttgtaaccctcccattccaaagaggtttagacctgtatctttcacaggcaagtctcctgcagtctcatcagttggaccagacatggcctagctgtggaaaaaagaaaattcaaataaactctttccaaattattacattaactatgcaatggaatgaaccaaataaaacgaaaaagggactagaactttaatgggcatcttattgtccacatgtgctgcttggagaagatgaaagcttctattctaatagtactactacattcagtcatggagacagtgttcctttcaacagtgtatttcctatagtttgcttaggaaatgaagtaagattatcatttaagaaatacctcctctccatccctttcctctccccagcctccaaaagaaagcagatatcttggaaaaaactcaggtcaggaacttgattcaaatggttgctctatcattaacaaactagtcaagccacctaaactctctgagtttcagtctctcagttttaaaaatggagaaaataatacctatctcagagagttattctaagggtaaatgggatgagtaaattaaaagcactgatcacatgtgcctgggatgtcaatattactcaaatattgtctgcttgatgtacaaatgagtgggcagttctgtgcattttgtgagttttgtgaaagaggtttcgttgcataaatttaccaactgggtttgtgtttttttgtgtgtgtgtcttgcctttgttgccatgaggcctaggtctcacccagggttcaactacttcaacatataggctctctagctaattctagtatttttgtagtttctattctttacagaaatacaccatagtaactctattttgagtatggatgtgagtggtccacacaatatctagtatgcaaaaataaaggattttatattttcatttcaatctacctagtaagctacatgcaaactgtgaatgaagatactctaaagggcagagttcttaagctctaggatattggttctagaatgtaaagaccaagacagtagcaagcttcattgtcttgttcagctctgtattcttggaggctagcatagagcgtggtgcattctgagagcaggcattcattaaatagttgttgagtgagtgaatggagtccatggggtttcagggtctgtgaacccagagatggtttaccaaattttgtatgtatatgtatatatgcaatatcttttaaagagggttcataacttttattacaactcgcaaatggtggagaaccattgcattttgcttttacagaaacagctaacagacaaatccttgggagatcatctacttcttttggaagtactcctatagaaaaggtcaatttttaggatcctgttgacacataggcccgtgtatgaaaatgattagttttccatgacagagttaaggtcactttaaaaataataatgatgatgatgatgatgatggtgttaacattcattgaacgcttactatgtgccaggtactgttctaagtgttctgttataggaatgaagtgtctcaccatatccttgtgaggctgttactcaaatgattcctgctttacaaatgaggaagctgagacacagattagttaactcacttaaggtggtagttgaaagtattaatagttgtgtctggtgatatttttggttgtcacaacaaggaagcgggatgctactggcatctagtgagtagaggccatggatgatgctaaatatcttacagtgcttaggagacataataatgaattatccagcccaaaatgttaataatagtgtagaagctgaaaaaccctgcacaatgctgcaatgcctctccaacaccatcttatgttatccttctttgctcactatgcttcacttacattattctttactttcctcgaaccccccatacccttgtcttgctcaaggcctttgtattagctggttccttaatctttggagctcagttcacttcctcagacaggttttccctgaccatcctatgttagagtagtcttccttacatttcttcactgtttatttcttttcttttcttttttttttttttgagacagggtcttgctatgttgcccgggctggccttgaattcatgggttcaagtgatcctcccacctcagcctcccgagtagctggaactacatgtgcgtgccaccaagcatggcttgtatctcttatagcaactgcctctatctgaagttatcagataaaattattgtttgtctccactaaaaaaggataaacatcttgagacgggtattagtcttgttcacaactgttcaggaacagtgcctggtacagggtgggaaccaacattaatatttattgaatgattggctgtgcgtggtggctcacacctgtaatcccagcactttgcgaggccgagacgggcggctgacttcaggccaggagttcgagaccagcctggccaacatgatgaaaccctgtctctactaaaaatacaaaaattagctgggtgtggtggcacacgcctgtaatcccagctactcgggaggctgaggcagaagaatcgcttgaacctgggaggaggagtttgcagtaagctgaggtcttaccactgcactccagcctgggcaacggagcaagaacctgtcacacacacaaaaaaaagaataaagaaaaaatatttattgaatgaataaatgaatatcaggtactgagattaaaatggcaagcaaaacccccgcctttatgaagctagcaagttatggaggtaatcacatgataaacaaataatatataattaagcaaacaatagaccactcaggaggtttagggtctaccaaccaactcctaatccagggcaaatgagcaaactgtgttagggacctacaacttgcaggatctggatagagatggcaattagcagcatcaactctcaccttcatggctgggatataacatttcaaattggtcctggacgtggggataaagggcggcctgtgattcaggcctgaggatgtggaggtgtcttgggctgggctgctttcacgccagcagaactccagggccaactccagggccttctccaggcggcagagcggaccctaggaccccggcccgcgctgcagtggggagggtcagcaacctccacccaccctcatcctcccccatcctcccgggtactcaccgtgccactggccctgcagctagctaccgttgctatagcgccgacagcgtggcgggcggctggccgagaggagcacgggagaaacatggcaggctcccgtagcctcctgggaaatgtagttctccttggactctagcctgtttgctcgcggggtagcggactacgctcttccagctgtcggacctgggaaattctcctgtgctaaatcccgtggcgctcgcgggtgtcgccgcggtgcatcctgggagttgtagttttttctactcagagggagaatagctccagacgggagcaggacgctgagagaactacatgcaggaggcggggtccagggcgagggatctacgcagcttgcggtggcgaaggcggctttagtggcagcatgaagcgcaccccgactgccgaggaacgagagcgcgaagctaaggtatgtcgggctcccggggcctggagatcttcgtgcgctgtgagcaaggatcagggaaccggaagggcttggtttgatggcgagcggatgcgcggtgttaaactaagggatgacagggccttgtcagcaagggacctggagatattagaggggatgttacaaattcgtgctcttcaggatgcaggccgagtcttgttggatcggctcaaaaatgagaagcaagatacccatttccttgtccttcttctgcatctattccttggttaaatttgtcgccatccctgtgcctcagtttaccggattctcagatgactgtgatcataccagctgtgctttctcataatggtctctgaggactgagatcggcttagatgaaatatctgtgcagtcagctgtgtttctttggaacaattgtctccgtgaccggctgataacagtttgtgtcttttagcgctgtggatatgaatctttaactacattgctcctctctacctttgatgttcagcttctggtagttgccattccatgggatgaccataataatggcaacagagattttaaaaagcatttattgtgggtcaggcactgtattaagtgcataatatttaaattatttcatatcattgtcacagcagattgcaagatagatattatacagatggagtataaataacagcccagcttcacagatgaagaactgaggctcagaagcattgagtgttttcctttctctcattcccaaactcagatcctgttgatttgtctacgtatattgggaatatgcccactttttttttttttcatctccactaccttggaccaagctaccattatctttttaatagactgttggaatagcctattgattggcctacactcactctacaccctaacttaactcttcttccaccttctctcccttccctcaactaccattctcttctgcacaccatagagtaagatcttcgtgaaatgcaaatataattatgtccctttcctttctccttactctgccaaccacctgtttaaaaatattccatggctttctgttgctcttaggataaaggcaaaacttcacattgcctacaagatcctgcatgatctggaccctacctgctttcacaaccccattggatatgacactctgctctctgcctaccagtcactttggccttcttaaaagtcactcttcactatactttatcgggcttcagggcctttgcacatgtcatttgctgcctactctatgttaggcaaatattggcagtgaataacagtgttaaataacgtagacacagttcttgctttcatagaatttcatcttacacgtgagtctgtttagggcaatacacctaaggatttaaaatataaaatctgctctatattgacctgagttattgcagtatttcgtaagggaccagaagttttcatgcttgagtctgcatatgatgtggataatatattaaagataagcacaaagagggcgacccttctgctttagtctacacagtgcaaagaaacaaatgtcacctcatggtgttgtgcatgatgtctttctcatctttcaggtttatttttaaagtatttcatttattctgtgaagatttgttgagcacctattatttgccataagttgggattataattttggctgaaatagaatcactgcaccaaagaagctcttactctattgaaaccataaccattgcctgtgagggagttactagtgtcatccatattttagagatttagaaactgagacttgtaggtaaatcgtgacttgcccaaggccacttggttgctaggtgaaactagtgctctgagccaggtcttctgactccaaattcaaggcttttcccattttctgcttgtgaaacatgttgaattagtagagcaaattgtcttccttttttctttaaaaaattggctgttcatttaaaatttgtttgcttaatattatttgttagaacaaagtataagtagttgttttaaatcttaaatgtaaagtgtccaatggctcatgaattatcttctctttttctaatcaattttattgaggtataatttacatacagtcatttgcaaccatttttgtgtacaatttgatgccttttgacaaatgtatatacctgcaaaaccaccacagttggcatagcgaacatttctctcctaagttccctctcgttaatttgtggttagtctgtccctccaccttggcccccaaacaaccactgatatgttttttgtctctgtagatgcatctgtattttctagatttcatataaatggaagcatacagtgtatacttttgggtctttttttcattcagcgtaatgatttttttttcaaaatagagatggtgtcttgctgtgttgcccaagttggtctggaactcctgggctgaagccgtcctcctgcctctgctacccaaagtactgggattataggcgtgagccactgtgcctggccagcataatggtttttgagattaatccatgttgttgtatgtatccataatttgttcctttttatcgcaaattagtggcccactgtatggagataccacatgttgtttattcattcacttgttgctggacattaggattgtttctggttttggactcttatgaaaaaagctgtttttaccattcatgtatgagtctttccattttcatttctgtcaaaaaaagctgctatgaccattcacctaagagtctttacatttttatttctgtcgggtaatgcccaggagtagaattgcttagttataggggagttctttgtttaaccttatgaagaaattaccagttttccgaagtgatttgaccatttgttttagtttcttatggctgctgcaacaagttaccacaaacttggtggcttaaaacaacagaaatttattatcttacagttctggagatgaggcattgaaatcaaggcatcaatagggccatactccctttgaaggactctaggggaaactccttccttgcctcttccagcttctagtgtccctggtgttccttggcttgtggtagcatcacttcataacttctctgcttccatcttcacatggccttctctctgtttctgtgtctcaaatctctctctcctttctgttaaaaggatgccagtcattggattaggacccgtcctaaatccaggatgatcctgagatccttaagagcctcaacttaattacatttgcaaggacactttttccaaataaggttacattcacacgtgccgggtttttggattcggacatatctttttggggaacaatattcaaatgcactgcacccttttacattcctaccaactgttagtaggaatgtaaaatgagagttctacttgtttcatatcttttcatcgcttgtcagtcttttacattttaaccattctagtaggtgtgcagtgatatttgattttaatttgcatttcagtgatgactaatgaggttgcatatctctctttttgtaaatctttattgagtgaggtataatttacataccataaaattcacctgttttcagtgtaggactcaatggttggtagcatatttgcagagtcgtgtaactgtcaccaccgtcttattttagaacagttccattccagaagaaactttgtattcatttgcagttatttctcaattctacttcctccctagggaaccacgaatctactctgttctttagatttgccttttctggacatttttatatagatggactcatacaatatgtggtcttctttcacccaggatgtttttgaggttcatccatgttgtagcatatattggtactttgttcctttttattacacagtggatagaattccagtgtcaggccgagcatggtggctcatgcctgtaatcccagcactttgggaggccaaggcaggtggatcacctgaggtcaggataacttagatcaagaccagcctggccaacatggtgaaaccctgtctctactaaaaatactaaaattagccaggagtggtggcacatgcctgtaattctagctactcgggaggctgaggcatgagaatcacctaacctggaaggcagaggttgcagagagcccagattgtgccactgcattccagcctgggtgacagagtgagactgtgtctcaaaaaaaaaaaaagaattccagtgtcaggatataccatattttgtttatctgttcaccagttgatggacatttgatttgtttctacattttgactattatggaaaatgctactgtgaacatttgcaccctagtttttgtgtggacgtgttttcattcctctttggtagatacttaggagtggaattacaggacttatggtaaatctatgtttaacattttaagaaactgacaaactgtttacttgtgtggctacaccattttacatttcccatcagccattttgagggttacaattttgtcacatccttgtcaacacttgttgttgtctgtcttttctattgtagccgttatagtgggtgtgaagtagtatctcattgtggtttgatttgcatttctctgatgggtaataatgttatgcatcttctcatgtgcttattggacatgtgtatatcttcttttgtgaagtgtctgttcaaaatctttgcccatttttttgttggattgtttgtgttcctattattaagttttatgagttctttatattttctagatataaatcctttgtttactatgtgtgttgcaaacattatcttccattcatctaggttacttaatagtttttaagaaaggtccactttatcaatgtttatttttatgattcatgctttttgtgtcatatctatgcagtctttatcccaaagtcacaaagatttcttttttgctttttaaattaaactttgtcatccccataatgggcacttagtttttatttttcttttctctttgaaataacttagatcatattttctctcttgtgattgcttatgctatggacttttatgctgtttccaagtctggagggtgaataagaaggttggaccacatagctttctacgattaacatttatttaatttgtgttaagcacatgagaatactatacggtattcatgcatttttaaaatgaacttttcttctaaggcatataatagaacagtccagataagtatttgatggtttgagttagaaccatggcgtctactatttccttactgtagggataggggattcataccccgtgcctcagtttctccagtcattaatgaggttaagaatagctgcttctgtgggttggtgtgaggacccagtgtgatgaggtctagctactattccaggggtagagtagcatgcccttgattgagtttggtggcctgaggggtcctctgctggggtggggctggccctatgcattttttcccagatgttataatttattattttgaaatgatttaaaacttattgaagagcaagagtagaacctagagctctcatagacctgtttgtccatattcacaggttaacatcttgctgtgttcactttattgctctctttctcgccatatatatccacatgaacaatttttttaatgaaccattgcagagtaagtcggagacatcagtcctctttacccctaaatagttcagcatatatttcctaagaacatggacattctcttgcatacaaatataaacacaatcaattgttaatttcagaaaaagttaacattgatataatgctattatttcatccaaagtccatattcaaattttgctaattgtcctaataatgaattttatagcatttttttcctggtccaggttccatctggattgcatattacctttcattgtcaggtccctttggtctcttctcctttaatctggtgtcctttcatgtcctttaaattggttcctcatcctttttctttcaagacattgacatttgtgatgtgtgcaagctatcttttatttatttatttatttatttatttaatttttttgtagaatggccctgtattcttatttgtcttatgtttccttatgattagattcagattttgcctttttttttttttttttgagaccaagtctcgctctgttgcccaggctggagtgcagtggcgcgatctcagctcactgcaacctccacctcccgagttcaagcgattcttctgcctcagcctcctgagtagctcagactacagacacgtgccaccacacccagctaatttttgtatttttagtagagatgggtttcaccatgttggccagcctgatctcgaactcctgacctcgtgattcacctgcctcggcctcccaaagcgttgggattacaggcgtgagccaccgtgcgcagcccagattttgcatttttgcatgtatatttttgaggaaagatggggcctctagaggtcacatatttataatccacatatgcctcctggctgtaggtaagttttatttggcccaaacaaactaaaagttgtttcagaattattttctaatatttaaaagttgagggatttcacataaagatctgggtgtctgactctcttgaaaaacttaagtatctggtaacagtgggcatgcattttcctaactagaattgaatagtggcttcccttttaggtgggaaatgtgctttccattttgctgtcatccagttttgccccttaagttacaatatagtggtgtagtgtggagctttagatgcagactcctgagattgaattctgctccctcatttacttgcgcaagcaatttaacttctctgagcctccatttcctcatctatcaaataggagtgatatggttctggtagggattgagatattatatagcacataaaacattgctggcatacagtaaaaataaacattgttatcatcatcattatcaccatcatcaccaccaccttcactactgcctatctgaccccagtagatatatattctgtatgtatatatatatatatgtattctgatcccaggacgtttattctgtaaacttatgttgagtgtctagtcaagtggattttctcaaatggggttccattaacttatttcccatgcagccagaatggtactagttttgtaccacctttcagaaaattgagaatatagtcactcaaaccattttctgtgttctgtggttcagataaggaacctgattaagtgtcgagtagtgtactcagcaccagggtaaagatggcagacacagtcccatggaactggctggctgtccatggaaggtaagtaagtaccaacagcagagtggtgagttttatcacgggaggacacggtagcaaagaggatctaacatggcctagtagtcatggaattccttccttagaagatctgtttaaaggtgtatccttatgagaggcctgggattccttacggggtttttcagaaacattaaaactgtttcattagtcatggaataaaaagctatggatgttgaaatccaagttagcttcaaagactcttatgctggcttaggttagataatcttttaaactattaaaaatagaactagtttattatggaaatggttatatacctaagaacatttaataattttgtttgagtaatgtacatttttatcaatgaaggaaaatatccagaatatgtaacctaccgttttaagtaacatgatttaaaaactcttctgcttttggtgatagttgtcttatcaactttaaatgataaggtttattgagttataaaaataataacttggccaaatgcagtggcttatacctgtaatcccaatgctttgtgaggccaaggtggaggaggctcacttgagaccaggagttggaggttacagtgagctgtgattatgccactgcactccaggctgggcaacagagtgagaccctgtctctaaataataataacaataactcaacaaaagaaagtttgttatttatgtttttactgactgggtatttttaccttattttatatttcaaatttggcattttattgaggtcctgagaaggttcttttggagtctacttttattatgggccattctagattatgtcaccagtttatctaaagtggacactaaatataggacagttttggtgttaggccaaagaccaggggacttgaaaaatgaaaacctcacctgacagattctactctgttttttttccttcttcccgaaatccattattattttttgcttaatctctccttcaatatatgggtaagcctttaatcactgtttcggaggtttagttgacttctgtaaatagaagaagagttagtgtatttgatcatagtttccaaaccacttttaatactgtaccttacttgaaaattaaccagctaaactatcgagtaacagtgagttcttgttgctttctgttatttccaggctgtttcctaaccctcctagtactggttttgaaaactaaattagccattcaaaaaaactcttagacactttgagcaaacagtagcttccttgaagatagcatttgtgtctaattcatcttttcatctctccattgtacctggcaggatgtcttccacaaaggagacattaataagtatctggtgaagaaagattaaatggttgagagagtccagcatctgttatgtgatatatgtgacccttcataattatgattctggatccttggctgctaatgagatttactgtggctgagtttagtgatacagattttggcatgtagatgatagtctccaaaaaagtagagatcatgtttttttttttttttccgttttgtcattcaccattttatccctagcccttaagattttgccagacacatggtagatattccatacttgtcaaacaatgaatgaatgaattcccaagagcatcacttgttattggtcagtagactttctaatagtgagagatggaaccggaatttgaaagaagtaatggaaaatggttaagtaccttatgaattttaaattaatataccataggtgtgggcattaattttgagaaacaagactcttctgttcaacacatactttagcaactgtcaacacttgttttcaagtgttctcttccaattttaaaatgccagtttacctttcagatttagagtattttgttgttgttagtttattatggcagttttcttgctaaagttatatttaaagtgtgactttctaacttctagaggagaggaacttttgttaaggtggtacttttggaaccttaatgaaaaacacaccttagagaaggtgaatttagagttctgctaagcacattcatttactcttctattataaactggttttgtaatattttataaaattgtctcactggttgatttcacaatgtaaactgggaggattcttaggattccttgggttggattagaacaggttcaagagatgaagatttgtgttggtaggggcttgtttccaaacgtttgtccttggcatgctctttgttaagccatcacatgtttgaaagttaaaccttgaattggtgccatggtttgcatttaaaaaaatgtattttattatggtaagaacacaacataagatctactctcttaccacatttttaagtgtacaataaagtattgtaaactgtaggtacaatgttgtatagcagatctctggcactgattcatcttgtataattgaaactttatgccgcttgattagctctttcccatcctcccagccctggtcatcatctttctactctctgattctatgagtttgactattagacgtacatttttgtttttgctataagcatctgtcctgttgctatgctgatcatttatttactctgtagttttggaaatgacctgcttacaagataaccatgcctccccttatgttaaaaaactgccatatggataaagggcagttaagacctttacaactggtagaaaccaagtagaaaattcagtttgaaggaccaaattatgttgcagctgctctgaggaggagatttgttgccagagcatgagtgttttcataattgtttgtgatcagaaaattcagagctctgatttctgcattagccctaagtctgccctttggcaccttcatttagtgattggatcattcaaggctgagcctcaagggccagcatttctccagtaataatataaaatgggctgatgttgcaaccttaactcactctgctgaattgggcatgattaaagtctcaaggctgcattaatatggattttctatttctatgtacagccgtccattatctcactattttccagtttgccattttttgaaaacaaagatggaaaattctgctgatgaaattttttttttgtctgtcagcacaacagcattttttgggcttaagaatatgagaatagcaccgggcaaatgaatgcaaacattacagtttatgtggactctagcctgttgtcatgtcaatcttgttatttaggtaaatagtgtgcaatttttcaccaaatcagcagccaatatgctgcgagccatttttgttttagttacattattggctggtaacactattaatgagacaataattgggaaatagtagtcattgttctcataaaacacgatccttgtgttggaaccacagccaggcagaggagttgcatatgcagactgcaagggaggaaaggatgagtagccagtgttcccagcttttaaaatcatcagacccctgctgcttaaattgccccagctgttaatgctggaaccattacagtaatggactcagcaaatgaaggagaacgaagacacgcacactttattaccagaggggcaattttctcttcatatgtaatagcagcggtgcctcatattgatcagaccatcaagatactaatcctctgtaaaattactttttataactgaaaatgtgttaatccaaatcagtctgtgtcctgactgtctacttactattgaatacggactattagatgctttatttttcatgatttaaaggctttgccctgaaaatggttggcttttcccttgcaacactgagtgcttaatcttagctatagcccagggttgtctttttgttttaaacagaacatcacccacttaattaaggagtgagtgtctgtcttgctgagttatgctggtgttttatgttcctctggatttattaagcatcttgttttacattcagtctgcggtttgtgctgtaaataaaaataggcccatcttgcacatattagaaatttgcaggtagcaaatgtcaataagtaccagggatgtaaggttctttgatttatacttcaggcaccaggttgtggtttgtcgattgaacccataggcaggatgcatcttggtgtcttctgtggagcagatgtgtttttgcatcgttgtctgagaaagtttatgtttatttctgcatccttggttcagtagattgcttttcagacaatgaggcatatccgctccgcctcttatgtcttgtgagaaatgactacagctaaacattattatgagaagacccattaaaaactgatttctatcttcctgaatatttggaattttgggaactttgtaaaattcccatttttttcattataatctctttccacataccttatatgtttatttgtatatagactcaggtgccctcttggcagtatatttattctaatatgttgttatagctgaaagcatttgtgtgacattctctgtagagttcattcagaaatacttaattagtgtaccctttgtgtaccaggacttggattacaggctggagacttgaggaagtgtaagatataatctttgctattgaggacctcagtttaggaggaagacaggcatgtaaacaaataattataataatgcagtatagtaaatactagtctactgtgaatgtgtacttcttgggagcatgggcgcaatagtaaaatcagcctcattggttttttttgctgtgttatcaaaagcagaattctgacatccactttgagacttgtttctgaatgactcgtagctgtttgaaagaaatctcttccttcctcactggagacatgtttaccaccctagggggatagtcaaaggaaagttttccaaaaatgttttgatcaatgatcacatctttggatatgtatagagtttcccaaggaggctacttgaaaggagatagtgcttatgttgtttatgttctggcatttatgtataaatcagtcttattgctttagagtatagtttatgaggagaaactgtagcctgtggtggttaagaacgtggaatcctttagctctatttactggctgagtgatcttgggcaagtcacctattctccttgagcctcaatcttcatctgtaaaatggggatcataatagttgtgaagattaaatgatttaatatatgtaaagcatttagaatattgttggggtaagtgctatataaggttattattattatgcgtgtgactattaatgaaattatttttcatatgtagcttatgaaagtcagcttcgtaaatatagaaccacactgtatatataagtatatggtatgtgagatagagaagcatttcttaaatttcttaatgaaattttttttctgattacataataattttttattttagaaaaactaacaaatatggaaaaatatgaggcagaaaaaagtctcatactcttcagagataaatactgttactttatattagtgtattgcttagaatattgttattatgcttatatataatatatacagtatgactaattttaaatatatttatgatctatatttatataagatatattttaaacaaaaattagaaagataacttgcatattttttactctgcttttttttaccatccagtatattatatttttttcatataattccaattgtatagtattttatggatttttttccatcctatcataggttatcctttagtgaacattcttgtacataaatctctgcaaatctttggaatgtttcatagggtaaattaaaaggagaattgtatgggctaacttttgttaagatttttggttctcattgtcaagttgccacctggggaggtaatgccagtttccaatttaaagaagcaatatgtcagaatgcttattggtacatccactctaacactgggaattatcagaaaacaaaaatgtttgctgatttggaggagaagtaggaacttgtagaactaatttgtattttcctaattattatatttggttgaatttcctcccaccatttatattggccaaatatagttcttttgtgatttgtttattcatataggctttgttcattttgctaacgtgttcgtcttttcttactgatttggaaaaatattttgtagattagggatgttatttactaatcatgtgatagaaatatttttccagtttgtttattgcctgacttttatatttttgttattcaaaagttttcctttgtttttaattagaaaaacattttccctgtcagtattagattaacagtcatgcattcttctggttattaatattttatgtttttttcatgtaattgttaaaatgtgtctagaatttagttggtgttatggtatggagtagatgtggaaatttttcttccccaaggccaatcagatatcgctgcctgcatttattgacttatcttttacgtactgatttgaatgcttaaataatcagatctgctttttatcctgtttgtttttactttgacacatcattttaattgccatcgatttataatatctttctaaatttggcagcatgaggcccctataattagtctttactttcaaaaattctgtggctcatctcttgctttgagaagacaacctaaattttttcccaggtaaatttaaaaatcaccttttcaaggtcccccatgtgccccaccagtcttttggtattttaattgttattgcattaaatttatacattaatttggaaataactgaaatatttgtggtaaatcatttttctcattcaataattatctgtctctacatttatttaagttttatgatcttcagaaagctttgtaattttgttcaattgggcaccatttattactttatgtaaaatacgtgggtattttatatttttgattactattttttggttactattgaaaatgggatatttaaaaattgtgttttttaaatgatacttaagaaagttttttatgtgtttgctatttttgtatttggccacaatacagaatgcattcttatcattctaatagttttggatgattttcttgggttttctggatatttacgaggttgataatctacttatctgcaaatataatttgttttttcctctttcagtaattatactctcctctcctttttttttcttctattattaccttgtctagaacctccagttggtagtggttatagcagatagtcatgtcttcaacagttatacttcgggattctagtattaagtaaagtggtagttgttggcagttatctttgattcttactttgtttttttcagggactgaggttgaattttattgaattttaggaacattttttggacatctctttagatggtagtatctttacttctactgataaaatgtaatttattagactttctaataatggttccttgggataaagcctacttggttatattatataggtcttttaatatattgctgaattcaacattttagtatatttcaattaggaaagtaagatgggtcagtatcagggattcttatggaaaccgcagagtggtactccaggggttgagggtatatcagaatctttgaatggggcatatataacatacatgttgaacataattcaagctacagtttgtaaagcctaataaagcatttttggctgatggggataagatcacagtagaagaaggtaaagtgaataaaaatattgagaaactcctttttgtgctttcttttgtcaaatttggtatcgtattatgctagtatcataaaatgacttgcagagttttcctcctccctgtcttcttgggaaccatttacaaagcattaggattatttgcctgttggaagtttgaactttacttcttcttcttctttttcttcttcttcttttttttttttttttttttttgagcagagtcttgctgtgtcacccaggctcactgcagcctctgcctcccgggctcaaacagttctcctgcttcagccccccgagtagctgggattacaggcgtgcaccaccatgcctggctattgtctatttagttttcttcttgagtaaattttggtcattatatcttagaatgggagagttttacatttattgacatggcattgagcataacattctctggtttactagggtagaattgtgtatagttttataatttaaaaaattccatattcactttttccatcttcttttaaattataactttgtacattcttgtcttctctttaaaaattgactatatttgctggtagtctgttttttttttttttttttaaacaagctcttgaatttgtttatgctctaattcattaatttctacctttgtttttattgttttctttgtcctgcattgcctaagcttcttttggcaacatcttgagatgaatgcttacttattcatttttattcttttttgtttaatatggaaagtatttcaaaatcttaaaatagttttatctttttggtttctgtagcaatttgtgcatgtttttgtagcacttattcagtattctaatgatttttttcattttctttctcataccttagttatatagactatactttatttttctttgtaccccaatgtccgcagagtcttgaacacaataggtactgaactaatgtttcctaaatgaataccctgaattcccccattcccctttcactccacacaaatagtaagtagcctgctatagttagtggaagtttagctctccaactaccagtgcacatcactggtggttggagggctaaacttgtagtctcacattccaactaccagtgcacatcactagtagttggaaggctaaacttggagtttcacatatgccacttactacgtattaccttgtatgagtcctccaatctctgtgatgtttcatctgtaaaatggggataataactcccttccctgcttcatctgagatgtcatcaataagataataaatgtaaaagaactttgaatactaacaatgttatgtagatataaatatgatttaaaataggtttttagcattcttatctcatccaccacttctccccctccccaccatgtagaaattatcaagttcttaggaacagaaacttattttgaaatagacaatattgtacatattcatggagtacatagtgatgttttgatacatatcgtgtatagtgataagatcaggataattagcattttaatcatctcaaacatttattatttctttgtattaggaacacagaaacttaaaaagatatatatatatcttttatatatataaaatatatatatatcttttatatatatataaaagatatatatatatctgtgtcttccgaagtatctagcacagaactttgttgacagatatacagtaaatatttgttgactggatgttttctgagatgtacttttctttttctttttctttttttctttgagacagagtcctgggtcctgctctgtcacccaggctggagtacagtggcacagtcataacttactgcagcctcgacctcctaggctcaagcagtcctcccaccccaggctcctcagtagctgagactacaggtttgtgccaccaagcctggctaatttttgtacattttgtagagactgggtctcactatgttgctcaggctggtttcaaacccttgggctcaagctatctgcctgccttggtctcccaaagtcctaggattacaggtatgagccactgcacctggcctgagacctacttttcaaacatgaagtactaagtgatcctcaattggaccaagacttaggagccctgccccaatcacgttgcttctcccagtttactcggggtgacctagacagctacatcaacacacagtctggtgaaatgcacatgcgtaacttgaggatgtcaaccttttggcacagtctcatttcctctgcagaagagcggctagagacattatactctgttcccgaagtatatagactaataaaatagtggagttgatttagattgataacaaattataaaattgataaaaaatattttctatttttataccatttagaacagctattaatatttttaaaatttttttctcaattggatgaaaaataaatgtatgattattccttccctttcaattgcagttacattacattttcattgtttctcttgcactgagatttattttttatttttagtttattttgttcattgctatggaagggtgataattgtatcaagtaagtctcttttacttacctgagagttcccatgttctttggggaaataaatgtcatcatataagtcagtcttaggttaacaggttgttttaaaattgctaaccactatccaaatgcagagtgatagtattttctgggtaggtatttcatactctcttttcgaatattggtcaccgaaggatttcacaaaccactgacatttcagcattatgacagtgcaatgtgctcctgtcaccctctgaccccatattttttttaaaccattcatttcaatcggaaaaagtataattttttgaaaaaacagagatacttaccctttgcgctgcttttaaagattactgggagacttcatatctcagataattgatggtaaattctgcttggttgtttataagctcaaactttggagatctacaaaaagagtttcatctgagaaataaaaactattttaatgattgtatgatccaccagactgtgaggtcttttcttcagtccctcctctttcatgaagcgtttgaggattattccattcatctctttccttaccgactttatttcctgtgtcaaaaagtatgatactaacggtaagtttgtgtatggtacatttactggtgtatggtaccgtatgtggttgacgttaggtcatattaaattttacattttgagattgcttatacatagtagtgttttatacacagtaattctcttttccctatggggattataagatccctctggctgacaacactgctataaatttgttttttgtgtctagtaagatgctacaaatgtggttgactctcagcatttcttgtcaaatggaaacatgtatagattggaagttaagctttttgttttttgtttttttttactttactgaacagttatttaaccttaactcttaatctgctctccatcaccagtagaaaatattttgtttagaaaatgttttgtgtaggctaggtgtggtgactcacgcctgtagtcccagcactttgggaggacgaggcaggtggatcacaagatcatgagtttgagaccagcctggccaacatggtgaaaccccgtctctactaaagatacaaaaaattagccgggtgtggtggtgtgtgcttataataccagctactcgggaagctgaggcgggagaatcgcttgaacccgggaggcggaggttgtagtgagctgaggttgcaccactgcactccagcctggatgacagggtgagacgccacctcaaaaaaaaaaaaaaatgttttgtgtaaaaccatatgacagaatagatctgaggaaactgcatttgtagccataggagaaatcatagattttggtggctctttacctatcactgtgttttttaaaagagttatgtctgaaccacctatgtgtcccgattcattttgccatttcatctactgctcttcctcctgtttttatttaagactatgaagttactttagtgtaactgctgctgtcacctttgcccttagctaatcaaatagtttaccttgagggaagcatttatctcccactttcattattattatttttgtagctgtaaagatatatattttatgtctgcagaaggctgtaacagtgaaacgaggtattgatctgctgtatttagcaatttctttccaccttgccatcaatagcatgtcagcatctgtctgtaccgtggttgacctcacaaatagctctttatgctcccattggattcaaatgatatagtatgctgaaaactaaatcaatgaatgattataaagtttttagtattatttcatgacctggaggcaactggtactccttgcactgacagttcagtgtacaatgaatatggtaaaatgagtgtgtctggcctttgttctactgaaaggaggaaaacgggtcacctggttgggtcagctcatacttctaatgatctcaaagcacttaggcacttcagttaaacatctcactttacagaatcaggcagagagaagagcaagactcctatttaactttattccccatgcctcatcacaagtatgtagcaaatgtttctaaaattatttgagctataatcatataggcttttgccttcatttataaaagaaagacaaaaacccaaaactagatgctttgtcactgtcaccaaggacctaacgaaaaggcacatggtggaaggagggagagtggtaacctaggtttaggtctaaggggactcttgcttgctgtcagcacctggtacaaataccaagatagggtttttggggccacattttccatttgagggagttcctactcacctccactgatctgtggaacactgaaatagcaggagtcactaatttgcctgcttttggatgttgctgaattcagcatcgtcttgaaaagttcttgccgaatcatacattcagatgaaagatgttttagatattaaacttgacatttgggatatatggaaagatagaaccaggtgatggtgggtgaacagggaaagtagaacccagcagttgtcatcctgatcttttgaggatatgaatcaaatctatttatttctaagaaatgccatcctgatgtactcctttgtccatcagcccagtaggaagtttgacaaggagtattggggagttcacatactaattcattccccagacatttgttggatgaataatgtctgaaaaatagggtatcttggctgtattccttacagatgacgggttatctcctttccccagggtcacttaaggaagagtggatgatagtgatcagagcttaaaggtgttggtctacaccagtgctgccacgaagtcaggagtttgagaccagtctatagtgctggtgtagaccaacacctgtatataatgtttattttcaagttcatttgtaccactaaatactgtctctgatgggggccactagggctctatttgtgattagaaatcctattgttgagaattattactgtgtcctgggttagagagaatagatatgagggctagctcctcctcttgaatgttcatgggaaactgtcatgcttggctttagcaaatccagaatgtgtctacctgccttttttggccaattgccattattccccccagtaagatatttgaataggggaaataatgggtggattttatgaccatttcatgtctggtcagtttcttttcctacatgaaaggatgaagtggggactcttcatgtaaagccacagagtcggaagccccgaggaagaaattcagcttggtcctctgaatctgggattgagaacaacaaactgaggcaccataccctctatttcctgtagtataggaaattgctgataattaataattttagcattgaacttattcaagtccagtaaaattttcttaggatctgctcagggatctgcctctcctaaattcttgggttacttttgttattcattatggatatgtgactgattaatcagctaagctgtttttgaagtcattttaacttttgttctgtattatcctttaggaatatgagtaccattagtactttgtgatgtctacaggagtacttccttttcatttgtcctgtggtgtctgaaggagaactttcttttatctttcctgtattagttcacgttatactgtgaggtttgcaactcaggtctaaatacaggatttgggaaagatgttcctgtctctcaattcagtctttgtgattttatgtacatatatgcctgaatattagataaggaattttcccactcagattatgctgctggaaagagaagtcacttcatattcaaatctttctcaagtcttttgtattgtagaatgatcttcattgtgaacggcattatttggtcagctatccaaatagtatgtgagtgtgtacttatggcttggaatatttttctggatcaaaactatatgtagtaatctggatttatgcaccataatttctattttttgcctaagagtggaaggttgctacatgctcatatagtacttaaaataatttatgttttgctgtctgcagatatatattagaaactagctatattcttgttggtagagaatagggcaattagttgacctttgttcatataagctttgatagtgggatgtcttggctttgttccttgtagatgatgggttatttcctctccccaggctcacttaaggatgggtgggtggtagtgatcaggaattaaagagtgactagtgttgcctctggtgtagacccacacttttatataaaatcattttcaagttcaaacctctaaaggctgtgtctgatgagggccacttaaggctctgtttcttagaaatcctattgttgatgaaaaggctgtaagaagacctgtccaacttaattcttgatcctagctagtcacttaatgacaatcatgtggcctgtaaatgagataagacatttctttttactcaattaagataaagaagaaacctctttacaggttatatgttaatgcacacacatcttaatacaatcatgtatttctactacatagaaaagcaataagagcccgaacttagaattgtataaggaggtatttgtgtcatatactggactctgaatcatttgtggactacgattttataaacactctaaaaaaatataaaacgtgtcgatgaactactgtgtacctaaagttacattatttttcattaaataaaattctatatacacacactaatattcacagttctcataatagtatggttatattatgttgaaactcgtccttcttaaagattattttgttttgtagacatgtaggaactttcctagaaaatctgtatccagtttttttctgtgccattttgaattagaaactccctaaagaagaataaattaactttgcattttctttcatttttttaggatctgagaatgtgtatgtgtctgaggctacctctgtgtctaaaagcagagcatgcttaaaaccatggctgaggagttatgcttaacggtatactttgcatgcatttgtgatttgaaataggaaaaaaagtcaaatttgagacagcttgaatggcatgctgtcagtttggagcttcatgaattggcaatggtctcatttaggaccttcagatgtgtctctgcctggacagaatgagaacattttgcatgttcagaaggagacagccactccttgctgcttcacaataggcagtggtgcatgacagttgcccttcattgctggcttcttggagcttaacctctgaccctccacttagtcactgtgcagcagttggagcaggttggagatgttggtgaatgacaggcattggcctgcaacatgcttgtcattatttgactgtcaaaaggagcctgccattggtttccatcaaggtttgaaacctctgtgcagcagtccatattacttaacttccaaggctgtcaacaggatgatcaaatgtgcataaaaaaatcagagtgctgaatatatcttcaatcaggagaaagaagtttcccctcttcttttctttctttctttctctctttctctttttatttttcttttggctaaatatattcagatgactttcacagggccaagaggttgaatctgttgctccagtgagaaaagtgaactgttgtctcaagtggtctaagtttcaaatagcacaatttaaatctgagcagctctgctggctaaattctctgacttgtctggcatattctatcagctttcagctgttagtttaagggactagatgctagtccagtggtgcctggtgttagctcacaggataaaacgtttactttggtctctatgtagtgttgcaaagggatgcagacgtctgtgtatgtgactgcgaatgaaagggatgattttggatgtatgattactatctcatttaagactcttttttccacatggtagggttcaaactggaattttaagtgatctgatcaagtcttagaaacttaacaggtcagtcttatgcaatttattttttagacatagaaaaatatgacagcaaaagccattttttttcttgtaaatttgaaactttggtttgaaaagcatcttgaagtggaagaggatgaacctaacagtattctggaagtgtatggaaagtgttggtttgcttctaacattgtgcagtggatggtgtgggagtcacgagacctgagttttagttttgcttctgccattttccagcagtgtcactgtgtgtaagtcactgaaccccttagtctcagttcttcatatggaaaaatagagatactaatatggtgaggatggaaggaggtactgtttgtaaagtacttgcttttgttaagtactgtagtcactcagtaggcattccctgatctcctttttatccttttcttttacatccagtgttagcaggaaagacatcaaacagtagtaaggggccaggtacagtggttcatgcctgtaattccagtgctttggggggctgaggtgggaggatttgaggctggaagttctacaccagcctgggtaacatagtgagaccctgtctctacatgaaattaaaaaattagtcaggtgtggtggtgtgcacctgtagtcctagctacttgggaggctgaggcagggggatcccttgagcccaggagtttgaggttacagtgagctatgatcacgccattgcactccagcctgggcaacagtgctagaccctgtctcttaaaaaaaaaagtcagaagacaatacttgagctgaataaacattccagagcctgacacagtcaatcgttgtgttccaactcttttcttctcccatagttctgattcttgcttatgacatcacgttttagtcaagcactcaaactaccaatctgagtaggctgcctgccttccttttttctccttcccttccttccattcattcattcactcaacagatatttatagagctcctactatgtgccaggccctggtctaagttctaggatacagccatgaactagataggtatcatttggctatcattaggtatctggagagagagacaaaaaataaacaaacaaataatgactttttgatagttctaaatactattaaaaaattagtgtaagaggataaagagttattttggttggtcacagaagagctttcactgtagagttctttccagcagagaactgtttgaaggaaggagagggccctgggaagatggggacagtcttccagacaaaaggggaccatacttcttttttttttttttttgtcagggagtctcgctctgtcacccagactgaagtgcagtggtgtgatcttggcttatagcaacatctgcctcctgggttcaagtgattctcctgcctcagcctccaagtagctgggactacagatgcccaccatcatgactggtttttttttttgtatttttagtagagacagggtttcaccatgttggccaggctggtctcgaactcccgacctcaagtgatccgcccaccttggcctcccaaagtgctaggattacaggtgtgagccactgtgcctggccaggaggctgcacttctgtctcctgctcctcatccagttagtcacctttgtcctaatgtctttccttctttcatctcttcatcttcaggccactgctgtgttcagcccctttagatttccgtaggctcttggcctgtttccattccacccacttctaccttgccatcttaaaaaatgtaaaatgggccaggagccgtggctcatgcctgtaatcctagcactttgggaggccgaggtgggcagatcacaaggtcaggagatggagaccatcctggccaacatggtgaaaccctgtctgtattaaaatacaaaaaattagctgggcttggtggtgcgtgcctgtattctagctactcgggaggcagaggcaggcttgaacctgggaggtggagatctcgccactgcactccagcctgcgtgacagactgagactccgtatcggggggaaaaaaaaagtaaaatgaccgtgtcactccactgttcacaatttcgtggagatttgccactggctgcatgttaaaattcagactcctgggcttgctgtataggttcctgttttttcagccttatttattgtcagctggtaaccacgcccccaacccccagctttcacccccataatttataccttatactcctactgttggaaagtggtgacccctgaacatatgcctctgtccttttctctttctagactcttctcctcccttctcattggcacctagagaatgatgtatctttcaacaatgtccacaaatgccacctcttctgagacttctgtgattctgccatcctcaatgttgtgtacacttccttagctttcccctcactatagctgtttgtccattactttctcagtccctgagctctttgaaggcaagaactgcgcttttattcctctcttgtaattgcaatatctggctgagtgtctggcatacaacaagcactttataaactgtcacctgtgatagcctaatctttagaaatatttagggatagatttatcatggacttcaaatgtagatataatcagattggacagtatacattttgaagagctcttcagtcaaaatattccatgattgatagagagacttctttccttaggcctaatttaaataaatatcatattgaaaggagagtgatgcatgaaaacattagaaactaatagaaatattatatatactaacttcccaagaacaccaggatatagtgtcactgagcaagttagcttcagataaacttttatgttgctttttttttctataatccaacatgtgatgtatcttttttcaaagaagatagtattaaattttgtatttcaattcagtaagtaaatttcatattttttctatccatccatttatctctacatttttccaattatactgtatagcattgtcatgattttttttgtagttttcattattttagaaggcttttttttttgagacagggtctcactctccttgcctaggctgaagtgcagtggcacgatcatggctcactgcagcctcaacttcccaggctcaggtgatcctcccaacacagcctcgtgagtagctgggactacaggtgtgcaccaccatgcccggctaattttttgtatttttagtagagacttggtttcgctattattgcccaggttggtcttgaactcctgggctcaagcgatctgcctgccttggcctcccaaagtgcttggattacaggcatgagccaccgagcccagcctattagaagcaatttaatgccaaaccacagtagatttgtcatatgaatagaataatttatttaaatagtttcctctattgttgaccaattagcttgtttcatttattttatcagcataaataatgctgtgttgagtcagtgggtttaaacatttgtatgtgcatttttaaatgaataaattcctagaaacagaacaacggagttaaagatagggattttttaaggctcttgatgcatattgccaagttgccttatggaaaaggtgtccagatgtttgtagagataggttgtaaaaaggatcctgcattagaatgtgtttcttagattacttgtatgtgaatttgggatctaactgggaattttatatttgagaggacattggagagttcagtaatgggcataaagagaagaaagagatagaaggaaaggaagaacaaaatctagttttgaacttctcaaatggtgtgtaggctgtggtttagtgattttcagactgtgtcctggctacctatagggatctgcttctccaggtgggggcctgagaacagcttagcttctgttgatgtatttgtttatacttttggataaaagttccttcatattaatacttccaaatttgaaaagtttgaaagccacttggtaggtctctatgtttactactatcattttcagacacatgattcaaaagggaattatcttgttcatgcctctgttgtttgagatgtcagcctcctagttcattgttaccttctttttttaaaatttaatttaatttaatttaaattttttgacatggagtctcactctgtagcccaggctggagtgcggtggcatatcggctcactgcaacctccgcctgccgggttcaagtgattctcatgcctcagcctcccgagtagctgggactacaggactacaggcctgcgccaccacgcccaactaatgtttgtactttttttttttttttttgagacggagtctccctcttttgcccaggctggactgcagtggcactatctcggctcactgcaagctcctcctcctgggttcacgccattctcctgcctcagcctcccgagtagctgggactacaggctgtttgtactttttgtagagacagggtttcaccatgttggcccggctggtctcaaactcctaaccttagataaaccgcccacctcggcctcccaaagtgctgggattacaggcgtgagccaccgcgccccagccctcattgtggccttatttttttttttttttttttttttttgagacggagtctcgctctgtcgcccaggctggagtgcagtggtgcgatcccggctcactgcaagctctgcctccgggcttcatgccattctcctgcctcagcctcctgagtagctgggactacaggcgcccgccaccacgcccggctaatttctttttgtatttttagtagagacagggtttcaccatgttagccagcatggtctcgatctcctgacctcgtgatccacctgtgttggcctcccaaagtgctgggattacaagcatgagccaccatgcctggcccattgtggtcttcttaaaggaaccatgttgctaacccgaatgagagaggagtaacctcctgaattaggagttgttactgcactttacaaatatcctgttacctccttcacctctgtatggttaaggaaatgtggtatcaagtcactttccagttcctacttcagtgtgggaactgtgaagtatcttttaggcaaagtagaggttaaggcaccttaagggcaggaacttcttatcttgcttttattagcagtcgtgtcaacatgcactaaaatgtgatgacccactttcccttctgataaaaggagaatgacctgcttggcatggatggagagaggtgcctgaggcagattacattgttaccgctcataataacagtaggcataaaggaggggggtggtggaaaggccagcagatttctgtttacccatggaaatgtttgacgtttttggcttctgatgaaatgtgctaagaagagggggaaaaaggagcattgtagcaggggaaggaatgaatgagtaaggaaaagaaggaatctggcatcagggaaggaatgaatgagtaaggaaaaaagggaatctggtgtcatgtgagacatgtgaagccacgaagggccttaaatcccagccctgtagccatctattggcagagccttaagacctcaaaccatagagggagccccccttttctgtctttttaaatttaacctatatttgtttagagccaagatctctgacatggcttggctgacttttctaaagatgaactgaggccaggcacagtggctcacgcctgttatcccagcactttgggaggccgaggcgggaggatcacctgaggtcaggagttcgagactagcctgccaaacatggcgaaacccctgtctctactaaagatacgaaaaattagccaggtgtggtggtgggtgcctgtaatctcagctactcgggaggttgaggcatgagaatcacttgaacctgagaggcggaggttgcagtgagccgagatcgcacaactgcattccagcctgggtaacaagagcaaaactccgtctccaaaaaaagaaaaaataaaaaagaagaagaagatgagctgaatacagggcgacctgtacagttgataggctctgaggagatatcaacacggaaaattagggacgtaattacccactcctcaatgaaggaggattcttctcagttaagtttatttacttacttggctttgagaccagagtctgataactctgggaaaaagttgtagttattttgagatggtcgatataatttaaggcttttttaagagagtaattgtgtggtttaacctgtcatcttgaaatatgaattatacagagataacattaaaaaaggttatatgtgacatttctaggtgtctcagaaaaagatttgagtttgtctcatgtctaccatggcaacactcttgagttattataaagaacattatataaggatttcctctagaatttttaaatcttaaaatgtaacttactttagccagaataaaaagaggtttaaattaatggaaaactgactggaaggaagatataaaacaagaaacaataacacaacaaaacttcactaaagtacacaattctacaaattatgcacacaagcacacacattttacaaattgagggtatttgtagaaattcaactctcatttgaatcaactcatgacaaaacgtatttacaaagtaagtagaatggaaaagtaccaaaaaagcatttcttgggttaatggtattacccaggtcaaatccattaaggaaattctctgccagaccttttcttttttcttaagacatgaagttttgcacttgttagtataatttgggagtggtcaagaagctaggtgatagaacaacttcagattctggatttctggtctattatttggttttttttatgaataagagattcactcttttctttaaaggaagtaatttagattcctagcactgtcatttctgttctgaatgttataaactctctgtacaaaatttgaaaggaacagacatgctctgatgatgtacagaatcttaatgtttcaaaaacgatagttctcttcccctagaatagaaaagtatagcgttcacctgattgcagatcccaaatgtctacatctgtggttgggtggccaatatcacatgaaagagttttgtgcctttttgctcaatatataagtttgaaaaatgttggctgcaagtaacagaatttccatgtaacagtggattaaacagtaatgacatgacttttcccacatcataagctgtctggaaggaggaagttctcatggaacagtggcttaatgatacagtcaaatgcaggtactttccagttttctgctctgccattcttcagcacgttggctttttcgtcttttgacttgtaacctagtgatcactgggttataacagtgccaggtatcatgtcctcatgtaactgtgttcagggtaggaagaagaggatgggaagataaaagagagtttttatattaggagggaaatccttcctgtaagtcccctagcacactccttattatgtcctattggccagatctggatttgttggtcattcctagttgcaagggagactgggaaaagaagtgtctggcaaaagggaatgcgattcctacgcttggcttagagagctcatgatccattccttggaactgggctcatggctgcccctgttagcagggaagcagaatgaatagctgttgagtaggcagccaatggcttctgccatactcaattaatgtgtgactggaaatgagatttttatcttttgttccacactggccaagggatatggcctctgttaccatgtaatataaccctttgagacaaatacatttaagaccagaattggaactttgaattatccatccaatacatttaattagcactgacagtgttctaggttattgctagacacaggagatactgcagtgaataagatggacagtctctgaactcatagggttgatagtctagtaggactgagagattaggaagtagtttcagtagatatggggaaggcacagtttgctgtgcggtgaatgcaaatcagctaacatggactcggagagtcagggagggcctcttggaggaggctacatcctcgctgactccagagacacaggattcagctaatctcagaaaatgatgagttgatcaccctccttttttaggtattcttggaaatccaagcaaaaacaaatctgctcttaatgtggaaactgtggcaacttgagaattttatgtgcttcacggagtgagtaattccagcagcagctcaggaagcagcatagcagagtgtaaatggcattgtctttgaagcctagttggataagctttctgcctcaatctatctgtgtaaggaacagggtttctctgaaggtatctttgaaatactctaccatcagttcatatttctactttcacctaagtcaatattgaatcctctttggaaatcttggggtcatccttcctttctgtcaccttctatcttcagtcaccaagtctttctgtctgttagcagctctaaaatctgacccttccttctccttcttactgcctctgctttagtttcttactctataaaatggagataatatatcactgtgtagatgccataatacaaatagcaagctcttatggcactaataattttttaatacatgttaaccatatgaataggtcttattattattatgtccattttatggatggagaggttaagtaatgtgttcaaactgctccagctagcagctggtagagttgagggtttgaatataggctgaacatctggctcctgaatctgtcctctgcattgtactgagaaccctgtatcgtaccgaggtacgtcatctgtgttcttctgtactctcctattttgggctaaaccaggtcaaactcctatcttagtgtctttgaaatgctcaaacctgcacgttgtgcacatgtaccctaggacttaaagtataattaaaaaaaaaaaaaaagctccaccatcaatctgtagtttctgccctcacccaagtcaatatcgagttctctctggaaatctcggggtcatccttcctttctgtcacctatcttctgtcactcaccaagtctttcaatctgtcagcagatctgaaatctgacccctccttctcatttccactgcctctgcttaagtttagggtgtctcaaaatacctccttccagcacagttgcaatagtctcagaactaatgttcttgcctctatttttcccttctccccaacatcctctctttttgccaatttctgtttcacattgctgacaagtggtttttcttattatttaactctggtttgactttgattcaatgtaggtcttaaatgtatcccttttggctgtaggataaaaggccaagtgccacaggtttccagagcactatctgacgtaaccagcgtctcctcccagttctgacactttccatctccccgctaccagctccatctatttgctgtgtagtttgtcagggatgctgtcttccatactcattcccctcccccagatttatgtgggggaactcctttttaagatttagctctaaagtttctgcctctgcaaatccttcccttccattgtgcccatttatcacttcagcttctggtcactttgtacttggccattgcgttggtatacttggtgtctctttgatggtgagtccttggaaggcaggaaccctgtgtgcgcctgtttctgcagagcacagtgcagtttctgctaacagagggcctatcataatacttatggaagggttgattgatgtcctgagagtatgtttttaattttgcatggtggacacattttatatatttatctgtgggaaggagattcatgaataagtgtgtatatatctctatatacatacacacatatacaatcatgcattgcttaatgacaaggatacattctgagaaatgcattgttaggcagtttcatcatgtgaacgtcatagagtgcacttacacaaacctagatatggtatagcctattctctactgcatcagtacagttgctgtttcgtacagtaacttgctatacaagtaacttgctatacattactgtactgaatactgtaggcaattgtagcacaatggtaagtatttgtgtatctaaacatataaaaggtgcagtcaaaatacattattgtaatcttatggaagtactgttgtatatgcggtccgttgttgtctgaaataccattctgcaatgcaagactgtgcatatgtggatgtaagaaggatgctccttgtcacccagcagtaatatgagccatcacttattttgcctgtatagtgccctcttgggaaacatgtttattggctcccttagattaactttatgacgagagagtatgtacccttcactctactcctccccccagcctacccaattaaagatgactagtcttttaaaaatagcgttattgagatataacttacatcatataaatggaatcataccgtgtgtggtctttgtgactggcttcttccacttagcatgatgttttcaaggttcatctatgttgtagaatgtataagttctttctttcttttttttcttttttgagacaaggtttcgctctgtcacccaggttagaatgcagttgcacaatcgtagctttttttttttttttttgagatggagttttgctcttgttgcccaggctggagtgcaatggcgtgatctcagctcacagcaacctccgcctcctgggttcaagcgattctgcctcagccttccgggtagctgggattacaagcatgcgccaccacgcccagctaattttgtatttttagtagagacggggtttctccatgttggtcaggctggtctcgaactccccacctcaggtgatctgcccacctcagcttcccaaagtgttgggattacagacatgaatttcttttaactttttatagagatgaggtctggctatgttgcctaggctgttcttgaactcctggtgtcaggcagtcctccctcctcggcctcccaaagtgcacggattacaggcaatactttatttatttttatggctgaataatattccattatatggacacatcccacgttatctcattcattagttgatggacattgggttgtttccactttttggctattatgaaaaacgcttctataaacatttgtaaggaggtttttgtgtggccatatgttttcatttctcttgagcatatacctggaagtggaattgctgggtcatatggtaagtctatgtttggcagtttttgaggaactgccaaactgttttccagagtgacattcccactagaaatgtattagagttccattttctctacacccttgccaacacttgttattgtctatataacaccatgtcacattcccactggcagtgtattagagttccagtttctctacatctttgccaatacttgttattgcctatttaaaaaaaattttttttttgagatagggtctcactctgtcacccaggctggagtgcagtggcaagatcatgattcactggagcctcaacctccggggctcaagcagtctttccacctcagcctcctgagtagctgtaaccacaggtgtgcttttaaaaaattttttgtagagatagggtctccccatatgttgcccaaactggtctcaaactcctgggctcaagtgatcctccagcctcggctgcccaaactgctgggattacaagtgtgagccatcgcaatctggcccttgtctgtctttttaatctttctcatttgattcttataattctattagccaaagaaaaatattcttactattactatttatttatttatttatttgagacggagtctcgctctgtcgcccaggctggagtgcaatggcacgatgtcggctcactgcaagctctgcctcctgggttcacaccattctcctgcttcagcctccccagtagctgggactataggcgcccgccaccacacctggctgttttttttttttttttctatttttagtagagatggggttttaccgtgttagccaggatggtcttgatctcctgaccttgtgatccgcccgccttggcctcccaaagtgctgggattacaggtgtgagccactgtgcctggcctactattactttttagatgaaaaccccaaggcaacagacagattaaatgagatgcctcatatatgtgtgaatggaaagaaagaagtggtgtggataattcaaaaccacagattatccaaaagtaatttaaaagtttttgaatcaaacactaaagtatgtttgatgttggagatcatatttcccactcccacgttaaaagacaattagtatgattgtatcttttttgtctgtgtttttttttaatcattgaggtataattctcctaatataaaatgaaccattttaaagtgtttgaaatgattactctgaggatgcctattttttagtgattgtaatagttatattgtcttcaaaaatatttgcatgtacttaaaaacacttaaaaaatagaagcagtataaagtttgatctcccaaggagccatcatagatctatagagggaacaagaatagaagtaccacgaggcaaactggaagtcacttgttttaaagtaattaagataaccatgttgacttttatccatactttatgtatagccttttcaaaattagaaggctgtgtcttccttgttattctgacatgaatatttagcagtgccatctgtaaccctaggatcatatggtaaatgttaacaagaagcaccagaacttgtgttttccctgtcctattgtttttctacaagaatgctgacagctagagtggctttgtgacattgtgcccacaaagctgaatattacatgtgtagttacctgggtaggtgtagagtgtattttttttaaagagcaggacatagtgactggatgtcatcagttacatctgttttatcgtactaaaaattttacgtatattttgaaaacagttgcaaattagaattttctaacttgtatcttcatgttacgttcctgctaagtgaagaaaatattttctgaaaatatgaaacttgtaatgtgcatacaggattgaaaatgtgctgatagaatattttctggtttttcttgcctttctgctcagtgtgtcataatcttattttttgagggaaaacatgcacattttacagtaggttctccccatctgtttcaattcttcatcttgtaatgcttcctttcaaatagctacatgattaccttccagtttaggggcactgaaaatgttatctctggctcagttgacagtttttattgatgatctggtgggaaccaggtctgtggctttttcagcacatttcaatgtcccaataccacacaagaagcttttctctctcccctgcacaccccagatgaatacaactttactgtatattctaataataaaatacataaccataaattaagacaaggctgaaaggtttaaagaagaaagtaaaagtcaaccttaattttactttccaaacaacataatcactccggacattttggcctgtaacaggggtcagcaaactattgtctgtgggccacatctggcctgccacttgttttttaatcgaccttgagctgagaatggtatttacatttttgaatagttgaaaaacattaaagtaacagtaacattttgtcacatgagaaaattgatatgaaatttaaaattgtttccccaaataaagttttattgaaacatagccatgctcattcatttacatattatctagactgctttcatgctaaaatggcaggtttagtagttagttataggccttcaaagcctgacgtgttcattattactatctggacctttatagaaaaaaaatctgctgacccttggtctatacccttcaagactttttctgtgcatttgcgtgtgtgtgtttacattttgaaacaatgaggttattctatgtgcttttgtaatttaccctttttgctgaatagtgtttacaagtaacttctattgcattgtttgtttattccattggattataatctgtgaaccactctgttgctcttttatttgtattgtacaaacccattagatgttacctaggaacagtaataataatagtagtagtagtagtacttactatatgaattaaaattgattttaattgtttaatgaaataaaactttatttttttcacataatctgaatcatgacctaggtagtggtcaagctgcccaagaaggtcattgaggaaccaggatctttccagtgtcctcttctgccattctcagcatgcaatttcatagagagagggtgactaaactctgttattgttgtgtatcaagttaccacaagtcttagcaatctgaaacgacaaatattaattaccttacaatttctatgggtcatgagtccagatacagcttagctagttgtctctggctcagggtctcacaaagctgttggctgggaaatcgcttatttcaagacttgactggggtggaggggatctgattccaagctcactcatgtaggttttgggaagtgacagacccatactggctgttggctggagaatcaattccttgccacgtttctgtctccatagggcagctcacaacatgtttgttagtttctcccagagtatctggggagagtggggggtaggttacagactttttgtaacctactctgggaagtaatattccataacttctgcggtattctgtttgttagaagtgaatttctaggtccagcctatactgaaggggaggaattccaggagggtgggaatatcaggaggcagggattattgagggtcttcttggaggctgctttactatgtggtttcatttaaatgtggtgggtagaccttcaggcattggcctggcaggaagggtcaataccagcccttccagtttttcaattagaactatgccatatggccacccctagctgcaagaaagtctgggaaggcaagttttttttggtgacacattgttgcccaggtcaaaatcaggattttgttgataagaaaaatttcgataatagacactgggtggacaacagaaggtatctactatccctgccttctaaggtggttataaaggttcagtgaggcaatccagcactggtctggcttataatattcactcagttaaacaggagctatgattattgctgttacttaaaatcacataatatagctttgtaaattagcttgtgacaaaacaggatccctatgtgttgatactaaaagaagtagcataaaaggaagaaaaaaatacattgattgggtgcatagtatgtaccaggcattttatttacatgcagtatctgagttaatcttcatcataaacctaactgggtattgtttgccacactttatagataaagaaaagaaagcccaataagattaactaggttgttgaaggagcgctttccactagtgtgccttgagtgggttatagtttgtggagatattggttcctttagttcttggaatgggcagatggggacaggggtaactggagcccctggtctcttcatctctaactctgggcagcctcttctgattactccagtgtgccttaaaaaatataattttctgcacactccatgatgtggaaaaggttagagtgtataactctatccatgagtaagtgaatccaggtatgtataattccagctgcctgtctcctttccactgtcaggctctcaacaatctatagaagccttgaattttcgttagcctaaaatttgaaatgccccttcatttgctacaaaaatattatatttctacattttcttggattataaagtgatttaagttaacatgatttgaagcttcactgtggtcggaatgaaagcttgcttggccactaggtggctccttttggttctttctcccagtcgatggttgtggctttgtcctgtgccacctcttagaaggaacctaaattggacataaggaagcctagacaacaaggagatctgaaatgaatgggacatgcactctgatgattgcagttaccttttcatcctttactttccactcctgttcctcctgtgctcatacgctgatgtttaggtaacagatctagtccctggagcctcagatgagtctttgatatctctttctcacttataaaagtgggaaagtggggtaaagaacttttgtcctcatctagtatgttaggtaataaaataattgtaacatgtttgcagataattttaggcacaatttttaatacagcttattatcgtgggaatacttgtgttactacgcagataatgattgcactattaatattaatttccctattctttaatttaataatacaagctttaacttacatgtattatctcctataatcctcataggaaccctgcctagttaccatttttttccccctgattttagagatgaggcaattgaagcttagagagataggttaatttgctccaagtttaatagagtttggttgctttcagattttttcctctccgtttggaagttgttaattcattatagttgtgggcagagttttgacttaagtcaatatatttaaaattcctatgaaataattcagtagaaagtacttctggaaccatagtttggttgcaagtacagacatcattttctccagtcgtcttgtagaagtgagcagtagctggaagtgggctcccttcaggaaggctacaggctctttgcagaattacaaattgtatacactcagggatcacttcctttctcttgcctacaaatgcagcacccattatcatagaaactgcagggcatttgacagcttaggttcagactcggagctcatagaatggaacattcttcttcttcaattagagacacactaaaaagatgggaaggcacctaggcctagggttttctttgagactgctgactgatgtgttctcttttacccaaatttagattctgcattaatttccaaatttctctggttgccttgaaaaaataaatcggctcatgctaggttttctttagtcacgaataatttaactgtgcttagtatctctagttgactccccagttgtggtggtgatttctgcagaccataggaaaatgtataacaaatgtgagatgagagagccttgtcaggcagggggcacttactctgggaagtcagagctggcagtgggagcagtccccagcactaacaggtacacccacaagatctgcctcctacactgtcacttctacctctttgttccccttcctgactcacttcctgccagtgatttgtgacatatttcgtagctgatcaaatgagcccctgacacctgattgccgagtgcttcttgtttacagttgctttccaaggacacctagacaagatggaaagcttaacgtgaagtaattaaatttgcatctgctctgtgacaggactctaaggacttttcttccccccccccatatatgaatctcattgtagagctcctaccgtctttgaccatacaacatctaaaaaagggaggatgtggacaggtaaacaaacattggttcagtctactgcctgtcattatcatgataaatattaaataagatcactgatatccctttcttatttggctttctactctttacctacttgttttgccagattggtaactgattttcaacataagaactgtagcttggaggtgatttaaaaagatatttttaaaggaaagcaaatattgccaaacaatctggtttggtttaacaccctttggattgtacatttctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaacttggctacccactccacataccttctgcaattcttctgggaaacatgcagctctctctgtcccagctttttagccccagaacgttgctatgaaagagactctaacagaagaggaaataaaaatgacagaattcagctccactgtgattgcattggttcagttccttcattgtttcattcatataaagaaatgtttattgagcaccttaaaagcattgtatgtccacaaagataagatagatttttatgtgcaatgtcctcaaataaactagaaagtgtagggtgtataggagaggcataggatcccagaggaggatggtcagggtcttttgtcaaagtgatcagttaccattttctcatcatgttctcaggtatgcacttaaatgcatatttgccatttgtggtgttgggtgagggttccgttgctttggataaacctaagatttgactaatcttgaaactgcttaaaggataagccctataatgtgatcccagatatgactaagtggccgttgttcatttctgttgctctgaagtcaggaatgtggtatgacctggctttaccagcctgggcaatctaaggatggtgaacgtggatttatttatgcttgggtggttatatacttataccttagcaatcatactgcataatgtataaccctgaggtcagtgagtgcattcagccttggtgaggttgtttctggcagcctgtatccatttcagttttctctatgcaactcctaagttttcctctagaggagtgtaatcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacaggtaacttgagcaagacaaagacctttgttgcattaagtccctgagatttgggggtttatttattaccacagtgtagcctggaccattgtcactaatatagagggattagtacaggaatagctgtgtgcttgttattcaacatgatttagccagctttagagaatgtagtttcttttttttaaatcattttttattgtaaattgccaaatcatagttgtaaatattatgggatgcaaagtgatgttataatttatgaaaacaatgtggaataattaacatatatatcaggtcaaatacttaccattcctttgtggttagaacattttaaatgaactcttggtgattttgaaatatataatatgttattatttactatattcatcacactgcagtatatctaaagtagaaaaaacctcccaaacttactcctcctgtctaattgaggctttgtaccttttggccatcatctccccaatcttctaacactcctagccttgggtacccaccattctattctttgcttctttgagttcagttgtttttgattccacatgtaagtgagaatatgcagtatttgtccttctgtacctggcttatttcacttagcataatgttctctcattccatccaatgttgctgcaaatgacaaaatttctttctttttaaaggctgagtggtatttacgggctgtgtatatatgtcacattttctttgtccattcatctgttgatgaacactttggttgattccataagttgaatagtgcatagtgctgcagtgaacatgggagtgcagacatctctttgacataccaatttcaagtatcctgggtaaatatccagaagtgaaattgctggatcatatggtaattctattgttagtttttttgagaactccataattgctgtactgattcacattcccaccaacagattgcaggggttcccttttctcaacatcctcactaaaacttatttttatctctttgacagtagtccttctggctggtgtgaggggatatctcattgtggttttaatttgcatttctttaatgattagtaatgttgagcatttttttcatgtatctggtggccatttgtcttcttttgagaaatgtctattcaggtaccttccccattttttaactgggttattaaatttttaatgtagaggtatttgagtttagatattaatcagatgtatagcttataaatgttttctcccaatctgtaggttgtctcttcacttttttaattgtttcctttcttgtgcagaagctttttattttgatgtaatcccatttgtctattttgcttttgttgcctttgtttttaggggtcagatataaaaataattgctcagacgaatgtcctgtagtttatctactatgttgtcttctagtagttttgtagtttcaggtcttatgtttaagtctgtagtccatttgagttgattttagtatatggtgtgagataagggttcaattttattcttttgcatatggatatccagttttctcaacaccgtttattgaagtgactgtcctttccccaaagtatatacttggcacgtttgtcaaacccacatacatgcatgggttcatttctgggctctattctgttcattggttgatgagcccatttttcactagtaccatgctgttttaattactattgctttgtaatatggttggaaataaggtagtgtgatgcctccagctttgttctttttgtgcatgattatcttggatattcagggttttttcttgtgtgtgtggttccatatgaattttaggattatattttctatttgtatgaaaaatgacattggaatgttgatagggattgaattgaatgtgtagattgctttgggtagtatggacattttaacaatattaattcttctagtctatgacatgggatatcatttacttagttgtatcatcttcagtatctttcattaatgttttattgttttcagtgtataggtcttttacctccttggtattaaatttattcctaagtattattttttcacaactcactcttcatagaactattttttatagctattttatttatttatttatttagagacagagtctttctctgtcacccaggcaggagtgcagtgatgtgatcttggctcactgcagcttccacctcctaggttcaagcaattctcgtgcctcagcctcctgagtagctgggcctacaggtgtgcaccaccatgcctggctaattttttgtatatttagtacagacagggtatcgccatgttggccaggctggtcttgaactcctgacgtcaggtgatccacccaccttggctgggattacaggtgtgagccactgtgcctggcctgtagctattttattttattattttattttatttttttgaaacggattcttgctctgttgcccaggctggagtgcagtggtgcgatttcagcttactgcaacctccgtctcctgagttccagcaattctccagcctcagcctccccagtagctgggactacaggtacatgccaccgtgcccggccaacttttttgtatttttagtagagacgaggtttcaccatgtgggccaggctggtctcaaactcctgacctcaggtgatccacccgcctcggcttcccaaagtgctgggattacaggcatgagccaccgtgcccagccttgtagctattttaaatgggattgttttcttgatttcttttttatatagttcactgttagcatatagaaagactactgatttttgtgtgttgattttgtatcctgcagcttaattgtattcatttattagttctaacagtattttggtggaatttgtagggtttttaatatgtagtgtaagagcatatcatcagcaaacagcaatagttttacttcttcctttcctatttggatgctttttttctctttttcttgcctgattgctctggcaatactctaatactatattccacttctgtactgaatagaagtggcaagagtgggtatctttgtcttattctgaatcttggaggaaaagattttaattctttttttcttttttttttttttgagacgaagtcttcgctctgtggcccacgcgggagtgcagtggcgcaatctcgggtcactgcaagctccgcctcccgggttcatgccattctcctgcctcagcctcccgagtagctgggactacaggcgcccgccatcacgcccggccaatttttttgtatttttagtagagacggggtttcaccgtgttagccaggatggtctcgatctcctgacctcgtgatccgcccgcctcggcctcccaaagtgctgggatcacaagcgtgagccactgcgcccggccaagattttaattctttaccattgagtataatggtagctgtgggcttatgtatggcctttattgtgttgaggcacattccttttatacctaaggtattgagtgtttttatcatgagaggatattgaattctctcaaatgctttttctgcatctaatgagatgaccatctggtttttgtccttcatgtagaatgtaatttcaattgggaatcaaatggcagatctaatttaggggcagaaagagagtttgtttcatcagttatcaaagaatctgtgcaagaaataacattggtgaaaacagagtcatggaagtaaaagaataagtagtaagaagagacagagttgaattgaggctatcataactgatattaatgaattttaaattgcatttggcatgtttaattggtaagattatgaacctgtaatttttctctttgcttataacttatatcaaagtctggcccttgagctaagaatggcttttttctttttctttttcttttcttttcttttttttttgaggcagagtctcactctgtttcccaggctggagtgcagtggtgcgatcttggctcactgcaacctctgcctcccaggttcaagcaattctcctgcctcagcctcctgagtaactgggattacaggtgcacgccaccacacctggcgaattttttgtatttttagtagagatggggttttgccatgttggtcaggctgttctcaaactcctgacctcaggtcatctgccctccttggcctcccaaagtgctgggattacaggcatgagccactgtgctcggccaataatggcttttaaatttttaaaagattataaagaaaaacaaagaagaagaagaatatttaataggggccatatgtggcctgcaaagcctgaaatgttactagttagtcctttacagaagaagtttgctgaccttggtaagtttgcttaccatctctacaaactattatcaaaaaggatcacacttaaccaaaatgtgagttcctggagaattgggaactcattgcttttattaatctctgtgtctttcagtctagcatggtacatggcaacacagtagaagatcacagcaattttacttgattgaattgcacacagaacatgggcaatatggaagacagtttagaggatgaaaaccaaaaacaaattacgaaggttgtaggtctaaagaaatagaactgttcttcctctgtgcttgtgggtggtgacattcctggtttgtttaaacctaagtatggacgtttatttaattttcatattcatcttcaaataaaaggaaggttttaaaacagatgtgtccaatcttttggcttccctgggccacaatggaagaattgtcctgggccacacataaaatacactaacactggtcaggagtggtggctcacacctgtaatcccagcactttgggaggccaaggcgagagatcacttgagctcaggagttcgagaccagcccaggcaacatagtgagaccctctctctattaaaaaaaaatttaccatcctggctaacacggtgaaaccccgtctctactaaaaatacaaaaaattagccgggcgtggtggccggtgcctgtagtcccagctatttgggaggctgaggcaggagaatggcatgaacccgggaggcgaagcttgcagtgagctgagatcatgccactgcactccagcctgggctacagagcgagactccatctcaaaaaaaaaaatttaaaaagaatgaagtattggcacatgctacaccatggactaatgttgaaaacattattctaagtgaaagccagatatggaagactaatattatatggttccatttatataaaatgtctataacaggcaaatctatgaagatgggaagtaggtgagtgattgcccaggggtggggtgagaatcaggagtgagggctgatcggtgcaggggtttctttttggagtgataacaaagttctaaacttagaatatggtgattgttgaacaactctgtggatatactaaaaaccattgaatcatatactataagttggtgaattttatgttacgtgaattacatctcaaagatactaacaaaaataatgatgcagtggattgcctatttcctagtgatgttgctggttatttttctctctgattcaagctgcagtcaggatttgaatcgcttacattttaccttcttgaagtaagatcttctaaaaacaaaattgacttatagtcaaatcctctttgacccagctatgttctacttacatgaatttgctccattttttgtactggcacatgggcacaaagacatatgtataagaatattcattgtggcattatttgtagtggcagaacacgagcaatctaagtatccatcagtagggaacagtttaaatacattaagggagatgaagctagtgaagatgaaactgtcttcaagacaattaaaagaacaaggtgtagaatactgttactatttgtgtaaaatgcttgcatatagacagaatatgttgtaaagattcaacagtggctacctctttgggaggcaaagattgggctgatctagtaataggagagggacagcctattgcagggttgcactttaaaaaaaaattatactttcttttcatggaagcattattcataattaaaaagtggaaccaatgcaaatgtccaccagctgatgaatggataaaccaaatatggtatagccatccagtcacgtaagtagggtcaaaggggatttgaatataaatcaatttcattttgaggaaatcttaattcaaaagggtagtgttcaaatattatctttaaaattaaaaaagttgactcctagactatatctcagcaatcaatcttgcatatctttttgcatacttcttttcaatccatatggaataatttgtcttaagactcatcccttcaattcaccctccaaccactaatgatgcagcaattatgtggttccactgtaattttaacactgtcttctaacccagctgtgtggcagcagtgtatctgcagggcaagaatgtggcttgcaagggtcaatatcacactgcccacaattattttaatgtctcctctgaaatgataaatgaactttatagttataataaaaagtaaacccattccccctaaggtataaagggtgtacaatttacatagtcagatatgactgcctttttttttttttttaaagaatccttcgttgagggctttaaaaaaaaacagggttagggataggaataggtggctcatgcctgtagttccagcactttgggaggctgaggcaagtggatcacttgagcccaggagtttgagaccagcctgggcaacatggtgaaaccttgtctctacaaaatatttgctgtgcatgatggcgtgcacatgtagtcccagctactcaggaggctgaggtgggaggatcacctgagcctagggagttgaggttgcagtgagccgtgatcgcatcactgcattccagcatgggcaacagagagagaccctgtctcaaaaaaaaaaaaaaaacaaaacaaaacaaaatgcaaaaccagaaaaaccagggatgggttttcagtgtgggcatttatttgatccagcccaataaacatgattaaaatatgaaaatgttataggatttatagctgctcctctaggaacttacactttttttttttttgctgttgttggcataattggaagaaattcttccaagttttgcatctgcattgcttgtcttataacactaacttcatgtaacttacaaaatatttgctggaagttttcctggccctaggaggacccataatttataactcctgctttttattatttggtgccacttgtggctcgtgtccttcctaattattgcaaatcctctagcctgcccccacattcactcagtaagactgccaccttgagacatgagctgttggtgtttgcagtatttaacatagcatctactaccatcatttagctatctctgacaaagagctcattgggccctcttgcaccatttcctcagctgggaagtgtgggattgtagaagctgcttcccttctccccacatctgaagctttgtcctatcacatgaagctaggatttccacgctttctttctagctgcaggagaactggctgctcaggggtgctgcgttttctaccttctgacccacagccagaggcagctcccactgcactttttcatttgcattagatggcactttgctttatacaattgacgtctccatttaatttttatatcttgcctgtatcgttagagaacggggtttggaggtgttcatgacttatagaagccccacagttagcccttttatgatccctcttttagctaggccctatttacaaattttgtaaatttagatggcttcttattaaatgatgtaaacccatccatttgtactgttaaagctgtcatgaatggtatggcatttttgagtcaggccgtcctatagcacagctgaagcacactgaggcccagagagtttattggcttcttcaagattacaaagctacttaattacagagctgaatttggaatttagaattccaggtccagaactttttccataaactgaactgaagtaaaagctccaggctgggcgcggtggctcacgcctgtaatcccagcactttgggaggctaaggtgggtggattacttgagcttaggagttcaagatcagtctggccaacctggcgaaaccccatctctactaaaaatgcaaaaattggccgggcacggtggcggatgcctataatcccagctattcgggaggctgagtcaggagaatcacttgaacccggaaggtggcagttgcagtgagctgagatcgcaccactgcactccagcctggatgacagagcgagacttcgtctcaaaaaaaaaagctccatgataccttgaatttaagggaaaattaatggtgagttaggaaaggcatgatacacaatgcaccaaacaacactccatgaaaatacctcaacaacgaagtactttggaaagagatgacgctgaggtatttaaaattttatttactttcatgattatccaagaagtaacaaatctttttttagattatttctgatagtctttacatgttcttccaggtacttctgtagcaacttaacagatcgtatgacaatatgctgatagtgattcttccttttgataacggtattagagaagacagacagtgctaggacaactgtacaaacaccatttctcatcgctataggcaagccagaagccacatgtttcctagggaaaagggctgacctgttaccattgctagttgtgtgtaaaacatgtgttagaagaagtaattatgtttagctgactgactatgaccaagattaatagctcttgaaagggctgtaatgaaaggctgccccaactggcttccacattattctttatttatcccgctctcatccctgtcacctttgggcaccagccaaatgtcatttatgtgagatttgccccttggatgtgaaaggcctctctttcttaatgatgggaggcgattgggctgcagggctggagagcttggacggttgacatgacccagaggagatgctccaggtctgtgggagtcagaggcctaggactctccctcctgagggagaaagaacatgaggatattcagctgtctgatcccgtccattgaggtgtacttgagggattacagggagtacttcaaacactctgttgtcaagtccatatatttcggtggctcttcagtttggagcacttggaagtttcttattttgaagaccatttgtttgaatgaaatcatcaatcatttctagtttcgtaaaacttggaagtctccttgtggtagagactgcacagatcccttcttgcttctttgagtcatggacttttcaggctggactgctgcccaaaatgcagattgcatttccccagcctcccctgcaacggggtgtggccatgtgactgagagaaggtgtactatgggagtctctgaggtgtttctttaagagaaagctggtgtatgccctttgccctttgcttcttaggcccttgcttctgtcccgctgcctggaatgtacatgctggacttggatcttgaaggtgaagcccaagccttatgggctaaaaggggccgggcctctgagaacttcaggagaaccactgtcccagcctggttaagccactgttattttggattttttgtcacttgtaggcaaatctaaacttagataatacactgtttctacacttgcagaagatgaaaacgccaaacccttggattgccttttcccttcctaagtattaatatcaaaacttaaacaggttcctttccccttctttcaactcctctaaattaaaacaacctacaaaaagatcatgcagtaatttatttaaaaactaaagacatgagagagatctcagtaagagagatatatgagagggagattaacaagaaggctagaaaggaaaataacacatttaggaaaatgataacgaggactggtcttcatggccttctgtaataggtcagggagctctcactcccttccagtgttggtggcagcaacagcttcttttcttagattattagaggccctagggattcgatttcacctgctttgttaaggccataggaagctttttaaaatttcagatttcaaatgtcaagtctctattcagtgcttttgggccccttgcatcagagtgtttatattttgcctgactctttggtttccggccataaagtttgcatgttgtcatcttttctctaacattatgtgtattagataacatgtactacaatagctatagtgggttacaaaagattcttaacacaacccttttaaaagagttgcagagatgcgtaattatttttcatgattttcaaaacttttgaaagagaaaagcagctgtttggttcactgttctcattagcatttatatagtaaactaagagagaggttttctgtgcagtgtttttccttgctgtttcttgccttttaatttgaagaatagcaggatcttgtcttttgttcacatgagtagaagtccattcagctggaaaaagaacagtgcactctttgtgtactcagagcatttgaatgcttttggtcacacactagttgctgtttaactacaataaaattgtgaccaaaggagataaacatttaaaggataaatgacaggcctgttaatctgaaagcaagttttgtagcgttgttgtttttagctaataggtgtatagccaggagtcacggtgatgacttttaaatctgaaactgagtgaagtctgtgttttcaaccagtttaaaaaatgttgccactggacctttttaaaaaaatatttttaaaaatacgacaaaaattttatgtatttatggtatatactatgatattttgacatgtatacattgtagaatggctagatcaacctaattaacatatgcattatctcacatacttttttgtggtgagaacacttaaaatctactttcttagcaattttcaagtatataatacattgttattaactgtagtcaccatgttgtacaagagatctcttgaacatcactgaacatatttatggctgatcattttgtgttttaacaatcatttgaacatgtctaaactgtctttagaaactggtagggatttccttgctgtgtttgctaagcttggccatgtcatccacataaatatctgaatatattcatatatgaatacatactgtatataatatgtgtgtatatatgaatacataatacctatatttatatataatatgtgtgtatatatgaatacataatacctatatttatatatataatatgtgcatatataaaatgcccaagtatattatctaagaaaagagccactggggcttttataagtctatgatttcagaactatgtccatctttacacctctaaagcgttatgatttacctgatttggtggaggaaaggtatttttggtaattttctgtccctatgggaattcaaaggataaatttcaatctctttttctttctttctctctctgtccatcttatgcagctgaaaactggcatatgactctttgagaagagctcaaacagttgtggtaagggtgcttagatgttgagtgctatctgttttctggggtgtgaaacatacagggttttaccagtctgttgttgcagagtgctgggtgtattttgctttagctgactgttccgttggagtattcagcctttctttaggataacaaaaaataaaattaatcaaaggcataatcaaggacgttttccttttgtacagtcacatctcattatacaacattagtcttaagctttgcccacctgccagataggtgtaagatgattaatgaaagctgaaactctcagtctagaggagacagcagggactggtggtgctagtggtgaagtaagaagtacatatgctgcctaaagggactctggttcagtgtgtgaatgtcagcccagtgttgcaaatattctgacttttcaaaagaagcaggacatctagatttttatttgaaatctctttattttaataagccatcgactaattgaaatttaaaacctgtgtagtccaaatagaccatatctacaggctggaaggaatagagggcctgccttttgtgacctctgttgtttggggaggttatgtaaccattgtaaccagggaaggatacatgaggattcctcttcagggaagctgaccagcccaataaaaaatatataggttgacatttggagatatcttaaaagacggccaggtttccatcatatcgctctgtagtgaggcccaccagttgacaaactaagcttctgcacattcagcttctgatctgtttcatattccctcactggaaattatgaactgatgggcaaagatcattgaacatccaggaatgcctcaaataggaatgacaaaatacagagcacagaaacagaagaaaaggaacccagaggaacaggaaaatgtggagagcagaaaacaatttcaaaacaaattataattaatattcccagagagatgagagaaaatacacgaaacaggaacaagatgctaataaaaaggaaccttcacactgttaattttgttagttgtgataatgtattgttatacatttttaaaaatcttatacatttaaaaaaaagttgtccttagttattagagatttatgctaaataattacaatttgaatattgtgatgtctgggatgtgatttgaaataattcagaaaaaaggatagagtcgtgtgggagatagataaaatgagattggcaaaatgttggtaattgttgaagcatgctgcgtaatgggcgcataggggttcattatattattatttgtacttttgtgtgtttgaaattttccattatacaaccttaaagaaaggatcatttagaaagcaagaaagagcttgcaaattgaaaatatgatagcagaaattaaattttcaacagaagtattagaaaatacagttgaagacatttgtccagaaattagcccaaaacaaagcaatggaaaataagaaaggaaaaatatgaaattagaggatcagtccaggtggtccagtatttaactctgggagttacagaatgagaaccaaaatatcagaaggaaagagattatcaaagaaataatacaggctgggcacagtggctcatgcctgtaatcccagcactttgggaggcccaggcaggaggatcagctgaggtcaagagttcgagaccagcctggccaacatggcaaaaccccatctctattaaaagtacaaaaattagctgggcatggtggtgggcacctgtaatcccagctgcttgggaggctgaggcaggagaatcacttgaacccaggaggtggaggctgcagtgagccgagatcgtgccactgcactccagcctgggtgaccgaaaaagactccttctcaaaaaaaaaaaaaaaaaaaaaaagaaaaaagaaataatacagggtcatttccttgacctaaaagacatgagtttccagatcaaaagagcccagtgaccgcccagcacaacagatgaaaaatgatcccactatggcattttatcatgaaatttcctaaccccagaggaaaagagaagattctaagagctctcatttgcatcctgagctggtctaggatccagggtttccttgggccaatgcttcagatagttaaactcatcttttgcttggtcagggatgtggtggttgcctggctgttgggattgagagaaagaatctagggtctaacctctgctcttgacttccaactagtcttcctgttttcagcttcatggttgaaatgcaccttccttcagaagttcctggttattgtattcctgagcctttctgtagatggtggcatgggagctcacttcttattggtcttccccttttctccctcaatcctgtctaccagttagtcttcagctttggtgtgtgtgtgtgtgtgtgtgtgtgtgtgtgtgtgtgtgtgtgtgtgtgtgtgtgttttttggagacagggtctcactttgtcacccaggctggtgcagtggtgcgatcttgggtcactgcagccttgacctctgaggttcaaaatcctcctgcctcagcctcccaaatagctgggactacaggtatgtaccaccatgcccagctgatttttgtattttttgtagggatggggttttgccatgttgcccaggttggtctcaaactcctggactcaagccgtctgcccgcactggcctcccaaagtactgggattacaggcgtgagccaccacacctggctttaggattcaggttttgctgttacattacttgccattcctttttcatcttttaacatctctcatctgcttgctttcttttttttttttttttttttcctgagactgagtctggctctgttgcccagactggagtgtagtggcatgatctcagctcactgcaacctccgcctcccaggttcaagcgattctcctgcctcagcctcccaaatagctaggattacaggtatgcaccgctatgcccagctagtttttgtatttttagtagagacagggtttcaccatgttggccaggctggtctgaaactcctgacctcaagtgatccacctgccttggcctcccaaagtgctgggattacaggcgtgagccactgcgcctcatctgctcttatctttcacattgactttgacgatttatttttattgttgttattgttgtctccttttcttttttcttttcttttctttcctttctttccctttccctttccttctcccttcctccctccctcccttcctttcttccttcctcggttccttttcttccttttctttcttttctttttttctggagacagggtcttgctctgttgcccagtctggtgtgcagtggcacaatcatagctcactgcagcataaaactcctgggctgaagggatcctcctgcctcagcttcccaagtaactgggacatcaggcgcacaccaccacacccagctcattttttttttttcagttttgtagagatggcaccttattatgtttcccaggcttgtttccaactcctgggctcaagagattctcccaccttggcctcccaaagtgctgggattgcaggtgtgaaccactgcacccagtatattgttttaatttctttacaggcgttccagtgaggttttgggaaggagccaagtgcatgttttgaatccaccatgttagaatggaagttaatttgttgtgttaatcattaatttgtatgtcagagtttcttttcctgaggtttatttgaaaatcaacgtaagaaaacaaaatttaatatggagaaaataatttcctccttcttaaagtctcctttgactatcctcacggaaattggtttgtttctactttctctgaaatactgtggccctgggagactcctgctcagtttagcaaagaattctctactgttttgggtcttaatctaagcactggatgtgtgcttttcacccaactagattatggagtctctgtgaacctagggagatatcttagtctgctcattgattaccttacggctccttatggatatgaattgaataaatactttgctgatcaaagtatactactcaaatttgtattactttatttttatatgtgttatatgtgattcttttaatgccttctcagcctgttgctcagagattagtgggaaggaataaatgtaacaagtagactttgggggtaatactgataagttaaaaatgtcattggtttatagcttcaagggtattttactgaaattgcaaatgttctattatatttagaaagagaaggaatggaaacctgactagtcattatactgaggttgggaaatctggaacttgagttctgaatcagttttctgtagatagcctgtttcacagtggatttgcttaatgttttaccggtaaacaggcactcctgtttattttcagctcttgcctttcagcacaggatagctacaattgttcagagtatgcctctcttgtataaataacaatactgtcattttctctaaagtcatcctttttattaaagaaaccctttaatagtcccacatattctgtagttatgcatttctgtgagtgcttactgaccccagcacagtgtttaataaattattgaactttgaagaacctttgagaagcaagggctttatgtgactgagcagcagacatgaaaaaacgttatcctccagagtatctaacagacagaaatagaggcttgatcagacaatataagcaccgagtgaatgatggtaataccatgaaatatttacacccatagagcatgcgagggtggggaggagagtgtgggtttttatccttttgggttgaacctgatgccatacaactcaccactctatgatcttaaaagcaaaacagaaagagaatgagagaaagaaaggaagaaaggaaaaggaaaataaagaaatgatgaatattgatttggtgatattttgttgtttgcattatcttatcacaaaagcaaggctccttttgtagacaggaaccttactaagagtcaagttttaatcagtccttaacagaaactgaagatatctgaagtgatttcttgccactacaagtttaaagttttaatttaatcaatatctcatgatttaccatgcctcaaaagctgtcattttattatctgtaataaatagagatttgaagagtaaagaactgaatatagcctgatacgatcttacttttaaacagaagatgcaatttatttattttttcatgggatgctattttaaagtgacttgtgatttctttaataatgatccacagagaaaattaacataaaggaagaagtgtctaattatttaggaaaggtttggaagatgtttatcccggctaatatagatagagagtgtctaatatcttacagcatagaaaggggctaaaacaaatgtgccaaccaatttgttttgcccctgtgcccagtattttatatatccatttttttaaataaggatgaaccttttaagatttcatggtgtcatctaacattattaaaagtaattattgttgatgataaataaaggttgacaatgatgtgctttattgaatttaattttactcgtggtttattttaaaaacccgcagattgtgtttgggagatattttaatgtagtatgtctgttttttgctttctagttgtggaagaaagaatcaaattatgtattaataaggaggctcagattgaccatagacattggcctttcaaggggatcatctggttttagaggctttagtctcctttgagtaccctggatgtttgctatgtattatgctaaactaacgcatgattacattgaccctatgattatagtgacctaaattggcaagtttctgtcacttataaagtcaaggtagtaatgttggaagggaaactgtagtgagactctcctttgcaactgtaatgttttgtctgtagattgcaaatgagggaattttataaaggctttattatttgtaatgtaggaacccattgcatacaaagaaatttttagtctaaggacccagtattagtgaaatgtgacatagatctatttgtgaaagggtgtacccagttgaaacagcaggggcaagattttatttgtatgtttattatttttgttaccaaagcgatgccctggaaagaatcgggatttttgagtgagtgatgtgatgtggatttaaatcctgtctttgccacttagttctttcacttccagcaagtcctgaacctaagactcaattttttctctcaaaatggggctcatgatgatttacttcgcagatttgttaaagcttgtaagcattcagcacggcacccagagtgtgggaggcactcaatgaatattagctcctttctccttccttttcagctaaaccaaaaaggctttatctaggaggtgagacttgtagaaactcttgattgatggaaggaatgagtcagtgaactagaagaagggtattcgaggcctgtggataaccatgtgagaaggtgagaagtgagtgtgtagtgatgggagagtgtggctggacagatggacagataaagaaaagagggtgtggctgggcgcggtggctcatgcctgtaatcccagcactttgggaggccgaggcgggcggatcactaggtcaggagatcaaaaccatcctggctaacatggtgaaaccccatctctactaaaaatacaaaaaaaaaaaaaaaagaaaagaggggctgaattaactgacttgtagaggcaaatgtgatattggtgttgggacacatcatctgaacttccactgtcattatctgcttctcaaaattggagttgagagcatgtgcgaacttgagaatttattcttcttgtctacttgaacatctctcttttaaaaaatgcaaaatgttagaaatgtttgatccaatatagggcaaataaaaattggtctgttctttttttttaaatttttttttgagacacagtttcactgtagcccaggctggagtacagtggcatgatcttggttcactgcaacctctgcctccagggttcaagcaattcttgtgcctcagcctcccgaatagctgggattacaggcgcatgtcaccatgcctggctaatttttgtatttttagtagagacagggtttcaccatgttggccaggctggtctcgatttcctgacctcaaatgatctgcccgcttcggcctcccaaagtgctgggattacaggcatgagccaccatgcccaacctgtctgttgttaaattctacctctgatcgtaatacttcgatggagaatacattgctattacttttagcatgatgggtaccaatatgagatttccagttgcttcccgcatgttcattttgcagattttaactgaggcttatatatgctcagggctgtactgtactctggggattcagtagtaacagacgagagtccctcttctcatggagattaatattctattagaggaagaatgctagtaaataagtaaacagtggctgggcatggtggctcatgcctgtaatcctagcactttggaaggccaaggcaggtggatcacctgaggtcaggagttcgagaccagcctgggcaatatggtgaaacccggtctactaaaaatacaaaaattagctgggggtggtggcaggtgcctgtaatcccagctactcgggaggctgaagcaggagaatcgcttgatcctgggaggcagaggttgcagtgagccgagagatcacgccattgcactccagcctgggcaacaagagcgaaactccgtctcaaaaaaaaaaaaaaagaaagtaaacatatttaaggtcgtaaataaggccatgtctaatagtgataaacagtatgttgtgttaatgactgaggggaggggactgctttagatacagtggtctgaggtcacctttgatgtgaactccaaaggatgacaagggcatacatttcagcctcagagacaaagctctgaggtgctaaagagcttagcatgtagaaggaacagaggtggtcagtggccagaacttaaagagaaggaaacgaaagggcaaaggaatgaggccagatcatgagggtagggactttagactgcggtagatttcgattttattccaagtcccattggaaatcactggagtgttttaaggtagggagcgtgtgtgtggagtgacttactctgatttgatttctataaagatcactgtggctctgcgtgaggaatattggaaggccagagtagaattagggagaaatattgggaaaggaatgttctgatggcttggcccagttggtgactgtgcagatagactgaaggggaaggatttaagatacattttgtaggcaaagctgccaggatttacttttagacagcataagaagtttgaaagaaaagaacaatcaaggaaaatttccaggcttttagcttgagtaactagattggttttgtttgcttgttgtttctttttggagatggggtctcactctgttgcccaggccggagtgcagtggcgcgatcgtggctcactgcagccttgacctcccaggcttcagcgatcctctcaccttagtctcctgagtagctgtgactacaggcgtacatcactactcctggctaattttttcgttatccgtgaagatgcctcactgcattgcccaggctggtctccaactcctgggctcaagtgatttacccatttcagtgctccaaagtgctgggattacaggtgtgagcctctgccctggcctgagcaactagattgtgaccatttactgagataagaaaactgaggacgaagcaggtctggggtgaatcaggtgctatccctttggacagtcacatgactggtgtctgttcagcacccaagggaccatcaaagaggctgttgtggagagggaatccgaaggtcagggccagagatagaaatctggggagtcatccactatataggtgatgggttaaagccttagaactcttcttttcatgaatcattgttgttctttaggttgtaatgaagttttaggcctcagcttccctgaactggagtgtttttccttcaccttttccggtctctgggttgcatcgccagactgtctctaagcccaacaaacgcgttccttccaggcaaaagcaggagatgacacacaccatgagccagattttccatggcagacttgtaaggaacaagataatctcattgttcctcctgctacttaaaataaaggtaatattgattttatagtagcagttcaggtcctaaggcatgatattgattaagtgtctgatgagaatttgtagggtagtctcccagacctgcagctacagggcatctccccactgggccaggcctctgtgctgacctccactgttataagtggtgtttttcttaggaatccttagccctgtttagtctacgcactgtccagaagcatttatttaacctgatggatggctcaatccaacccatcaccttaatctgaccttaaagatgggaacctaatgtttttgttcttagtaaatgtgaagactaattttgacactgtttagaattattttcttattagtagcagtagatttcatgaattttctgctgtgaaatttcctattaaaatactataatctaatgttaaatgacgagttaatgggtgcagcacaccagcatggcacatgtatacatatgtaactaacctgcacgttgtgcacatgtaccctaaaacttaaagtataataaaaaaaataaaaaataaataaaatactataatctgacttttttatttttacttttttactttggagcctggctttatgaattttttttttaaacaggggaaggtacctcttttcaaggtgtcattattaagcccatgggactcttcaattttaatgttatatcaaagagagtaaatttcttgtgattattgtgatatgatgcattcaacttgcaggtcaggttttatatcatttatagatcagattctgaagatatcttcagtcaaatttaataacaatcaaggaatatattattcaccggcctgaagtatagaaagagttcccagaaatcatctaaaaataactgtttcatataaaacattttgactttctattgtaataagattaatatatttttctcccatgtctaattctggctggattgttcatggggttgatgtgaggattcagtgagttaatataggctaaggtgcataatataatgcctgacacatagtagatgctcaatttatgttaactactgttagctgctttagcctgttgttaactgcaaactccttttacattacctagcacaggcctgggcacaagtatgatatttaagtagatgcttagtgactgattgatgtctccaaacatttgggatttccttccacatttgccatagcacagcttgttttatgtcttttctaaaatggtctaggtacctgacatcctttgatccttcatatggttacactcaaaaggagccatatgaattttgaccatttgcacatctgcctgtctttttggttagctgccagatagagctcaggttttaaatcctttgcagttaaaagagataataaatgttaacattcctagtacagtgcctggcacagaatgtgtaaatatcatttgattcggaaacatgactgctggtcaattcggcctccagggagacaaaactaaggggtggggttgtggctttttttgaggtaggggatggaatagatatttcttacccgagtagaagatgatgccgggggatctaatgcttcttttaaatttcccttttgatgcacaaaggggcaactccgtgtagcaggaccttggtgggatggataggcagctttgtaagtggagaaatggcctctgtttagcttatgagcacagagtcattttgggggtggtttatgagtcatctgaaatatgcatttaatctagatttgtggcctgcttggtgaggctgctgcttttttatgatctcaagtgtcttgtccatgtcaaaacttgccttgtttttttgtttactttgaatcagaaaaatgttcacaaccacccttggaattcctcctcaagtgtgcgtttggtcacatcacccctggctaccaccagtacatgactgtttattttggatgtccttttctgatgttcagctaatttaacccacaatgaagttaatccttgcttctttggaaaagtacagatttacttattagctgccttccagagacatttgcattttcatgaaagcgagtatataattacattgacttttggactcatctacccacatatgtggtgggcgccttttgaaagtcaggattcagagtaaatcagaactgtcttgagttagctgaagttctctttaaggttaacaataaatgtatctatgacaaacatggggatgtggtattgcatattcgattatgtccatttatctttccttcttctgggtgagaggggagatgaaaatggagctaccttggagttcatgttttcaccttgattctccgcatttatagcatactgattgaaagcatggctgccagaaccatattacttgggcttgagtactagctctgtcacttactcattgtttaactttgggcggggtacttaatttctctgtacctcagtttcataatctgtcaagtggggataattatggtaaccaccactgagcattgttatgaagatcaaataagttaattcatgtaaaatatttagagcagaacttagtatatagcaactgcgatacaagtgttagatatcatttttattagggtttagtaattgcataaataaaagagatgaaagtctaaattattaatcagggccatttatctatgagacactacaggcattgtgtctagccctgtgggtttacattagttagggtaggttattgctgcaacgtaccctaacttgatatgatttttgctgcaaaaatcatatcaaaatagtctataatggcttaaacataataaaatgcatttcttgtttatgtaacagtaatgagtaggtaaacagggtggtaggacattttcctctctgtattcatttagggatctaagctgaaggaggctctgccatcttccacacaaggtttctaaggtcaccttaggttatctctattccagccagcaagaaggggaaaagagctgcagaaatgtgtttaggggttttttatgggccagacctggaagtggcactcatcacttctgttcacattccattggccagaactcagcaggaagaggaggaaaacagctgccactcatctcagccacagagtttttcaggggtctctaaaaatgtatgagacttgaaaaaaatgtattgactccaaactccagacataaaattgcagaattgaaatgaataaatgtttaactaaatgcttataaaatggagccttatatcagcttccaaagttgttacagtttgtatggaaaaaaatgtaatttcttcctaacgaacctccttgcttctttccctgccttctctactatatttgaaaagattttgtaagttggaatttggaatttccaagaattcccaagtactatccagtgattgctgagaaattataattagtcataaatgagtttctcaaggccaaataaattcaaacgaaaaatcttctcaaattattttgcattgcagagaaaccttttaatgtgaaatatgaatacaatttaatatgtttattttgatgttgagtgaggccttcaaaagtagcaggatcatggcctacagaggtcttaacattcctattgtatgcagacacatttcaattgctttgaaaaggtgtatgttgaaggtaactaaacacattttgcatttcaagctcagaaaatttcccctttagattcccttttcttttctccttttattttctaataaaatatttactgctgtgatatccaagaacatgaatgatactgcattgaataacccaggtgcttggtctggtggatgccagtgccagagaagaaaagtgccctattttttcagttatcatgtttgaaggcgaggctttggtctgccttctgagtcattcttggcttcttggatgatagatttcttaaattcttctattctcctaactcaaggcacttctgaatgggtgtttgcgagacgttgtttgaaaaaccacttatcgtgatggatttttgttcttctattttttgctctcttacacactttgctgttgtcctgccaattggaatttgatttgttaattacaaaagcaaactatccaggatggctctaaagggacttcgctataggttggggctatgatagagactttcgcgaaagggattggcaattaagaaatatagcaactgcttctgatgattaaacatttcaagcaactctgaaggtagaatgtggggaatctccagagaaggaaggaaatagagagggaactaatatttatagttactcctatagtcatctccatctcagtacaggacatcttcatccttccagttgttcagaccaaaaaccctggaaacatccttgacttcgtctttcccattccacatttcacccatcagcaaattctgttgcatctgtcttcagaatatattcagaatccaaccacttcttacaacgtctccttctgccatccttctccaagccactagcatcactctcctggatcatcgcaatttcttcctatctagtctccttgcttctttccttgcctttccctacatagcaatcaaagtttagtcttcaaaacacaacaaaacaaatctcttttctgttcaaactcttttatgtttcctcaaaatgttatacgtagagttaccatataacccggcaattccactcctagttacccaagagaaatgacaatgtatgtccacacaaaacctgtacatgaatgttcacagcagcgttattcatgatagccaaaagtggaaaaaacccaaacgcccatcaatgatgaatgtacaattaaaatgtggcataaccatacaatggaatattatttgtcaataaaaagaatgaagtactggtaccatgctataaaatggttgaactttgaaaccatatgctccgtaaaagaagccagtgacaaaaggccacatattacatgattccatgtacagaatagacaaatccatagagactggaaatagattagtgattgccaggagctggggagagaggaatggggagtgactgctaatggatgcagggtttctttttcttttgtggtagtgaaaatgttctgaaattaagtagtggtgacgattgcataactctatgaatatactttctggcttgtatacttttttgaaggggaaaattgtgtggtatgttaacgatatctcaataaagctgctattacaacaaaaacaacttctttggctttctttctgatctttttccctgaatcgtttctgacctcttcccctactcttcttctctttctttttaacccactcagactggcccctattttgttcctctaacagggcaagtgcttcctgccatgggcctttgtattttctcttctctctttttgtagaactttcttcccccaggtatctgcgtggctggttcacttgcttcctttagctctctatttaaacatcctattctcaggagactttctctgattacccgaaaatagtactccctacttcatggcctgctggcgttctctgtttctttcatcctgttttatttttctctgtatcatcaacatgtgatacactgttttcttgtttgttttttatctgtcttccaacattaaaatgtaaactccatgaggcagtaactaggctttgtttgtgactgtatctgcagtaatacataccacacctcttttcactagaccattagcttgaggaagacatggatttccttggcactggtgttgaattgggactaactgtatttgcaggaggaatattcagtgtgtctattagatgctacattagaaatcatcagcttggaagcagtctccatgggaaaagtaattttgattcaaagggtagaatggaactactcaggttacatggtcttttattgtcatataaatctttgtacagagttcctactttttaaaccattagcattatgctaatatacaaagtttgctacttttcatatttgtcttacagattcaaagcctttagttcttttcagtcttaatttaccacctgtctgctctctccttttctcccttggaatgttcttaagatttaattttgaaggaactttctgtcagatgattattggtaaagtaaaatgtatttctgggaagcagctgattacttgggcctttgatttatttatttatttttttttttgaggagttcatattgcgatatacctatttggtggttatttagaaaggccaaggtagggagaaaaaggaaagaataaaatatatgtatgctttaaaaaaaagcaagcatttagtttggggagccctccaaatgtgatttcttctactcctgttttcctgcttccaagcataggtggaagatattgtcagtttctctgaactcctaagttgaaatgtgcaagtcactaggtggcactgaagtatcattctccacacagccacgccatagaacacttttgttatcttgctccagctgactggatttctaggtgtcagggaaattgttttattggtacagggcatagtgtaatatattcctctccaccctaggcagctacttaacgccctgaaacatgcacctcttgtggtcatggcctgttaactatgcttatttggtgtaataattagcagaatttctcactaacaggggtacttaccaacacctcacatcttcactgtgtttttgtacgtgatggattgtacattctgtggagaaagttgggaaggtcaaagcttaacctctgcctaacaggactagttttcgcacatttgttcagaataggtttatattaactggcttttgagcttcttcagaccagaattgtgtgtaacgtaaacatatttgagcttttatgtaaggacctagtgaaggtttgtaaacacaacactgttaattttccaactcatagaatgacagaaaaataaatgaatagctgctggaataattggacgacacttgttactcagaactgtgagtgttggaagcgtgtcataggaacagtgggcctgccacaagcaccacattttaggttaaaatcggagaagaaaattacacatggaattttaattttttccatggtcgtaagttcggccccatttaattctttgtggtttttacaagccctcttaggctcctaatatttctatagcaacaatttcaacgtttattttagaatgtggtcagaattaaccgacagaagaccaaacaggataaaataggtttaaagcaggaaatactttagctggaccactaacttaccctctatgaccttaggcaaactgtttgccgtctctgtgctttgattctctcatttcttaaaatggagattataatacgcacccttgtgtgtctcctccaccaggtaaaagtgaaacaataacttctcaatatacctttgcttatattcaaagctccaggtaaatataagatgttgctataattacctaagaaagctaggaagatttttctttgttgattccaaggtgagttgtagaaattccagaagatggattaatgtagtctgagggctcagacttctgcatctgtgtagatagtacctattttcatatactgtggcctggctctgtttctggcctggctctgtttccaaggtttaagttccattcttttaactgtgtatcaactattttcacttggttgttctacttttacttaaaccctttatatatgtctggatttagttgtaggaaacagaaactatgtgagatagggaaataggttgatataaagtcatcaggaggaccagagaaatgggctgaaggtggagcctccagagatgggcttctgaaacaatattacagattggcttgccagggtagccgctcatctgtcacactcgggaagggctaagaatcaggagtcattcctagaactgttgatttgtaagaacacacaaccatagttgtagttgggatcaggaaggtaccaccattacaactggcatttgagaactacaaagtgaatggccagattctggaatgttattgcctcatgactatgttgcctgcagaaaaagttgaaacagcaaggtgatggcctccattttatttttgacttctgattctcacatgccgccattaaattggtgaagcttatttctcatccagaactcctagctgcaaaagggtctgagaaataatagtgtttaccttttcatcctctgcaccataggaaggcacaataagaggagattggaagggtgctgagtgccaccatatctacctcttcccccagcatgtttaaaataaaatatctttacctccaactcatattgcattttctgtccagcacagcaactagcttagtgggccctcagtagatgtgttaatgacattgacttccttatttcttatatggccccacctttcctagtcacgtgtcttggtactatgtgagatttcagatccacctgcctacctgtaactcttgattccttttcatttccattgctgtctccttgttcaggtccagctcctgtctgcctgggcttttgcagtagtctccttatctggcttttggtttctttcaccgtaaccatattataagtagattggtgtttaaaaatcagaacaacaaataacaaacatccttccactgtgctcctgtccttctcaaaagctttctgaggctcctcattacatgcaggatagaatccagactccttagcttgactttcaggaccttccataatcagggtgcaatctatcattccaggcttatctttcattttccccctgctggaactgaattttagccaaaaggtctaatcactgatgtcagagtgtcttgtcctttactaacttttcagctctgctatccttttgcctgcttttaatagtctgttttctttctcatttgtttattcctttgatcacttaggcacagagtttttttctcctttcttcatacttatagcatggtttactaaggcattttaattttattacctatatcgttagttttctttttatgactatatactctccgctcctttttatgtcgacaatgtaaatatttgttgtggattgatttgttgatttttcatggtttagacatctacttgcttgggaaaaaggggatggtggagggtcaatctgggggctgaagcggtactctagctgtgtgattttgtctttttgattactactgaaattaactatttgctttgagcaaactaatgctgagttttgtggatttagtgtttgaaaagggccctgagagggaaaaccctggagttgagctccttatccccgtttgccaggctggatgagctccatgtccataccactgcattgcagtttgctgaagtgtgtgttgtgaaatagcaatggaatttgtctgtggtttcttgccagcgaggaggaggaagaaggattctgagtaaatcagacatgtaaattagtaaggcccatgggccttaagcgaattacacaataaagcccaaagaaattcactttggcttctttctgctttttgtgtgtgtgagaaggcagctattatgtgtttgctttaggccagaggttcacaaattttttggcttcagaacccttttatactcctaaaaattgttgaggactcaaaaagcttttgtttatatgggttaaacctatcaatatttactgtactgggaactaaaacaggaacttttaaaagcctttattgatttaaaaatagcaaaaccccttcattacaagttaatgtaacattttttatgaaaaataactcttttccaatgtaaaaaattagcaagaagtgtgccattgttttacttttctgcacatctctttactgtctagcttgatgcttgattcttatacttttttgtttagttgttgaaatatgttgttttggttgaagtatatgaacaaaatctggcctcagacattaatggaaaaagggagtattttaattgcttcttcagctattaaatgtagatattcttctttgatattattccaaaacttgtcaagtgatagcttctattttaaaacatttttgtttttaattgacaataattatctatatttatggggcatgctgtgatgttccatgtacacattgtggcatgattaaatcaagctaattaacatatctgtcaccacacatacttattatttctttgtggtgagaatacttaaaatctactattttagcaaatttgaaatatacattactgtttactagtcagcatgctgtgcaacagatcactagaacttaggtctcctgtcaaactgaattttttaccctttgactaacatctcccctttctctgctctatcccaccaaactctggcaattactgttctgctctctacttctatgagtttgacttttttagattccatattttagggagatctgtacctggcttatttcacttagcataatgccctctagattcaagattcatccatgttgtcacagatgacagaatttccttttgtaaggctgaatattattccattttctttagacaagtgataatatcttaaagcttacttgcagtgtggaatccgaagctatctcaattaacttttcttactttgttatattaaaatctgttgatctcttttgcactttgaatgcatcttttacattcaaatgattttgtaacattacgttttgatcatttggaaaattatcatgtcactgagttatacagatcttccaaatgttgatgcatttcattatacagtgtaaaaaaaggtcacactcatcagtatcaccactgatcttatacaagtttttaagtattgaaaagccccaagctcaaggtagcaaatacaaattttctaaatttctgatttttcttgacaacctgaagtttatcattggcagcaaatatggtcagttgtttttcttgaagtggcaagctcacttgattaattgttgagaaaaagtctgccaaatactcaagtccgattaaccagaaaaatgtcagtcagctattttttcaagtaaaaatggtgttccatggggcaaattcagcccagaactcaaatcacacatgtacttttgtttgagacaaccattttactttagtatttatcagaagtactttatgtatgtttactattttgtcacacagtatagtaaaaagatagctacttaaagctcaagatttaatagaattaataatttttcctgcttcaccaaggacatgcttaagtgaaactaacttcctttttctttctcttttaaatggaatgcatggtaaagaacatagcaactagtaagtttttgaggtctattaaaacagcctgctcactatagttaataataatgtatatttcaaaattgctaaaatggtagattttaaatgctttcaccacaaagtatgtgaggtgatggataagttaattagcttgatttaatcattccacaatgtatacaaatgtcaaaacatcacattgtactccataaatatgtattacttgtcaattaaaaatagatgttaaaaaaactgaatactagtttagtttggtaccgctggcttgattagtgacaaggcacctgcagttttacccagcattctttaaaccgtcagtggaaatgtccacacggtgaaaaaagcaagtaatagtattattctgaaaatagtattgatcttgtggaacctttgccaatctactgcactatgccaattaggaagatttgagtagctaaaaattccaagagtggaataatagttttattagttatatcttgaaggccaatttccttttttaccctggaacttaggctaagtgaggcaacctggaggagaaaatttctctcctgtcctgagattgctgttagcccagggtcggaattcctggggcctgattttttgagtttaagaagcacagggaggatttttttttaacctgcctttggtgataataaatgtttaacctaaatcaatgtgattgtggattttttttttttttttgaattgttgtttctgttagaaaaataatgaatgacaagtgccgcagagatcagttgtttgtgagatgactgagaaggtaataggacctcctatttgggacattaaggaaagccttctctaaaaaaagaacccattttgagcaacatgcgaaaattctttgagtcagttggcctcatttgtaagcctttgattgctttatttgtttgtttgcttgcttgtttatttatttatatttggaaggcaatctttctgcttcctgactggctgtcagatctcccaaataacatcatccctttgctggtgtgaatatagcctagacttgaggcagcaattaactgatcatgtaatagaagaatcccaatcttccagtttctttttttaacttcttgggtggttggggcacatcattgcaacaattattacatttactcaagagtttgtcttttctattaaaaaaaaaattccatctaagtgccttacggtgaagaggaggagattgtgtaactggagtctccccttaactggtctttattgttaaagaagagtgatccctttgtgtttcagcttggcacacagaaactgttttaatttaacagtccagctcctttaatagatcaattctctattgtggtttgaatttggtgcactcccaatttactctaaacttctacgggcttccttggagaaactggggcagagatgccgaagactcatttcgggtacaatttagagtttgtttatttatataaatgtaaggggtaccagtgcagttttgttacatggatatattgtgtagtggtaaagtctgggtcagcttttagtgtaactcatctgaataatgcacattatatccattaatttatagttttatctcaaacctcttattaattaatgctagccatggaagctagctagcgcttgtaaatgcctgctgtgtgttagatgctctagtaggtgttttagacaccctcatctaatcttcatggtgattttctgatatatcctgaacctgtacaattttctccacttctgtcactactactacaggccaagccaccatcatttcttgcacagacttctgcaccctcaatgtggcctccctacttcaagttttaacagtcttctccctctcataatccactttccagacataagttggatttattttaaaaatatatatcaagtgatgtcacctcactgcctataagactcttcagtgacttaatgacaaacagaatgagatccttctcctgctctggctgacaagaccagaacaacctgggttctatagctctgagagctcaccagccactctgtccttgctcgttcactgtgctccagactcactggcttgctttctgtccctggaagccaccagactggttcttccttagggcctttgtaccagctgttcttcctgcttgggacactctctccccagatctttagtctgggcctggcttcttgtgatttgtgtcttgcctaaaatgacacccactcaatgtgccttccctgaccagctgagctacagcggtttccctctaccgcatcactagattttactttctttctttttgtttgagatggagttttgctcttgttgcccaggctggagtgcagtggcatgatctgggctcactgtaaccacctcctgggttcaagcgattttcccacctgtagagacggggttttgccatattggtcaggctggtcttgaactcctgacctcaggtgattcacccacctcggcctcccaaagtgctaggattacaggcaggagccactgagccaccacattcagcctagattttattttcattaaatcgcttgatgcagtgcagagtgagtttctgctattagactgtctggatttcaatcatggcctcgtcatttactggctgtgtgattttggagaagttacttaacttttcaggactttcatcttcttctttataaaatggaaatattattatatccctccattgtaagaattgaataaggtagtacttagcatcttttatggtttctgacacattgtacataatcaaaaaatgttaaatattgctattttaatgtaatgttattaaaatcattgcatattttatagcttatttatttggctatttttctgtctcttctaccaggaatataagctttatgagggaaagaatcttatgtgtcacattcccaactgtgcccctagagcttagaacagtgcttagcacatagtaggcattcactaaatctttgctgattattaaaatctgagatataattatccctatttttccaattgagtaatcagggttcagagaggtaaagtaacttacccaaggctacgcagctactaaatgctagtagttcctggtatttgtactgaatgctgattacaaagaccatgttctttctgttatgccacaatacataagtggatctttatttcagattctgtcatttatagcagatgattttcaggttgcctttttatgtaaatgtaacatgactcatgaaatgtaaacagccatttgtgtgaacatgaaaggtcagagccaagagttaggccacaggcaagttaggaaagtgagatatagcacacccaccacattcagtggtggaagaaaagttacctgattcctgccttggagatgtgtagggtagtgaccttggggttgggctgcctgaggaggttcctatgctttgatttctgaatggacaggatccctaaagtcatcgaccctagtttgggctcttgtacttcttctatcatcttattctagttggtggaggcagaggttgaaaaatcaaaatgttggctccttcagcctctaaaaagtaataggcttgaatttgcttttgtcactaacatgattatggtgcttggtctgtgggggcttcactgatgcattctttttaacagccctgtttgtttgtttgtttgtttgtttataagtgagcatagcacagaggaaaaaatataggttttggagactggcacatcagggttcagatttctgctgtgctacttcttggctgtgttttggcacgtgaacttctctacacctcagtttctttgtttatgtaatggggattcatatgacaattaaagagagagcttgtctaaagtgtcttatgtagtagtatccccagtttgacccttttgagaatctgatgacagttatggaaccctctccccagacaagtgcccgtatacccagaactttgtatttaatttcatggggttcatgaagcctctgaaactcagcttaagagtccataccaaccaaggtccttataggaagagcttgtgtttttgttttgttttggctttctgcagtctcttaataatgtttattgaatgagagaatttaactaatttccggtttccataatcactttaaactcggtatttgatttccttttccctgggacctgtgacagtgccagcttcatagcctagtctaggcatgccagttgcccactgtggcaatcaatatctgagcctgtggtttttgccttaggtaaactgtagagatggactcatggaatgcttggaaaatttttcagtttatgataatgtgtaaatgtcgagagccaattattgaggaatggcacctcaaagtatttgggtactctagatcagacatgaccatcttggtgtgtgaaattttgctaatgcatctttcctaatagaatatacaatctcagggctagaaagtcttagagatcatttaatttaattcctccagattgattaagtggtttgtccaaggtcattcaactggtatagtggcagagctcaggctgtacaaatcaggtgagtattcttcagctcctcagaagccagtaacttccactcacttgtgtgtgtctgaaattcattaaaccttcgacacaaagtgcagccattttaatgctgaatgatattcatcactgtctgaaatgggcttatttatgtacgaatgtttattcctatctcttcctccattctcccaaaatgtaaaccccataagaacaggaatcttgtctgtcttagtcacactcagtatccttagagccttgtgtgtagtaggtgtgtagtgaattttggttgaatgagtggcagttctaataatgtcagaagaattggaatttctttacagaaatctttatcagtaatttaacaaacatcgattgaacctattatgtatcaggcactataccaggcacaggtacgaatgagatatggtgctcagcttcaaggagttacagtctaaataccaaaataacagaatcaagagcagcagactaaattgggcccactgtattttttaaaaatttaatttgactgctgggtgcggtggctcactcctgtaatcccagcacttcgggagcctgaggtgggtgaatcatgaggtcaggagtccgagaccaacccggccaagttggtgaaacactgtctctactaaaaaaaaatacaggccaggtgtggtggctcacgcctataatcccagcgctttgggaggccgaggcgggcgggtcacgaggagatcgaggccatcctggctaacacggtgaaaccccgtctctactaaaaatacaaaaaattagccagggcgtggtggcgggcgcctgtagtcccagctactcgagaggctgaggcaagagaatggcgtgaacccgggaggcggagcttgcagtgaaacgaggttgcgccacggcactccagcctgggtgacagagcaagactccataaaaaaaaaaaaaaaaaaaaaaagtaaaagaaaattagccgggcgtggtggcacgtgcctataatcccagctactcgggaggctgaggcaggagaatcacttgaacccgaaaggtggaggttgcagtgagctgagatcgcgccactgcactccggcctgggtgacagagtgagactttgtctcggaaaaaaaaaaaattaatttgaatgcatgctccattatatcctatgtcttttaccttcctgctttgctcatttaactgcctgatttctgatgacatttaagttcaggtcttaggttctgtagatcagtggtttctaaacctggttgatcatcacctcacctcactggccttagaaacaatacagaccctacttctggagattctaaaccagggctgagatgggcccttggaaactgtattgaaaaacagtaactctatagtcacttacaatgagcagccaaatctagctagatgcccctgctttatgggtgagtgttgagcatgagggtttcgtcttaaaacctggacttgatattctatattcatagcatctttcatatccttaaagattctatgtacttttcagcacattgttctgtttcaaggggctctgcaaagtatacttgctgtctgtacatttccactgtgaaaactccttgaaatcatgtagacaaatgaaagctaaacatcaaataaataacctaaactggtaatactcccatttggctctccttgtgtcttttcatgtgggttagctcttcaaccagattcagcatataaattgagtatgtatggttatatggtgactttcaaaagtaaatactttttctgtggaacaaaagagatggatttgtggttttccaggattccttttccctgacttggtagaaagatagccaggcatagctcagcagacctgaaaataggtgagctgtcaaggtgttggcagggagaggctcctctgggtgggacttggggcatcctaccagcgaaaaagagactaagtttaagtgatttcacatttgggctttacttactataattgctgaagtgctaaattgagtgtgacaaatctaacaggtaattgccaagtaggtttcattaccagtcattgcatagataaatgatgttccttatgttaaaaaataaaaccaaactaaagaaaaaaaattggactatatttggaggtagaattcagatattgcagatatgttcatatacatcaaagctgtttcaatgtgtcaacgaactcagttcatttacctctgccaaggtggtatagtgtatgtgggagtgcagagtgggggaaagtgaggaggggttgtgatttatgagaaactgtaaaagaggttagaattgggaaacaagtttttttcttagaggagtggcaaatagtaagtagcatttggacctcactcagctctaatagttaaagctaagctttttgacattatcattatatattaataatatatatgtgtgaccagcctcaatagattttattcattagtaacttggttgatttaatgaaaatagttttaaaaggcatactgaagcacagtaaaacctaaggctcacatcactgtctggggagtcagtgaggaacagggcagagtgccagtgcatatgaagagggatttttttgccttcttggttcactgcatattcccagtaattggaacaatgcctgacatgaagtagacataaaataattactgaatgaaagtggaaaggaaagtatacttagtctctgctttcatggagcttatatgctagtgggagagagacaaaaattaagtacaaataaataaacagaatatatgatagcaactagggtgagagtgctgtttttgataggatggcagggattgggccatttggggaatgaattgatgagaaagagaaagttgtgcaaagctgggagaggaaacatcatttgaaggacagaaagaaggcctacatgatttgagaatggtggagagagagatttgagggacagacttgctatgattaagaaagatagctgggcgcggtggctcatgcctgtaatcccagcactttgggaggatgaggcgggtggatcatgaggtcaagagatcaagaccatcctgaccaacatggtgaaacccggtctctactaaaaatacaaaaattagctgggcgtggtgacatgcgcctgtagtcccagctactcgggaggctgaggcaggagaattgcttgaacccgggaggcggaggttgcagttagccgagattccgccgctgcactccagcctggtgacagagcgagactccatctcaaaaagaaaaaaaaaaaaaaaagaaagtcatgataaagagtgtggattttattttacgcaaagtgggagctcattaagaaggtaaaagtttttaagcaagggaatgacatgatttgacctactttttaaaggaggttgctctgacggctgtagaggatagaccataggcaggggacaatagagagaccaggaggaggctgttggagtgtgttaggcgagatatggtgagtggtttcagaggcttgtgtgagaaagttgatacactgcccctaccccatgcaaacacacactttcttttcttatgatgacctttctttaaaagcatttgttggaatatgagattataggccataagtgagaaaacaactctttttgagctgtgaggaatactaggagaggagaaagtgagctgtgtgtgctgcccatggtggtacgctgctatggttctacagttccagtcatttttgacagcatggattcaatgcaaaatggcaacacacactctgtatcttttggcagatcagaacataatgaaaataaaataaaaaaattcaaaactggctcttgaatgaaataggattcagaagagatgatctcaaatctactttatgagataatgtcctttttaaaaataaacactaacatcagttatgcatttagaatgtctgaattattattctaggttccttgcgactgctgtgaattttgtgatgcacttggatagtctctgttactctaaagttttaataggtaacagtcagaaatggagtgggagagcataaaagcaaactgaaatgcaaatagctggtaccctgaagccattaactttaagctggttattcctgacctactgtttggacataagatggtagagaggctgagtgtgacttgaacatttgttccttagaaacaccatccttgggctgggcgcagtggctcacgcctgtgtttccaggactttgggaggctgaggcgggcagatcatgaggtcaatagatcgaaactatcctggctaacacggtgaaatcccatctctactaaaaatacaaaaaattagccaggtgtggtggcgggtgcctgtagtcccagctactcgggaggctgaggcaggagaattgcttgaacccaggaggcagaggttgcagtgagccaaggtcgcaccactgcactctagcctgggcaacagagtgagactccttctcaaaaaaaaaaaaaaaaaaaaaaaaaaaaaaaagaaaaagaaacaccatccttgtaaagagagcgcatacaccttcaatttctagggcagcagcgtttgctttacaacttctatgtcttggtgggagtagcactatctatcaccttatgggccaaagggaaaaagtccagtgaaaatggctctgatgttgttggaagtgggaaagcaggttaataggttcttcttaatggaaaatgcagccaatattggccaacttactttgatttcggtagtcataacaccaccctggaaggcaccctagatagaggtcacttgctaccactcattttacagatcaggatactaaggattttcctgattttaagcattaagtatggatatccctgttggttgaagttaaattggtcaactagaatttaaaagcaaaaattaaaaaaaaattattttgtattaggtttcaaaggaattgttgtcagtaggagaagcctgattgttccttttacgctgactcatacagtttcagcagattacatttgaggcctaatgttgaaatctcatctgtaagtctggtatatctaactaatcatataaacatctttcatcttagactgtgtagcatgtccctagtagaccaggtgggccaaatgacattatagttaaatcaagccaataaatatatgagaaagaaggcaaatgagcgtagactccatagtgaatgatggaggttccgacgagtcaaagacactgaactattcattgctattggtttatggaagagcaaacccagatatgtgttatgctgattctgtgtgattggctacttccaggattgaccctgttctcctgtcctgctcaagtctccttccttcacttaaccatatattgtgggtactcagaaatgccatgcttttgtttagagtagcaggattggtgttgaagatcaacaagaaaaagcaaaatgggcttgtctgtcccatcaagtgatgtgctgtcaacatatgtagaatatgtgccctgaattaggagaaaaaagtagagattcctgagtttaggaaattataatctgatgcatcttcttcagactcaagccttacctaaagtttgtaaattctttctctttcgtctttattctttctctactcttaacatttttttcccccacctctttggctatatgctgttctgcttttgatacagaattgaccttatttggccagatggggtggctcatgcctgtaatcccagcactttgggacgctgaggtgggcggctcacttgaggccaggagtacgagaccagcctggccaacatggtgaaactccgtctctactaaaaatacaaaaattagccggacatggtggtgggcgcctgtaatcccatctactaaggaggctgaggcaggagaattgcttgaacccgggaggtggaaattgcagtgagctgagatcaggccactgcactccagcctgggcgacagagctagactctgtctcaaaaaaaaaaaaaaaaaaaaaattgacctttttcatgcccaacctctatctccattatctcctagctttttggaaaatatttagtactggcatttcttcttcactgatttttcattctacctgtctttagtatcataggggtagttacctcagcgggggtagggagaccttgggtgtctcttacttgtacatactctgtcctctataagtaagtgtgtaaatacactgtattttcccattcagacatattgtgtaagtaataggaaccaggtgtttgaataaattaaccaagtgccaaatttcattttggaaatgaaatattttagtttaagactctaggacatttataaagctgaaatacattgcaaagtgatgaaagctttcttaaattctgttatagtcatgcaccttaaaattattcattgttacttatagttattatctgtctgtatatgctcatctacatatgtaaaacatgaagatattctctcaagtgaggacttcatgtgccagatttttcagcctggattgaattttatggatgagagagataccctggaaatggaaccattggcataaccttgtgtctaatataataacagagctctaatgaactgcaacatgagctcagatctgcaaaatattcagaggatataggcaaagagcagttttttcctccttatgagctaggttgttctccaaaagcaacaagtactacttgtcttttcagagcgctgtcatggagctgtaagtctctttgtggtttagacttaatgtgagtaagattcctctgcattctcagcctagaaaaacttgaccgttctcttggaatttggtgaaagtttcctaactttgaagctagagaatactctcatttcagattaggcaattattaacatttttttctgttctaatttcatgatgccaaaaaatcatgtatggttgatctatttggagaacaatatgtagcctcagacacttaagatcatatgtagtttagaaataatgtcaattgcatatgaatgttttgatgtttttcccccagcctttctgaattttttgatttcttcaaattgtacctggttttttatttttgtttctgtttttgtttttgactttcacataaactgtttatagtgtctggaacatacatatatatatatatacacacacacacacatatatgtatgtatgtatacatgtgtacatgtatataaacatgtatatgtatgtatattccagacaaattatataaatgtatgtatatatatacaaattatatatacatatacgtatatatatacaaattatatatatacatatacgtatatacacaaaaattataacacaaattatatatacatatattttgtacatatacaaatatataatatgtttgtgtatgtatagttatatatacacataaatattttgtattttgtatatatgtatacatatacattttgtaatatatacgtatatattactatatgtatttttaattgtaaaatacacataggataaaatttataattttagtccttagccattttttttaaccatttaacaagtggtattaagttcatcctcattattgtggaacccatcaccactatccatcttcaaaacttttccagcagcccatactgaaactgtaccaattaaacaataactccttgtttctagcttcccccagcccctggcaaccaccattctattttctgtctctacaaattcaactatttcaggtaacacatataagtagaatcatacagtatttgtccttttgtggctggctagtgacgacattaagattaaaatcaggagaaacagggtgggcatgttggctcacacctgtaatcccagcactttgggagcctgaggcaggaggattgcttgagcctaggagtttgagaccagcctgggcaacagagtaagacccccatctctataaagaaaacaaaaccaaaataaagcaaaaaaaaaaaaaaaaaaaaaggagaaacagatttaagacagtcaggaaagaaaaatattgactttgattttggtcttattgaatcttaggtgctggcaggtgaggactttcatgttgtaatatcctgaagacagtttcaaatataggtttggaatggagatgaggacttcagagttatcggtaatgaactcattttaagaagatgagattgcctaaaggaagaatgttttgtagagttagaagagtgggatttacctgatgatcttaggaattctggacatttatcttaaattgctctttaggaagtttagtagaaaaagaaaggatgcagatagtgtctgctattaaaggcagaggaagaaagacctgaaacagagacagagaagaagggagcttaggttataggaataaaagggagaggatgtcatagaaacgaagggaaatgaggattttgagaaagagatgcaagtgactgtgcccagtgtttccctaatgaccaagaggatagttctgggttttagcaagtatgagttggccattggccttgggaagaatagtttcagcagaatggtagtggttgaagccagatcctcataggggttagggccaaaagaaacagtaggaattctaggcatttatctgaaattgctctttaggaagtttggtggggaaagaaaggatgcagatagggaatctcaggcacatagaggttaagtaacttgctcaaggtcacacagtaaccttaagtaggcaggataagctctggttctggagctggtgctcttcatcattattttaggctgtactctcccacctttttttctttgtggttgtaggtggttgtaggctacttaaagagatacctatacacctgcagttaaaatccaagtaactcagtggagagcctggtccttcgttattatgtctcagattgaagttttatattttacagcatgatgaaattacatatatgatggttaggttaggttgcaagtcttggaatatatgcagaggaataactttattacaatgactatttactttttataagacaatccagcaatggtaatttttcattagtgatataattgcaagaggaaacttgagaacagaaaatggacatattgaaataagattaaatacatgctgatgaagttacagagttttatgcaacgtttcaatcaagaaagcatgataataaagcgtgtataggccgggcgcggtggctcacgcttgtaatcccagcactttgggaggccgaggcgggcggatcacgaggtcaggagatcgagaccatcctggctaacacggtgaaaaccccgtctctactaaaaatacaaaaaaaattatccgggcgtgatggcgggcgcctgtagtcccagctactcgggaggctgaggcaggagaatggcgtgaaccctggaggcggagcttgcagtgagccgagattgcgccactgcactcccgcctgggccacagagcgagacttcgtctcaaaaaaaaaaaaaaaaaataaaaataaaaaaaataaagcgtgtatattgactttccagaatcttgagaatggataaatggaaacaaagagaaatacctattttgtattataaacctctaaaatagttactaaataagttattcttttaggtatttttctttcacttttcatcgctattaggcaaaactgatagtcgatgtagctgtgtcagtagctaagggatttttgttgttgttgttaaactaacatgtcatatcttgtataattcagctgtgactatacaggggaaagtatttaatgtctgatgattatacagcctgtgctttggaaacagccgaaagccagacagcgacagtagagggcaaaggattattaaatggatagtcactgaggtcacttatagtgactttactgcaacaccgtgtgcatctcctttcccatggcaggttgtttgatcatggcttaatggctaaagctttgtaaaattataaaaaaagccagaaatcctgctgatctcaagtgttatttacagttggatgcttggcaggaaagtgctaagtctgatcatactaatgctaagtcaggcagaacacgtggtgaaatctcatggagctctatcctctgaaccttgagaagactaccaaagtataagatttcagggtggaaagtatgctgcaatatgattgagagaatttggctttttcatctgaacaggtgtggccaagtggaggagtttctcctcttggaaatgtcaaggggtgtatcattaggtccttggagctagaatgtaggtagaatggcaaggaaggaattttaattagttctgttatctttcttttatggtttggaatggtattttctttggtcatctattcacttacaaaattatggacagtatttgattgtgaggaagaatcttgggtaagtgttatctttgttttcagtagaattacttggagctggctcaaggaaattatattagtagtttgcaagtgagttacagctaatggagtcaaaagaagtttgaaaagggtcaaaagaagttagaattgttccatctgagtctttggcccttagtaaaggatccagcattttgttttgtttttgcttatgtctttgatattaatatatttttcagaatattataaaccacccttccccaaagttttatttccgcaatcactccctaatctttatttcttttttgcttcgcatcatatacatttttctcttcaggacaccttcttttcccttttgaaacttggactatgttcttaaaattgacgattataggtaagaagaccaagtttgtgagacaaatagaatttgatattcaaattatctgaagaactgaagtacattattttgtacttgtttttatttattaaaaaaaatttcccttggaaaagaaattggtgagattaaggaatgctatagctaactttgtaggatatttggaaaactatgagttatagtgaaaggtgctgtcttagggagtacattttaaaagtgctagaaaatataatattacagcttgaatcaagagaagtgaactctgctagggactaagtactttgttagaaaggtgctcataatagaatggcgtgaacgcgggagacggagctttcagtgagccgagagcgagactccgtctcaaaacaaacaaacaaacaaacaaacaaaaataaaatagaaaggtgctcataataaaatgagaaataaaaaaaattctaactgatcaaatgggacaaaacccagattcacggtctttatatgcaaataaagtatagattcttagattcagaacagtaaaagaaaaatacctagaaaacaataaacaaaaggcatgaacaggcatttcacaaaagagctactgcaaagtcacaaacatattaaaagttactcatcctaactaacaatcaaataaatgtaaattagagcaagcaaacttgtttttccatttatgaacttgccaaagatttaaaagtttgataataatgaatgtttgagtatatgaagaactgggtattatttgttgatggacatgtaccatagcatttttctggagcgtaatttcacaatgtgaatcagaagtcttaatagtgcatacgttttgacctagtgaatctcctgctaagactttttatcctaaagaagtcatctgtgccttcttgtcaagatggtactgtaagctcacagtttgtacataccttctgctctaaattcataggaatggcagatataatgcattaaaagaattaaagaaaaaagtcgtagctgggcttacagacaagatagtgttgtagacccgaaagctaactaaacataaagggctagtaagctggattgaagcgatggtgctgcagaggctctggatggagaaacagaaagctagatttagctcccatagagtgctaggactgaaagtttaccacttgaaatgggaccataactaagctcactgcttaaagccaggggcagggatgaagttgtcaatcctataaaaggaaactaaataaaggctccacatggaggctccagtttatatggagctgtgggtcttgaggggcaggaggagatagattcaatttcaagaatagcaactgaatcaggctgactgtgaggagacaataatgagaaaatgtggtgttccatgttacaattatgaggtttggtcctggacagtagcacagggatcctggtggaggcagctgcagaaacactatggagggaaaggtgagcacaggtggagagaaaggggagtaagagaagcaaagaagaaaagcctttcacttagaattagccttcaaaatgcaataccaaaatactggaagaaaataaataccaagaaagatagctaacaaaatcaacaatgagaacaaaaatttatcccagatgagatgaatttttacagaaaagtcagtcaaaaattaaaagaatcatgttcagaatactcaaggggataaataaaggcattacattgatgaaaaatgatgtttaaaaatactcccaagatatgcagaaatggaagaggaacaacgacatgaaaaagaaccagttacaaattttggaaatgaaaaatatggtcatagaaataataaacttaatagaggggatggactttagacctcacacaattaaaaagagaattgatgaattagaagagaatactaaggaattcattcagaatgtatcataaagagacaaaagattttttaaaaggcatttaggagatttgaaggatagatggagttccaacatatgtctaataagagaacacagccttgaacttttggcctcaagtgatcttcctgcctcagcctcctgagtagctgggactacaggcacatgacaccagaccctgctaatacatttgtgtgtgtgtgtgtgtgcgtgcgtgtgtgtgtgtgtagagaccagattctcgcgatgttgcccaggctggtctcaaactcctaggctcaagccatccacctgaggtctcagcctcccacaagtgttgggattacaggcatgagcctctatacctggccaagaagcaaaatgtaaagagccaagaattgagaattttcctatttaaagaatgatgagtttagatatattgagtagtatcatcatgttgacgttgtagaatttaagggatatagaggaaaaaacatttttgagatacaaaacaaaaaaatgccaattacctacgaaagaaagattagcaacaatagatgctagaagacaggagaataatatactaatatattcaaaatgctaaggggaagttatagttaattttgatttttaaacccagttagtctttgattcaaaagtgaaggaaaaatacagatactttcagatataaagaaagaccaagagagttaccatccatggaatctcaccagggaaactgttaaatgctgctctttagcaagaagaaaagtgaaaccagaagtaaggttttgttttttttctttctttctttcttttttttttttttttggagacggagtctcactctgttgtgtaggctggagtgcaatggcgcaatgctgactgcaacctccgcctcccaggttcaagtgattctcctgcctcagcctcccgagtagctgggattacagacatgtgccaccatgcccagctaattttgaatttttagtagagatggggttttgcaatgtcggccaggctaatctggaactcctgacctcaggtgatcggcccgcattggcctcccaaagtgccgggactgtaggagcgagccactgctcctggcctagtttttaattaaaacaagtgaacaaacaaaggtgggcatagagattgataaagtgtattggaaaattcactaagttattggtttaaatactactttttgttctaaaatgaatataaagctaaaactctggagaatgatgagaatgtaagaagggagaagtaaattatgtgtgatccaatattagggacacaaaaagggacatactacatgaattactaatatctaagaaaatatgatacatttgagaacttagatgaagttgatacatacctagaaagataggcattacttaaattgcttcaagaagtagaaaatctgaataaaacaatgaacgaaattgaatgataatgaaaagtccatctgtcaaatgacagcaggcccagttttataggcacgttaaaccaaatttaagtaatccttacttactcttcttccctttttaaagagttttattggggtataattgatatagaataaactgcacatatttaaagttttgacatacgtatatactggttaaaccaccaaaatcaagattaggagacatgttcattatcactcctaatttgtgtccctcagaaatccttttctccttctctcccctagtggttctgggcagctactaatctgctttctgtcactattgactagttggcattttctcgaattttgcataaatggaatcaatcaaacagtatgtgcttttgcactcgctctctctttctctctcccttttaaaaaatagattctggttttttagagtaggtttaggttctggcaaaattgtgagacaggcacagagatttcccatatactccctacctccacacatgctctgttacacacactccactattatcaatatctgccattagagtggtacatctgctacacatcattatcacctaatgtccataagtttaataaaccattagggtttacttttggtggtatatattgttgcttgggacaaatgtatagtgacatgtacttaccactgtgttatagtatcacacaaagcagtttcactgccctaaagattctctgcactgtgtgctcttttttggaggtttagggggaggcctgtcttccgtcactcagcattgtgattttgagatccatcatgttgttgtatgcttcactaattcattcctttttattgctgattggtgagttattatatggatataccataatttctttttctttttttcaatatactgcgatttctttatctgtgcacttgttgatggacatttgggttgtttccagttttgggtaattacaaatgaagctgctgtgaacattcatgtgcagatttttatgtagacatgtgcaatcatgttgtaggtgtttaatatatatatttttatgaaagttccagattgtcttccaaagtagttgaccattttgttttcatgagagcagtgtataagagttctagttttgagagcagattttcttaaatttcatgaagtttatcctttttttcttttatggattttacttctgggttcatttctctgaaatctctgccttgtgtaacttaaatactaaaagagtttcgtatgttttctaatactagttttatagttttaaggttttatattaggttttatattgatgtatttattaattttgagatatttttgtgtatgcacaaggtgtggattggagttctttaaaagatatagatatctaattcttcaagtactatttgttaggactcttctttctccatttgaatctttgtcaaaaatcaatgaaacataaatatctgggtctattgtggacctctattttgttccatttatctgtttgtttagtattatatcaatacagcactgtcttgatttctgtagttttatactaagtcttgaagttaggtagtgaagtccttcaactttattttactttttcaaagatgttttgtcactttaagtctttgcgtttctaagtgaattttagaaatagaatgtcaatttttacaaaaaaaacctgcagggatcttagtttgagattgcatcaatttggggacagtgaaatattttatcgagtcttccagtccactaacatggcatatctctttgtttaatttcggtagtgttttttaaattttctttgtataagtgtggaaaaccttttgtccagtttatctctgagtactttataatttttgttaaggtacatggtatttaaaaaaacttcaatttcagattgttggttgctagcatataaaaataatttttgtatattgatattgcagtgtagctaaacttatttattagctctaatagctgttttgcaaattctgtagaattttctacatagatgcttatgtcgtatttaaataatgacatttttaccttttaaaaatttattctcaatccggatacttttcacttctttttcttgccttgttgcacgggctagaaccttcagtacaatctggcatagagggggtgatgggaaacatccttggcttttttcctcattttagggtaaaatcattcactcttttaccactaggtagggtttcattgattcctttattaagatgaagaaattccgtagtttaccgagtgtgtttatcagggtcattgttgggtattgtctaatgctcttacatctattcaggtgaccctctagtttttctttcttagcctgataatatgatggatttatgtagatttttgaatgttaaaccaacctggcgttctgggggtaacacttggttattatatattgtcctttttatgtgttgttggattcagtctgctaacattttgttaatactttttacatttatatgcatgagggatattggtctgtagttttcttgtaatatttctgcttgcctttgggattgaaagccattaattttctggattaatttatgtagaattattattatttctttcttaaatgctttgtagactttatcagtgaaggctttggatttggagttttgtttgtgggaagtttttgaaatacaaattcaatttcattaatagatataggactatctatgtctactaaaaaggggctatccttttctttttcttttttttctttgagagcaaggcctatgtcttgatcaccattttgttccaagcatatccctggcatatagtgggtcaggagtaaatgtttggtgaatggatgaatgaatgaggcaaactcagggagaggaagtggggactgtgtctgttcttggcccagtgtggggttgtttgtggatgacatctcattctcatcctgtagtagagggataacacaaaagtatggagtctcagggctccagagtcctcatcctctgagctacatctcctacttagccgaggtcttttcactctctgggcaagtctcctcactttgctgaaatggcagcgttcctggtacatgcccggtttagcctaggctaacctcttcttgagtgaacctaggtaatttgtgtctttcaaggaatttgtctattttatctaagttctagaatttattagcataaagtttataacatccccttattatccttttaattggtatgttgaaacttctgtgtgtatttttaaatcattctggctagggattttaaattttcttttctcaaagaactagcttttggcttcatttttttttaacttttctgttttctatttcattgatttctgttgtggtcttttattattttctcctgtgtattgtatttgttcttctttttcgagtttctccaagtggaagctaaggtaattgatttgtgaccatttttcttttttattataggcattcagtgccataaatttccctcagtttactagtttaggtgcatcctacaaattttgaaatttgtattttcatttttgttcaacttaaaatactttctcatttctcgattgttttcttctttgactcatgtattatttaggaatcaattatttagttttcaaatatttggggattttctagatgtatatctgttattattttaagtttaactccattttatcacagaatatattttttatgatttcaatccttataaatgtattgagacccagagatggtctgtcttagcaaatattgtatgtgtatttgaaacaaatgtctattttgctgttgtttggtggagtgctatctacatgtcagttagttcaagctggttgatggtgttgttcaaatctcttatggtgcttttgtctacttgttctaccagttattaagacaaggatattgaaatcttagactattaattatggaattacctatttctttttgttctttcagtttttgctgcatgtttgaagacctgttattaggtgtatatatgtttaagatttttatgttcttgatgatttgactcctttatcattatgaaatgactttttctcttgtaatattttttgttctgaattccattttgtctgatatcaatatagccacttcaactttcttttaattagtattactgggtaaatttttttccaactttttacttctttacaaatctttttttattgcagtagaatgtacataacatataatttatcattttaaccattttaaagtatacacttatgtggcattaaatacaatttcacaatgtcttgtccatccttttactttaaatcaatttgtttctttacatttgaagaatattttttataggcaacctatggttgcatactgcttttaaaaaaatccaatttgacagtttctcccctttaattgggttatttagatcatttacagttattgtgattgtttctatggttggatttaattctaccacttttgtctattctttgatccctttttttcttgatttctgccttttttggatttttttataattccattttatctcttttgttggcttattacttgtaattttttggttttttttttatgttggttttagggtttctggtatccatctttatcgtatcggaatctttcttgaagtattactgtgcttcacatgtagcataaaaatttttaccacaatatacttttcatatctctttggccattgtgatgttgctatcatacattttatttctacatatgttatgaatcccagaatgtactactcttgtttttgctttagtcaattatcttttataaagacttagtgagaagtcttttatatttcccatatagttaccatttctgatactcttcattctcttaagtattcagatttttatctattgtccttttctttccacctgaagatcttccattatcagttcttatcttgaagatctgctggtgttgaattctttctgcttttgtgtgtctgaaaaaatatttatttctcctttattgttgaaatacattatagcatttccccactgtcttctgtcttccggcaaccattttttttttttttacaatgagctatttggtgttattcttttttttctttttttgaaacagagtctgactcagtcacccaggctggagtgcagtggtgtgaactcggctcactgcaacctccacctcccaggttcaagtgattattgtgcctcagcctccccagtagctgggattacaggtgtgcgccaccacacccagctaatttttgtatttttagtatagacgaggtttcgccatgttggccaggctggtcttgaactcctggcctcaagttatccacccgcccacctcggcctcccaaagtgctgggattacaggtgtgagccaccacacgcagtcttatttggttttatttttatagtttttttgggtacatagtaccttcatctcttgctatctgtgggggattggttccaggacccctgcaaatataaaaattcatggattctcaagtcacttatataaaatggcatgtcgcatttgcatataacctatgcacatcttcctatgtactttaaatcatctttagattacttatagtacctaatacaatataaatgctatataaatagttgttatatttcattgtttagggaataatgataagaaaaaagtctgcacatgtttggtatagctgcaaccatccattttttttttcagcaatattttttatctgacattgtttgaatccataaatgggaaacccatatatatggagggccaactgtattttcttttgtctgactgcttttaagactttatctttttcactggatttaagtaattcgattatgttgcgttttagtgttatttcctcttgatttttgtgattgaagtcctttgaacatcttaaatctgtggattgatggttttcatcaaatttggaaaatatttggccacttctttttctgtcttccaatctctctcctttcctttggtaactccaattacatgtattaatctgcttaaaatcatcccatagctcactgatgctctgttaacctttttctcctgtctttttcctctctgtatttcattttggataatttgccttgctgtgtcttcaggttcattattcttttcttctattataactaatttgtgttgaattattattatccagtgtatcttgcctctcagatattgtggatttactctagaagcttgatttaacgttatttctgtttctctacttaccatgctcaatcttttctcaactttttgaacttgtgaactatagctatacttactgtttcagtgtacttgtctactcatttcatcatctgttctgtttttgcaccagtttcaattagttgatttttctcttcattatcagtcatattgtcttgccttgtagtattctcttagaaacttccatgccttgttgcttttgattggatgacaaacattgtaaatttttaacatttaagtgctggattttgtgcttgctgttcctttaagtaactcatttatgttacttggaaacagttgaatcttttcaggtgttgcatttaattagaaaggaacagtgtgacattgagtctagggctatcgcaccactgctgaggtgaagtccttctgagtgttcttcctgatgttttctaaattatgacattttctatccaggctagatttttttgtatgttgtagtgttggctcccattattggaaacagaacaagacttgctaagtattaattaaaaagatctcttttgaaagccttgtggagctaccaaagcagccaggacttgagggtccaagagcagtggctgtaagtattggttttaaaaatttataagtaggattgattttaattaaaaacttttaaaaaaatgttgtgtatgttgtttttcagttaaaaattaaacaattcttaagagagatgatttctcttgcctcagggatggtgtggtgtagtgggtgtggccttgtacctgggaactaagaatgtgagttgtgattctttcataagcagcagtatagtctcttgccagtcacttcatagctctggatgggccttagtttctttatatgttctaaaattatgcaattttgtcatattaaaaagtaggtgatcaccacaacatagttaattgacacattttatatatgtaaacttttatgggaagtttttatacatttctcctgtagatcactgaggctaattaatatctggattcttattaatccagtggcattaatctgtggcctaaagtataatttgatgtggtacacatagattcctgtataagtaatttataactaggaaataaaactgtcctttccagacatgagtaaataacaacaacgaatggttgccaaaatgtattgaggggctgtttatgtgccagacactgttcttagagctttatgtattaatatcatttacatctcacagggagataagaaactagttgcaaatcatgcacctagactggtagaactggcattggaattcaagagtttggctccttaggctatacacacataacaaaggagtttgctttgttatacagacccctgcctcactgtttgaatgctatttgcctaatatctgcatagtttatagtttgcaaaaggcactaatatgtatgaataattttattttatcatcacaactctatgaaacagtgtccttacagatgaggaaattgagaatgagcgagtttgcttccgatgtggtaccgcatcgaggaagtgaaagagtctccattcaaaattctactttcgcctccaaatccagtttacttttactgtgccatattttcatggagagggaagtttttcgtaggacaaggaatgctaaatttgttgaaatggttgaaatactttttttcttcttatctaaagcaaatatggtatatgtgaaatatttacacttttttggtttagctacttcttattgatcttttttttttttttttttgagaaagaaccatgctgtgtcaccatgcagcggtgactcactgcaacctccatctgccaggttcaagcgattctcttgcctcagccaccctagaagctggaattacaggtgtgcgccaccatggccggctaatttttgtatttttggtagagacggggttccctttgatggccaggctggtcttgaactcctggcctcaagtgatccgtcttccttggcctcccatagtgctgggcttacaggtgtgagccaccgcgcctggctcttaatgatctttctagtgttagtttagatatgtcttccttgcccaccaagcaccctgcttaaggactaggtcattttcccacttaaaaccctcataagatcatgcagttattttcacaatgaacattcattagccattattcatcactgtattttgaaaagactcaggtaacaaaattaaatttttactgaacctgacacaataggatgcatagttgaagaagtattatgtggaaaatgataaatggataaagaataagtgtcattagcagcataatcttgacacggctgaagagtcaggagtgggatgaaaaatacacttcatttgtaggtgagatacacccttacatgatgagtcataatccacttaatctttttatgtaattactgtaagactctcaaaccatatctctatgtgacaagatatacaagctcagatacagcttaactttttcacagtaaagcagaggcttagggctggtgtagtttctgatatctaactttaaacccttatgagtttgagttgtggttttttttttttttttttttgagacagagagtcttattctgtcacacaggctggagtgcagtggcgtgatctcggctcactgcaacctctgcctcccaggctcaagtggatcctcctacctcagcctcctgagttgctgggactgcaagtgcacaccaccacgcctggctagtttttgtattttttcgtagagacgggtttttaccattttccccaagctggtctcgaactcctgagctcaggtgatcgtcctgcctccacctcccaaagtgctgggattacaggtgtgagccactgcaactggctgtggtgtgtttcacataggtcttttgtcctcttttactttgctagagctgtggaaatgggtggtagcctgtgtgcaggggtcttcatctgcccctcctgccaggtaggagagctgaggcttcacgctctctctggctctccgtgtggcatttgtgagcagcttgatgtatttgacacaagtgtgacagcaaagaagtgtgtgagcagagcagtgtgctgcagggcccagctgtgtggatttatctgtacatcaggctgaggagcagcagttagccagatctgacagtcaaacgtgagctccttctacctgtgctccagagcgcattttaatgttgtgtgtttttactgtggttggcatttgacacaaagaaaattgtcagagctgtttttttcctctcctctttagtgtgctagtctgcaatagttttccaaataaatacttcattgtacatggacaaaagaaggcactttctaaaacaatgccaaaaatcatgttgtcttcatctttatactgaatttcatgtgaggaattagtaggttagatgtttgaattggtaataggtaagacgtttacatagtgcaaaaatcaaaacaatataaaatggaatattttgagtagtcttggctctgccttgctcctttctagtcatttcccacctctattgacagataatcactttaatagtctgtcatttatcctttgtgtttctgtatgcaaatacaagcagagttttgtgccttgctttttacttcccaatatcttctggagagctttttagttcataaacagagagcgtccttgtttttgtttactgttgctttatacttcatcatgtggatgtcctgtagtttattccactgtcccctgtggctggagatttgcattgtttctaatcttattgttttattgagataataatttccatatcataaaattcaccattttaaagtgtacagttcagtggtttttagtgtgattccaagctttttttctacaagtaatgatgtaatgagtatcctcatgcatatattcttctgaacatggtacaagtgtattagaaggataaatcagaagtaggatcactggctcacatgggaaatgcatttgaattttgaaaggagttgactggttaccctctctaagtatggttttgttttgccctcctgacagcagagaatgaaagggcctgtttctcttagtcttgcccatagtgacctcgcttttcataaagcaatcttaatatttgtttttttataaagcagttaagaatttttaattttgatgtttatgagctaccaatttactattgatatctgattgatttcaccgatgtaagcatgaccaaaacttctctttatgtttgtaaatattgttatttaatacttgatcttgtcagttacttcgtaaaattgcaagtactgagtgttggtgttcagagcagatttttatctgtagggtcttaagctggatgattttctggtccccattctctgctgtcatgtagatacaacagtactcacaggattaaaatgaaaattcctagtggaagatcaattatatgctgcttgctctagagtaggaaaaatcttgtcaaattttatccttttgatacagccttataagttacaatgttttatacctgtctgatgctcagttccgaaatgaactgagaagtggtggttgttacaagaatttagctgaagcattaattataagcagaggttcagcctacattggcacttgtcgacctatgggacaggtctgttgctgtttcatctgatttaggtggagtatgtaattacttttgggaatccatgcttttgtgctcctctttatatgtagattagctttactgatggactctcatgaagagatcttaaggtggtgtttgcaaggtggagacatttcaaggtttgagaaatgtgtgtttgaattattcaaggcttaccttttttggcatttataaatattctggcactttgtgtctataaaaaagactaagaattgataaaatattcataggaaaatggaggcttttctgagcttgaagtaaaaattgaggtatagattttgattaaatttatgatggagtggagaaatgtacaagtatggcatggaaatatcattggttctttctatggcccaaataatagttaatactgaaaaatagataaatcaattaaccaatagtgaattatccaaactggtttgtcgattatctgtaatggtgtgtgttacattagtattataactataaaagtatcataatttaggccaggtatggtagctcacttctgtaatcccagcactttgggaggccaaggcgggcagatcatttgaggccaaggcgggcagatcatttgagcccaggggtttgagaccagcctggggaacatactgaggcctcatctctacaaaaaaagtaaaacaaaactagccaggcatggtggcattgcacctttagtcccagctacttgcgaggctgagttgggagaatcatctgagcccaggaagtcaaggctgcagtgagctgtgattgggccactacacttcagcctgtgggacagaatgaaaccctgtctccaaaaaaaaaaaaaatttctttgtttaactggtaagtcaaccttttcgttgtaaatgagaaaacacctatagtcaaaacaaaggctttgactaaataaatataatagaattatgcctaagagtagaatttggttttgtgtctctcagggtcaattggttgctatacttctattccctttctctttcctcacttttaggtaatgatacaaaaaaggtccagaaagaatttgtgttttacccaaaaggaagtttcctctgactactctgattgtgatgggtttgtgagagaaggctgctatttggggtgggagagggtagtatgcagggctgccacatctggttaagtaggttgtgcactttataaagacattgggcattggagcaggtggagcctgaaatccagtttgtgtttaccaagctatattcttattgagtgggactatatcggcccagagcaaagtgtaccgttatctaatttttataaatgtgacttactggctgacagtagctttggtgatgcatttaattgcatttttatttgaaacccagttgtttctgctgtttttgctttctttcttacagataatgtctgttgtatgtacctgtctatgtgtatatgtgtctgtgagtgtatatgcacatttatgccttttatatgccacgtacacacgaaaactccatatattcttgaatgtaaggtcagatattctttgaaaaatatccctcagaaggacggaggtgccctatatgtatctgatttcttataagatactttataatatgagatcgtctttcagttactttgtttgaatagcacagtactgtttggggaaaacatagtctcttgaaacagcctcagacaatgctggctttgagtgcttaaaaaggctgcttcatggaattggaaaagagaagaaacaaagatgtttaacacagatttattaattattgtagagatgatagatcactctaaaaaagcaataccgtaagtggatatgatctcaaataaatgtttacaagatgaataactcttccacatatgctgacattatgcaaatggatacttgtggcttggtttggtatttccagtgatagtaccataaaaggatttacaagctactatgtctcaagcagattatacagacaggcgtttgctctggaaaactgtgttggatgagttgtaagctgactctagtgatgaaaaagacccggttgtcaacaatacatgtgaagagtgaatcaaattgtctcatgaaatgtgagagtgaataaaattatttctaaatttatgcttcataccgtgtgtaatttagtatatatgtaattgactgggtgccatgactcatgcctgtaatcccagcactgtaggaggccaaggtgggaggattgcttgaggccagaagtttgagaccagcctgggcaacatagcgagaccttgtccctactaaaaataaagacaattatccaagcatggtggcaccgctgtagtcccagctacttgggaggatgagatgggaggatcacttgagcccaggagtttgatgttatagtgagttgtgatcacaccactgtattccagccaaggtgacagagcgagactctgtctctaaaagaaaagaaaaaaaaagatgtatgtaatttaattaatatattttataattgagatttgactaatttctatctctaaaagattataaattcaaagttggctaaaatttgtttgtattctcttattggaaaaataagagagtgtcttactttgggttattgcatattcacttatatgtaattattattttcaaacagaaactgaggcttcttgaagagcttgaagacacttggctcccttatctgacccccaaagatgatgaattctatcagcaggtaaggtattttaatatttttatcagtttcagtgatgtgttctgatcaaccttattttacctatgaggaagctgggctagagaggttaaatgacaggtgaaaaggtcaaattagatcacccatgacttctcatggcctacagagcatgtacatttcttcagaatcggctttttgctgtgaatttaatgctttagcatagtgactgtttttatttcctcggacattccacacttccttgcctctgctcatgctgtttcttctgcctagctcctcctccttccttttgctccttatcctgttgcagatggctaattcttcaagagttcagttaaacatcacctcctttgtgaacattttcccagcttaccctacctacaagtcaagttgattgcactcccggtaaataactctataccacctagcacatggtattgcaattacagaattccgtgtctctgtctctgaattagacaccactgtttcaattacaaatgacaaaaacccaaatcaaactcacagtggcaaaaaataaggggaatttattgacttgccttagaagtctaggagtacatggctaaatccaactttacaaaagatgtcacccgatcactgttttttcctatttttcttggcttagctttcctcagtgtgatctcatgctcaataggctctcatctgagagcatagcaggactctgacagcccaaggggtatgtggcctttggcatctgggatcttagaaaaagttagtgagttctttttccctggttccatcaaattatccaggaagtaatcctgttggcctggttggagtcatgtgcttattactgaactagtcatcatgttcaggagagtcaaatgctcctgtttgcccagcctagttcatgcacctactcttggagtggggttggagtgagagtactcccaccaaactgtatgcactatgtgagttagacatgggtggctctcccaaaggaaaatcagagtcctgtttccaaagaaggaagagtaggccctctgggcatgtaaaaataataaattttcacctcttttttcctactacaatgtgaagtcttgaagcagagggttgccgtgaaaatcagaataggaattaggtcacagcatctttgtatctctagcacctgcatgtacatagctgaccatcagtaaccaaggaaggaagagaggaaggaaggactttacccatctagaatccaggtcaatatgatttctgtgacttctagctcaatattatttctaggccactgtctcttatctccattcccatttgatctgcaccatctttcctcttcactgtcagtcctcttataggtctgtctagttttcctctttgccccccttcatccttgaagctatagtattttctaaccaagatgtaaatctgagcatggcaaccctctgcttcaaatcccacatcattgactggctcctacattttcagcctcatctcccctgctcttacaccttttatccacactggatttttgcagtactttaaatttgctatgagtttcatctttggggccttcttgctacgtcctctgctgacgtacctccttctctttatctgtctcttctttttttttattttttgacagaggatctcactctgtcacccagactggaatgcagtggtgtaatctggattcactgcaacctctgccccctgggcccatgcgattctcccacctcagcctcccaagtagctgagaccactggcatgtgccaccacgcctggctaattttttgtatttttgtagagacagggtttcaccatgctgcccagactggtcttgaactcctgagctcaagcgatccacacaccttgggctcacaaagtgctggggttacaggcatgacccaccatgcccagcctgtctcttgtttccttggtgaacttctgtgttacctgttagtaacagctcatatgtcatctcctgtaggaagcttccctgacacctctacaaccagagagttgtctctgcttcctctcatactttatctatacctttatcagcacttaatctcacttaatttttttttttttttgagatagagtctagctgtgttgtgtgcaggctggagtgcagtggcgcgatctgagctcactgcaccctctgcctcctgggttcaagcaagtgcatctggctaatttttatatttttagtagagacatggtttcaccatgttggccaggctggtctcgaactcctgacctcaagtgatttggcgtcccaaagtgctaggattacaggcatgagccatcacatctggcattaatctcacttaattgtaatgaatttttgtgtgtgctggcttcccttatcctctgtacttcgttcagtgccgggtacctatcaggtgctgaatgagtttgcttcaatgcatgcacccaatagttaatttggaaaaccagttatatataataataatgagtttagtatgatttgaattttgcttctacacacgtacacacttccccagggatttggcatctggaaagatttgacagatgtgtacagaaatgtcatactgcatagtgatagggtgggtgttctcttttgaactttcccagttttccagattatctgcagtgaaggtatattcttttgcaatcagggaaaaaataatttttaaaagtacccttaagacaggtaaacccacaaaaatgcaattagttctgaaatgcttactaaattttcatagctataagccttctggtgcatgattacatgcattgtcacaaagcaactgccaagccatttcagcttttgtcgtgtgaaaatggtacaggaagaatgagatacaaaaggttatcagcccactgtgctctgaaccagccatccactgagggataaaaggaaacccaaatgcaaacagaacaactatcaagacttctctgttatctttccaaggcccgcaacaaaccctgatactaatatctaatcactctaagtgcaccttgctgtttttcttttctttttttttttttgagacagcatctcactctgttgcccaggctggagtgcagtggtgcaatatcagctcactgcaacctctgcctcccagattcaagcgattctcctgcctcagcctcctgagtagctgggattacaggcacctgccaccatgcctgcctaatttttgtaagtttagtagagatggggtttcaccatgttggccaggctggtctcaaactcctgacctcacattatccacctgcctcggcctcccaaagtgctgggattagaggtgtgagccactgcgcctggccaaagtacaccttctaggaaggcttagtacttcaataaaaccttagtaaaagtaaacctcttctcttaaaagatgaagtgaaaatactttttaatgacatgagtaaatagaaagttcagacctgacactgggtcccttaaacaggccctcaccacaggaatgccaatccagctgccagtcataaacacaggagtctgttcagcttccattttgggtctgtcgattgatccttacagtgtgctaggctttgtgctacatgttttatgcatgctctcacatgcaatccccacaacagcctcattcattgtattcagcaactacttttcttcaggcttgaggtacttgaggtaggtatttctgttttagaaatcaagagaggaaccaggcacaactgtaagttccacctacttgggaggctgaggtgggaggatcatttgagcccaggaattggagttcagcctgcctctcataacaagattaaaaaaggaggaaatcaggagagactaagttagttatctgagtgggagagctggagttcagcccatatttgtctgactctgaaggcccatgctctttctgctgtattgtccacctcttggtctaccatgctccaattcaaaacaccttcagagaagttttgcagtttcttttaataggaccgtagagaaaagcaaaaccaaaccaccaagggtcaaagcagaaaagcagagagaacttctgttagctcatcatggaacacaaggaaacgaggaattacatagtcagaaaacaaactctgacttccagaaatatgaatgcagccccttttatccaaagaaaatgagaccatcctcagtaacccccttgctgtcactgattgtgtgctagctgtgtgccaggttgttctgctgctactttaagtgcattacacgtgtgagctcactgaaatcttgctatatgcttctgagacaggtgttactaaaaccctattttagagatgaggaaaccgagggacagagaggttcaaaaatttgtttaagacttatgtgcaggatatgttgggactaggatttaagtctgggctgttggcttttgggtctccactcttaagtcctatactgcttctctcttcccttgtgtctcttcatccttctgagataactctgctcttgtctcaaaggttccagacctctgtccccatcccagctctccctgtgacctccagctctccacttccaactgcctacggagtggctctacctgaaagtcttccagctacatctaactcaacatgattcatattcattaagttacttactccattaaacaaatggatttcactccccgactctgtgccaggtactgttttaggcattagaaatgaagttgtgaaaactgacaagagattcgtgtcttctttgagcttatttcttgtggggcaggtgatgtaggagcaagccatgtagatacttgttggaagaatgttctgggcctacagaacagcaaagcctcaggtatacttgacaggaaaagcacccgaggccaacatacctggagcagagggagacagctggtgagagcaggggagacggtcagagagagagagagagagagagagaggcccggttatacgagaacttatagtctgtaagttctgtaagaagagcattggcggttactctgagatgaggaggcatgagaaggcttggagcaaagcgtgacaggatgtcacttacattttaataaggattctttctacaaggctcttcccattcagcctcttctctaacggtatcccctagtcccattcttgagattagaaagctcaccaccctcaacttctatccattgctttcttccctcatttagtcactgggtccctggtggttttacctctttagaatctctcaaattgttttttctttttccatcccacagacactgcctcaactatgtaggccacattgatcactttctgcctccgcagttttagcatcctcctgattagcgttcctcatgccctccccagtgccatcagaactgacttgtacctccttgttttataaattttgttgagtcgcctttgcttccaagatcaagttcaaattcctcagcatatccaccctataaggccattgactttcttgttttttttttttttttttttttttttttttgagacagagtcccgctctgtcacccagactggaatgtagtggtgcggtcttggctcactgtaacctccgcttcccaggttcaagcgattctcctgcctcagcctcccgaatagctgggactacaggcgcgcgtcaccatgcctggccaatttttgtatttttagtagaaacagggtttcgccttgttggccaggctggtctcaaactcctgacctcaagtgatccgcctgcctcggcctcccaaagtgctgggattacaggtgtgagccactgcacccagctgccattgactttctgaccctaaactacctctctggtgtaatctcatcccatggcctaaaatggcgcccaatcataaactctcgtcatagggagttcttggttccaccctgactctgctgtgccctcttatccttccttgcctttgtgcccactagtactctcttcccttttctgtctggtgagcatctactcttaaagactttacttaaacactacatgttctgtgaaggcttcagaaaatcccttctgttctaaaatgtatgaaaaatctgactgcttctcaccacctctgcttcttacaccgtggccaaaactgccatcatctctgttgcaacagcctcctgactggttctgcctccttcccctggtctagtttaacacagcatccggaatgatctttgaaaacataaatcagctcattacactttcttgctcaaagcccttgaatagcttcccatcagcctaggacctgacatgcacccacaaagctctacatgcttgggttcctaactgcttccctcacctcatttcctgcccctgcccactccccaccccccctcacacttttcttcctattctggcactttactcttcctggaataaaccaagctcactcctgccccaaggcctttgcactgaatgttccctcaacctggaactctctcatccccccaggcatctgcagatattgtatccttgtttcttgctttcttctgctctgatgtcactgtatctagaggccttcccttaccaccctgtggaaagtaggcatacttaccccagcactccctatcctactttctcggctttatttttccccgtagacttatcatcatctaaaataccgtatattttacttatttatatgcttattgtctggctcaccttgctaggacatgagcttctagagagaaaatagacgtttcgctctcttccatattctcagcacccaagtgctttgcaaatagtatgtgctcaatacatatgtattcagtacctaagggttttccagcttttccttcccaattattccctgctcccacagcagtatactcacacttctattgtaggacattcttctcttttggtttccattttggtttatactgttaaattatgagatgctgtcaaataggacctatcttcttttaatccttgtatgtctggcactttatacagtgcctggtacataggaagtatttgagaaatgttaaataaacaaaatgaaatgaagtattgaatgaatgaatgaatgaatgaacgaggatctctgtgtcattttgtagcaaagcacatgttacctcaagtcttgtgatagctgtggcagagtctgaacagtgactccagaagtgtatcccttctggagctctagtttgcatcatgcaggcagagtctgggtcagacgagtgtttagcccgttagtcatcggatggctgccaagtcgcaagcattttacaacaaaaattatatagaaaatgagtgatagggtgcaaattgctgagtgcaaaatagaaagtgttaggagcaaaatctattaacagctagattagaaatacagtcctctaaaatcagaatattctagtacttctaagtgaagggtatttcccaagttacttgaatatttaaattttttttttctctctacccaaggttgagttccactgggcttcatttaagtgagcctctggtaaactggtatcttacttgtttaaaaaccatatctgacttccctgtgtgatgaaatctttcagaagcatctcttgatatgggaggaaaaggtagaatttttatataatggcttaaaatagacagaaaatgaagcctgatctccagagagcttagctttccacatctttcagccattgacaaaggcctggcatgctggcattttatatctaaaatacctttccaaatacttattaaactatataatcatcatttatgccacaggatcatttgtgaatctcaagaaatacagtatgtgaccagacaactgctaatataaatttcatgactgcatactcattggaaaaaactctaatgggattaaatgaaaaaaagcctaacatatttgaaaatctgccaacagctgttccaaattattgtgtgatatctgatgttctacatgtacctgtccaaaatggaaagtgaacttatttgtttgacagaatgaattaatattaaattacttaatgttcacttcttctccaaagttacttgttctttttttttttttttaaagaaaaattgaacaaatgcttcatagtacgtttatgtgtcaggcactaatttaattactctataaacaataaaagagggcatttaggttgagatttttttctcttacattttctttgagatagtgacaaaattagccagttattattatttgttttcactgtggtagactgaaaattcctcagtcttgaacaacagatttaaatagtaccagaagttctcttgaagatttttgaccatttagagccatcagaaagaatctcttggcaaatataagaaatgtcatgaaaattaagaatttttttagtgcagcatcttcactctgatttttctgattaaaaatattttacatttatattgggaaatttgaaaataatatagatgtctaaagaagaaaatcaaaatgatgctcaagtacattactcagggataaccaccataaacttttggctatctttttatccaatttttttttttttttctgtgagcttttacatatgtactgtttttcttttaatgaaactgagatctcttgtctatcttgttactaatttcttctatgagtatagtttcctactgacttccaaacagttaagtttgttactttaatattccatcacgtggttgtaccattttcccttctaaacccttcttgggcattttggtggttttcagtttttaattattatcaatagcagtatgatgaatattcttataatcttggtgtgtttaataacttccttatgacaaattcctaaaagtagaataactgcatgaaaagatatgggcatatttaggttctgatagatcttgtccaattggccttaagcaacattgtaataatttgcattcctaattgcacgctatcagaatattgaattttgccattatcaacaatatgtattactattataaaatgttttaatgcaaatttgatagacagtaactaatttaagtataatacaaattatatattttccaactttgatacagttaatatttatttatttatctatctttgaaatggggtctcactctgtggcccaggcttaggctcacttcagcttccacttcctgggctcaagccatccttccacctcagctgcccaagtagctgggaccacaggtgcatgccaccacacctggctaatttttttgtattgttagtagagaggggatttcaccttgttgcccaggctagtctcgagctcgtcagctcaagcaatacacccgcctgagtctcccaaagtgctgggattacaggtgtgagccaccacgcccaggcagttaatttttttatgtgctaagaggcttctctattaatttgcttgtgaatgggtgtgtgtgtgtgtatttaaatttttaatggttctgcattaatgtttctgcattcctgccatataggttgtactttttttttccagtttgtttgccttttaattttatgatttattttatacaaaaatttaaattttcagatattcacatctatcaatcttctttttcaaaaagtttattgattaactgtatatgtgtataatttacataccataaaatgcacgttttgaaattgtacaattcagtgatttttggtaaatttccagaggcatacaaccatcatcacagtagttttagaacatttttagcaccccaaaaagatctctcatgcctctttacatttagttttctttcctgccccagccaagatctccactcatctgcttcagtcttttaaagcttttattcttagaaaggagtcttgagcacttatgtggaaccaagtgatgtggctataacagatactaatgctattttcttcttcttctttttttttttttttgagatggagtcttgctctgtcacccaggctggagtgcagtggtgtgatctcggctcactgtaacctctacctcccgggttcaggtgattctcctgcttcagcctcctgagtagctgggattacagatgcccgccaccacgcccagctagtttttgtatttttagtagaaacagggttttaccttgttggccaggttggtctcgagctcctgacatcagatgatccagctgcctcggcctcccaaagtgctgggattacaggtgtaagccaccgctccaggccactagtactatcttcttttaggagcttgtgatcttacaggacagattattaaactaataatagtttaaataaatatagttacaaatagataagtgctacaaaagagaagtaaagcgtggggagtgataacagagggcacctatttgagggtggagattcaggaaaggtttcctttttttttttattatactttaagttttagggtacatgtgcacattgtgcaggttagttacatatgtatacatgtgccatgctggtgcgctgcacccactaactcatcatctagctttaggtatatctcctgatgctatccctccccctccccccaccccacaacagtccccagagtgtaatattccccttcctgtgtccatgtgatctcattgttcaattcccacctatgagtgagaatatgcggtgtttggttttttgttcttgcgatagtttactgagaatgatgatttccagtttcatccatgtccaggaaaggtttctataagaaaatgacccagggatgggaaggaccatccaggtgtggagttgggggaggagcctgggggaagtatttaagagctggacacttgaggactgcaggaatagaagcacatatggtcagagagaaaggggacatgatctgagtgggaaaaaaatggaatattttcccatgccattattttctttttatgctgttttttatgtcaaggtatttacagatgatatttatgtggttatatgtttttcctggtctatagggttataatttccccatattaaatatatcttatgcagtgttgagacccagtgtatgttgaataagggcagcagaattttaatggggggtgggcaggcgtttgtgcatatgagtgcattattttcagtattcctttcttagtcccagaggggagtgtgttcagaaacagagttcttgggaattaccatacttttctttattgttttatactaaggaccattcagagagtactggaggtgttaagacagtgtgaagaaattaccttcttcatcacttcttcatcattgctttgagtatactggggcctcagggacttgctaagaaagtaaccagtatagtgatagaattagagttgctgctcatggcttcagaatatttggtctctgcttacaggattgcattgctttcttcataagctatgtaaatagaaagtacgatatcactgtttctgttttccaatggggataactaaaatatggaaactcaatccttaatggatccctgacaatctcaatgacaatccatagtggtatgccacatgactcttctctttgtcactttcaattcatggtcaacacctcagataggcattttgagaagcagggcagtcctaccacacttacctagtaaagtcattttttcacattcagacttgactcattcatttttcttctgcatacttcctcccactttctgcatgtcttctataatatctcctgcactctgcctcattcagaacaggctagattatgctatagtaactgataactctcaaatctcagtggctccacacaataatatttcttgtccattttatgtatcatttgtgggttggcacagagtcactacccattaaagtagctcagagatccaagcagccaccagctggttgctgtggcagaggggtgcagagtatgctggagggtcttgcagtgacaatgacatgttccaggctggaagggatggccatcatttttcactggacagaagtaatcccatgtttcatccatcctgaggggaccaggaagtgtaattttacactgggcccaaaaagctgggtggcagaggaggaatccagaactatttggcaaacagctctaatgaccagcatacattcttagctagtgattcaccttaacttcattgagaaagtcagagcattctctaactaccacccctccaaaagaaaccctagaacgtactcatctgcctactattattacatttatcatcctatctgaattcataccttctttttccttctagcctattccaatataagaagtatcttctctcctatccacatatttttgatcacatactcttatcagtagataagcacatacagtgacatcctagaaagtgtttaacaagtggcctgtagggggaaagaaccagccttgatttttagtgttttttgatttccgcagtgtaaatactctcactgtggacagtttcaagccaccgtcacggtgttactgaatgtgcagttggaaagagatgcacacagtgggctctcatgagccagtgtggactgactccagcacaccaccagtagtgtgctggtggtagtactcatgtactcgtgtctgttttataataatattcatattaaacctatttgtgtgtatatgtgtgtgtgtatatatatatatgcatacatattttaataatgcttgagttctttcattttatattaaaaataaagcagttctacctctcccctgtgccccaccactcttccagatggccttacaaagccttgcatacctgacttgggggctactgctctagacactcaaggtctcgacttctttggttattcactctctctgcatcgtcagcctctttctcttgtatcattctcatgagtgtactgagaaactctggtgttctctagcgtcttccatcattagagattgtcccttagtctagccttcttctttatcaaaagctccatttttctactccccttcatagcagaaccattcagagacatctctacatgccatctcacttcctcctctttcattccatcttcgcctactccaatctgactttcacccccagcactctactgagattgctcgtgtcattgccatcagtgattttcatgctgccaaatctactggatcatctgtcttcatctcacttggcctctcagtgtcaggtgacatagttgagtaccccgcccttctagaaatgctctcctcttttagcttctgcaataatacactctgctggttctcctttgttgaggcttctgctgcgactcaggaaatagctttggtctccttttgatatttgtactgtttccctaggtgatctcattcatttctaggcctttaaaaccaagctgtgtgctgatcactcccacattgcgttcctctgccctgctttctcttctgagctccagatgtgtacatccaattcccctccccccgcccaccatattttcacctggaggtttcataggtatcttcaaggctgcagctctacagtgaactcttcatttcccccttttcttctttctactatttctcttttgcctcagttttccttatttcacagaatagtaaattgtttatttagttgttaaatccagaaatctggaatgtattcttaacttctatcctgagcaacagggagaaaccccgtctctactaaaaatacaaaattagccaggtgtggtggcgcatgcctgtaatctcagctactcgggcggctgaggcaggagaatcacttgaacccaggagtggaggttgcagtgagccaagatcatgccattgcactctagcctgggcaacaagagcgaaacgccatctcaaaaaaacccaaaaaaccccaaaagacttatatctttttttatcccttacatctaattcataagcacatcctttagttctacctacaacgtatgtatttcatctgtccacttatctttgtctctattttagtccagaccatcacttttcttccagatgattgtaatagcacattccacgctcacatgtgcctctttccaatctgtgcctgatattataactaagagcgattgtataagatgtaaatcaagttatttttctcccttctacatcctccagtgcatctagagttagcttcagattccttaccacgacctctagggctatgtgtgatctggcctccgccttcctctgcctcctcgtagcatgccactctgtctttggctcttgtgctctagtaaaacaagcctttttttgtccctagaataggttggtctttttcctgagtgcctttggcttctctggtctgtctttctgggaagcactttctctggcttgtcatatttctggtgccttcttttcctgaagatctcagcttaaatcccgtctccttagagaattcttcctgttctaataagatttcctgctggtttgtttctgtcttagtacttaacacaatttggggttgcttttctttatttatttacttgatttggtagaaagctttgtgagaacagggaccttgtttccatctggtggtaggtgctcaataaacagatgctgcatgaaaaaaaaaacgtttggaagaatactggtcttgccctgcctatcatgtgaatggtaattactaaatgaagacagagaaggaaggtatcttaacaatggtgggcaacacaatacagggaggacaggttaatgtgttgatcatgtctgactctttctttaagacagcctaaaactagggaggaacaaatcagatcaaacgttacagaggtaaatgtaaaatcctgtgatttggttacaaataaatcagttgcattttacagaatcaggaaactccagtctgacaccgattcacatgccaagtcctaaggaaagtggtagccgaaaagctaatgcagccctaacctacattaatcattccatgtatttctgtattagggaagggaattgaccaatattactctcctccagtgacaccagtagaattattagaattttgtagaattacaatgtaataatacctcattcatccatgcacaaatccatttattcattcctttaccatttactgagtaaattctgggcactcatattatagtcatgagcaaaattgccatggcttttgtgttcatggaacttaatgtctaactcctgaagagaagtgagttctctttttgtgaaagtgttaagcagaaaccagtttgtcatttattgagacaatgcattctcatggttaagaactcgtgccctggaagccaggggttggtgtccaggggctttaaattccagctccagtatttgccagctgtgtgactttgggcaaattaatgtctttggtcagattaatgtctctgtgtttcagtggtctcatctataaactggagataataatactatgcctagagttaaaatgagctaatgcacacaagtaacttacaacagtacctggtacgtagtaagcacttaataaatattttagataataagcagttaataaaatggtgttgagatttagggtgagaaaaagtggtcacagaataatcctggtgtatcaggacacacattattattttttgttttttattaaagattgttagtaatttgagcttgaacttgaaaatcttgactttagagtttgatgacatttgttttatttggttttctgttttgggctaggaagatgtgactcctatttagaaatagccaccaggtagtccccccacaactccccaaatgcttacaaagaaacacacctttggaaataatacaattgtagctatatatcaacgtctgtttttgctttggttttgttttagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggtacagtctgctcttggaaaaagcagccctgtatgtaataatatgacccgagttgtttaggctctggagatacacacgcatatacatgaacatgtttgcatgtgtgcttgcgtgtgtacatgcacatgcgtgtgtgtgtatcatgtgtcctttttagtcttgtcacacctgtatgtctgcagaatatgcctctttctcatctggccatgctagctggctcattgttatactgtactcagaatattttcgcacgtaagcactgctgtcatttgtctctcttgtgcccaggagagcagcctcttggtttcatacagccgactgtcttctctacagctcagaggagattgtacagttgctataattaacttgctgataaagagctgggaaaacaaaaatctgtcaaatctttccaggttcccacaggtgcacatttccagacctgccaaaatattttattatggttgacatcactatcttgatgggtgtgatttgtcaaatatggacttgttcttggcttcctatagtttgtaactactgtccttccttgccagaagcagttgaggtaggttttgtaagcagacagtcctctattttcaggaaactccctagctctttacccaattctgcagttttagaccttgttgggtggctgtggtagacttgttcttgcattttctgatgtataatccccttgaaacagatcgtaggctacctcttagtagcccacccacatttctcttcttctattattgtttctgtgtgtttatggccctcatttttccttagaatagaattacaaaaatggtagttgaacagatggaggagagcatgacctctgttgactttcttttgtgtctgattatttggcaaagggatacaagacatagtattagctctcctgtctgatttactgaaagatgtttggaaaaccagaattctggatatcccatcagggaatgactggaactttccagggtcattattttctgacaactctagttatttgattggatttttgtttgttgttgttatttgtttactaaaattactgttttggaaaagagatttaagaaaaaaaagatctttaaagtactctttaaatttcttacaatttcccagtctcaaaaatttcctcagaactactaatattttttctaactttatcttatgtcttcagtctgaaacaaggaactagtttagcatttggaaatttcaccactttctctggcatctcaaataatgatgctgacctaagaaaatcgcttgaagggatttaacgctgtcctaatggaaagaacggagatcctctgatctttaataaggacttgccagggatttaagaactatcacatccaagaactctgatgtgaacgaacaatggagttagtttctttcttaaggagacaactctccaaacctgaagcagtggtatgtgatagtacaaagctctacaaagatgtctttgtgctcccaattactctgagccctccagtttaatagtcctattgtactcccttcccgtgggtgatcaagtagtttttgaaacctagaatatctttcagaaaggaatttaaatgtctaatgaatagtttctatgctcaggagtaattaagactgacaaagtatacaaatataaattacatataaatatagaaatgttggtacttaaagagggaactgtagaatttgaatctgtaagagcggtgtgcaaactcctttgttctcttttttttctttttttcttttgagacggggtctcgctctgtcgcccaggctggagtgcagtggtgcgatctccactcactgcaagctccgcctcccaggttcacgccattcttctgcctcagcctcccaagtagctggggctacaggcgcccgccaccacgcccggctaattttttgtatttttagtagagacggggtttcaccgtggtctcaatcttctgatctcatgatccgcccacctcggcctcccaaagtgctgggattacaggcttgagccaccatgcccggcctcctttgttctcttaactgcagaaattctcagaactccatctaataataatagcaatactgggaatgctcatttattgagcacctactacgtgctacatgctgttataagcattttacatgcattaactcattttgtcttcccaacaattcaaagaacaaaatagtaatgaagtactattgctatcctcattttacagatgaggaaactgagtcacagaaggttgattaacttgttcatggtgatgcagcaagtaattagcagagttaggatttgaggacaaatatccaggcttcagaatcttaacacctaaggctatgtgcattatgagcaggtatttcttatcccagcagtgtagccgtctcagggattttattttattattttacttttttaattttttgagacagagtgttgctctatctcccaggccggagtgcagtggcacgatctcggctcactgcaacctccgcctcctgggttcaagtgattctcctgcctcagcttcccgagtagctgggattacaggcatgcaccactactcccagctaattttttataattttagtagagacggggtttcaccatgctagccaggctggtctcaaactcctgacctcgtgatctgcatgccttggtctcccaaagtgctgagattacaggtgtgagccactgcgcctggccagggacttggatttttaaaatgtccaccttctggaaaggttaaggggacattccacttgctttttctttcaggtcctggtgtcttcctttctccagctttacttctcacccacatctgctgtagctttccagcacatactctcagatgattggaatgcatcagattatcttattcgatgaaacagaacctttctgtaggtgtctggctgtgtgtcagacggcatacaaagcatgtggctctgggtcagatggtgtacaaagcatgtgccttgaaactctatggtgggcgcatgtcttctaagtgacaagtgatatctgtttagttttctggtcttataatccttggcagaatgccagaactatggcaaaggtggacttgaagagaatcatttggtttaaaattttggttgaggttgagaagggcttaaggaggtcatagagagtggacacttcagagaattgtatttttttctgtgtccttgaacttgtttgtcaatgagctgttctagacagtatgggaactccaaagataaatcaatggctttctcactttgaggtaatagggaggtaataggtgggctctcgtgattataattatgaaatgatgaaacattgggtttgaaagagacttttgaaatcacttgattctagcctttcattttacaaatgaaaacaccgagaagggaagtggcttggccaaggtcacattgctacttagtgataagagcagggatttaagttggaaagtgttccttgccactggagaggttcacgtaaaatgcactgggaattcagatacagaagtgattgcttcctgctgaaattaaattcagttgaagcttaagatctttcaagactctgctctcaataccttttcccagggaaatcttcttgtagatttataatgagccagtcatccctctttggtttattttcatgagtagaggtcattgagaagtaatttgtataggatacgtgtaattatatactaaattcattggctttcacatgccgttctagttaatagatatctccagtaggaagattgaaatggtacaatttttaatcaggaatggcttcggggaaccatatgtaaataggcagaatatttgattttcctattccagctttgctggcaattgcttgttactcctagctataaaaaacgaactttagcggggaaggcattaaaaacccaatgtttaatatggtccagcaccttgttctttgactggaacaccttcagaaacatcacttagatcaacagtaactattggctaccatttttgtttctttgtctggaaggaaacattttctgtgaaattgtctttctagaaagaaaagcaattcttaagattttaaactagtgccaagtattgcatattcttgacattattttccagacctcccacaaggagccaggaaggcagctgggcgcggaggctcacaactgtaatcccagcactttgggagaccaaggcaggtggatcacaaggtcaggagttcaagaccagcctggccaacatggtgaaaccttgtctcttagaaatagaaaaataagctgggcatggtggtgcgcacctgtagtcccagctactcgggaggctgaggcagtagaattgcttgaacctgggaggcagaggttgcagtgagctgagattgcgccactgtactccagcccgggcgacagagtgagattccgtctcaaaacaaacaaagaaacaaacaaaaatccaaaacccaggaaggctcacaaaaggaagaaaccgatccatgtttcctgttgagcatgtgataggctggaaagtagagactttgcaataatgttcttggaattctaggatttccattcatgtctttgatttgggaaaaattgcatccccttaaggatggaaatttgttcccgtaattcttgaatctctattttaacatgacttgctctatatttctcagctcatcactgagaccatgaaaagctagtttataattacagcttggagttttggagtattcataaaaacgctgtgatgtttaatgttatcttagcgtcccagcatccctgtctaaaatctcaaagcttatttgacctagcttttttttattgtatcatgctatgccttgtcagtgatttttgaaatcacttatactgctcagtaaaacttgtttggtcttataagtcacatttttgggggtgaccatccagttatttattcatctaacaataaggtctcccatgaagagccaagaaggctcacaagaagaccaaagggggggaaaaaacttatttgatctacaaagttacatttttttcatgcctatgcaattattttttcatttaacaataagcatctactatttgctagtcagttgtctagatgctgagcatgtatcagtgaacaaaacagacaaaaatccctgccctcatcaagctcacattctagcaagggaaaacagaaaataaaagtagattgtgtaacaagggtgagggataatcttacaattttaggtaggagagccaggcaaggccttgttaaaggggtaacatttaagcagattggacggagagaatgagccactgagaaatttgaagcgggagcacataggcgggaagatagaacatgattgggatgtttcagaagcaacaagtgtggatggaatagagtgagagaagaggaaatgaaatgaagacaaagggacaagtaaatgggtggcagaaggtagggctttgtcatgttagaatacaaagtagtaggtttggatttggagtgagatggggagccactgaggagtagaagaagggaagcaacaccagaaacaggagagctcacagaggtgaccaaagtaatccagactagggatatgatggtccagatcagaagaggcagagcaggggagaaatgtgtaaatacagtcctgtaactttttaccaacaaagagagtggcagtgtttcagcaccagtgagaaaggataaccagcagtggcatctcccatttgtcaagagaaggctaagcctgtaagaatggctacattttctcccctctgtgaatggctttattcgggaataactgacatacaataagctatacatattgaacatttatagttttataagtttcaacacacctgtgaaactatccccactatcaagataatgaacatacccattattccagaagtttccttgtgcccctttgcaattcctcttcctgacatatctgttttctttttttattgttttttatttgtttgtagagactgggtctcaatatgtttcccaggctgatcttgaaatcctggcctgaagagatcctccttgctcagcctcccaaagagctggaattacaggtgtgagccactgtgtcagcctggatttgttttctgtcactagatgagttggcattttctagaattttaaccagatggaattatatatgtgcacggtttttttgtctggattctttaacttagcatagttattttgagattcatccatgttgttatgtatatcagtagctcattcccttgtatccttttttatttcaataaaatatacataaaattaatcattataaccatattaactgtacagttgagtggcattaagcatcatcccacaccaaatctctgtacccatttaaacaattactccccatttctccttccctcatttcctggtaaccactgttctgctttctgtctgtattatatttgactattctaggtacctcatgtaagtggaatcatacaatatttgaccttttgtgtctagattattgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgtaagtccaattaatcctctttttgtttccggtttcggatatgtctttatgagcagcatgaaaacaaactaatacaactattttacttaacatagtgtcctcaagattcatccatgttatggcatgtatcagaatttaattcctttttaaagatgactaatattccattgtatgaatataccacattttgttgattgattcatccatcggctattcataatagccatcttttggctatggtggataaagttgctgtgaacaaatatctctgtatacaaatatctgtgggaatctccgctttcagtacttttgtgtgtatactttttttgtgtatatacttttgtgtatgtacttttgcgtaggattgctggatcaaatgataggtctatgttgacatttttgaggaactgctgtactgttttctacagcgactgaactgttttatattctcgctggcaatgcgcaagggctctaatttctccacatctacgccaacacttactgtttcctgttttttgataacagccatcataatgggtatgaagtggtatctccttgtggttttgatacacattttcctaataattaatgatgttgaacatcttttcatgttcttagccatttatatatcttctttggagacatgtctattcaagttgtttgcccatttttgaatttggctggtttttagttgttgagttttgtgagttccttatgtattctagatattaattccttatcagatatatgacttgcaatattttcttcaaggatagctgaactttttttttttattttttttgagacggagtctcggtctgtcacccaggctggagtgcagtggcgcgatctcagctccctgcaagctccacctcccaggttcacgccattctcctgtctcagccccctgagtagctgggactacaggcgcccaccaccacacccggcaaattttttgtatttttagtagaggtggagttttaccatgttagccaggatggtcttgatctcctgaccttgtgatccacctgtctcggcctcccaaagtgctgggattataggcgtgagccaccgcgcccggcctgaacttttgatgatatattaatgtgatgagcacgggatcagagaacagtggaatagactttactgtccatgacattgatgaggcacttaaattctatactactgaatgacatcattcatattggtattaattagctatgggaccttaagcaagttacttaaattctttgtgactcagttttctcatctgtaaaatagtgatcagagctgtatccacctcaagattgtgagaattaaacacttgtaaagtgccaagaacataacagcagtaattagcacatagtaagcattcaatactgtgttatttttagtttttatcaaaattattcattcatatcatttttacaagtcaaatatttttataaggtttgctaaggaaaaaaaagcaggagtttttacaccttttcttcccattttcatttccacaggcaatcatttctactcttttctttcaggtaatgcttttggtagttgataacatacttacattgttttgaacattatatattggcttcctgatatggaaggtgaagatttacctagctctcttctttctccctgcctgcctacacatgtacacgcttctgattcccattatagatttactgtaattttgattatatcactattcagcctttatagttatcatatatatacatgagaatgccttccaaaacctgtgatctgttatccttttcttttcaacttttttcttgcattaatggtagtcttgctttttgtgtatttgtatagttttctatgtagttatgactaattaaatcccttgctatctaccacatctcctcttaagagcttcagaaccatcagatattctgtccatttcattttcttggagcactgtcttccagagtcttcttgtctgctccaatctggtgttctatgcctgatgcatggggatccctttctgtgacctcttcattgtaatccagcggattcctttacttctctcttttgtgaactcctcacgttcctgcatcctggccttgctctttcctgactgttttcttattttggtggagcatgtcctacaatgttttcttcagaaagatgcttaggaggtaaatttttaagaccttaaatgtcttcaatcatctttattccaccttggtatatgtaggttcttccagtatgaaaaccttgttaggaaataatattttttttcagaatcgtagtgacattgcattactgtcttttatcttacagtgttcattttaagagttctgaatttttcttcagcttttatgtcgctttttttgttggatctttttttgaatgttttacaatttcacagtgatatttttcactcattttactgtcattgtgtagggctttcaatcatgcccttcagttgttggacattttcttgaattgctttgttagttatttcttcctctccagttttctcatctctttggaatccatatgatttagttaaccttctggactcttcctctagttttcttgtttattcccttattttcaatctttatgtttgttttttagtctaatatctgggagattttattaacttccaacctgtctattgattttttttttttttttgagatggagttttgctcttgtcacccaggctggtgtgcaatggcacaatctcagttcactgcaacctctgcctcccaggttcaagtgattcttctgccacagcctcctgagtagctgggattacaggcgcgggccaccatgcccagcaaatttttgtatttttagtagagacaaggtttcaccatattggccaggctggtctcgaattcctgacttcaggtgatctgcccgcctcagcttcccaaagtgctgagattacaggcatgagccactgcgcctggcctgtctgttgaattttcagtattgaaatatgacatatatcataaacatacagcttgaagaattgctgtaaacatatctgtgtacctagcaccctggtcaagaaatgaaacatatcagcgtcctagaagtgctcccttccagtgtctgcttccccacaacagtaaacactctcctgacttctaaggccataaatagttttatgtgtgtttgaattagacttgtaaacttgtaagctcctaaaagaagtaatttgtgtcttcatccttctttgtatccgtatatagtggcaaatgagtattttttgccccaaatctgttaagtatttgttgttcttgaggagcttgtactattcagttacattgtggccactgttcagtaactctttgatttctgcaactgcagtctctgtttagtaataggattcttttgatagcaaataataattccagacccaaagaggcttaatttaaaaaggtaaggaattctctcacttcatcctaagaactggcgtctcactggcttcaagtggaccttgttccaacagtaatgatgtgatcagtttcaaatttcttccccttcctcttttggccattctaaagctcatggcccccaaatgactgcccccagcttttgtggccactctctctttctttttcctgagctttggggaggagagaaactgggtattgggtgtgtactttgaactctggatcaagctttacctgaagctagatgaacaaataatgaccctcttttgattaacccagttcggttctggtttctgtgttatttacaacgtaagggtttcctgtgagtctccacaactctctttataccttcctgaggttacccaaggaattgaaacctctactgttagaagctctggtttggagaatattgtttgagaagtatctctgcttccttacctgatttcatattttacttcagataatatagtgattttgaagctttagctaatggcccgcatagcagtttttctctccttttcatactttcaatttttctcccaagtccgtgaaacatgatgtaatgaggttctcctctgtaatgtaaatatttttatcttaaattttttccccaaatgcttaatctgaaagctgacagagccagacatgatgttgaagggctttagatttttctgtaaagagttttcaatatttcacctgaaatcctagaaaacttataattaattttacaatttatctgtgtcaagggactatgtttgtcttgaattgcttgtttcgaggcatctgagagcggcttcttgttatagattctgagctgggaatgattagtttgtttttttttctcaccccttcagacttttctaaattctccattttttcagaccattcattgctccgtggctgagaaggagtatgtgctgtgtcagcagcaagcttttcttgcaacccgtcaaggaaagcatttctaaactctagaactctggcagggaggcttctccttggctaatctttctttcctagtgatgtagtccatcagctgtgtttcctaaatgctctctggcttatacagtacccatttgttgctacgctgggaacgtgtctagaaaaagtgtagtaattatgcacgaagaagctggtaccttctagagagatcattctgaaaacagatctgactggtgaaaaaggctttagtgtctgtcagtagtctcagtgtaagttctagattctttcctatggttcataaacccatgtcctggtctccacccacctctccaggctcttctcttgcaagtccatgccattcatgtgacactattgcagctgggaattgattgtgctcttatacacacaccatgccatttccctcctagaatgtgccttccctatgtcacactttccccttttgccttctgtctcctttcgttctacaaaatggatttcccatcccagacatgggaatgtcgaagatcagcactggacagatgaggcatcattagactccatggtaccagctggccatctacaacttgtgagtttctcctgcctcaagatctgtgacatggatagcaagggaccagccttttaaagctcctccaggtgtggagttaaggaaacagaggaagtaatcacaagggtgggaatcttcttttttgagatggagtcttgctctgtcacccaggctagagtgcagtggcactatcttggcttactgcaacctctgcctcccaggttcaagtgattctcctgcctcagccttctgagtagctgggattacaggcatgtgccaccacacccggctaatttttgtatttttagtagagacgggatttcaccatgttggccaggctggtcttgaactcctgacttcaagtggtctgcctgcctcagcctcccaaagtgctgggattacaagtgtgaaccaccacaccaagctgagaatcttttgtatcttagctcttggctaaggaaatagaaagtagagaataagaaatagggctgtttttaacaaaaaattagccacgtgtggtggcacatgcctgtaatccccaccactcaggaggctgagacaggagaatcacttggacctgggaggtggaggttgcagtgagccaagatcacgacactgcactccagcctgggcaacagagcgagactctagtctcaaaaagaaagaaagagggctatttaaatgtatggtgatgatgaatatgtactgaacctgtgagggaagttcttgacatacactattatgtatgttattaaatatggtacaaaattttttgtgatatattttatttgagtatcactgtaatctctactgtcatactctggcttctgtctttgtttcctgtagagccgtggttataattagaaatgtaaacaaagtattttgtgctttattaaatagaattttttctcaaaaactagctggcataaaacattgaatgggttaattttggggggaagttttggacaatttaaacttgacttttaaacttaacagtcttttgtatgttgtcacatcttctacttatttaacagtttggttagtgggagctgggagctgggagtgcaccaaacacactgaggtacttaaaatcttttcaattttattgaggcttaaaggcaagtaagaacctgttgcctctgcttgttgccaaaataacatggggcaagagtaatcagttacagttgctataggtaattacaagttgatttcactgagaagtaagaacactatatttaacaataaaaagtttatcagacgtgaaactttcctcctccctacacagcctaaggaggggaaaaactctcaccaaactatcattttactgagcagatttcaaaggtgttggatttttgggagacatcgagaaagactaattgcaattattgtctctaattgtctttattgatgccagcttgagaagagtaccaggatgaaagttagaagggaaagtagtcaagcagactgttaccctatgaagattcccacttattagactgtccacacgcagtggcattaaaacttcataaaaactgttccttacagtttgaaaattatttttttcaagtcattataattggttttctttttttttatttatttatttatttatttatttatttatttatttatttattttaaggtgcagtgtcactatgtcaccaggctggagtgcagtggcgcgatctcggctcactgcaacctctgcctcctggattcaagcgattctcctgcctcagcctcctgagtagctgggattacaggcacgcaccaccacacccagctaatttttgcatttttagtagagatggggtttcaccatgttggccaggatggtctcaatctcctgacctcgtgatccacccacctcagcctcccaatgtgctgggattacaggtgtgagccaccacacctgggcctttttatttctttttaattttgtgtggacttcaatggtagaagttatagttgatttgaccagaaagggacatgtgaaaaaccttcctaaaatatttcctttttttttcttgtgctgtttgctctatctgtaatcattagtgcccccctagaatgaagcagccaagtcttgggttatcacaaatataaacataatttttatatcatattcttttgctaaggtgatctggatatcaattaatttagcattaattattatactgtatgctgtcattagtcatgttacattattaggtattagtcacattacatcataattattttatgcagcctcaacttctttactaaaatgtgcagtagacatcagatcacaaatatcaagactttcgaacaggtgttggcaaattttttttgtaaagggccagaaacaagtacttttggctttgtgggttttatagtctgtgtcttatctactcaaccttgctgtctgtgtgaaagcagccatttatgtaaatgaatgggcatgactgtgttctagttaaactttattttgcaaaagcaggtcacgggactgatttgcctgtgatctctgcaacccagctcttgagtaagggtcacagactttgctgtggttaggcaggtacctcaaatgagtaaagtgaagtggctgtggggactgcgactagcaaaggtcacgtccttgtctaaaatgggcagctacttcttccctatagccactgtgactggctcagtgataccagatcttgtaattcaagggtagctgggaatttggatttttaggcaaagtccttttatcagttggcaactcatttagatttgttaaggaaatatggttgaggtcaagctacacaccttcgtgagttcttttctggtccatgaactccagtttagcaaattctggtattttcaagtgtaacagtatattatgtatgaataagaagtgcctgtagaatgtcatcagacatcgatagcaactatctaatgctggtgctgccactcactaacccttgtagtgcccatgacagacatcagtaattgatcataacactctttcctgctgagctaggagaaagtttcagatttcttctccactagggctctaaaaagccgcaaccagccaatcagtcatgtcccctgatataaaggtatttatcattctcattctagaaggtttataaaaaatgtttttttaattaacctaggaaatggctttggacttttattgttattctgttaaaaaaacctaattaaaagatgttcttaattaaaaagtactggagaaaacatgtattagaatggcaggtatgaaaaaaggtaagatactgttaatatggcagtgttagatttcagaccaaacttaggggaaagagtatccaaagtcagatgtatccttaaaagtcacttagcagcattccttccttgcagagaccatgaacttggctttctgatgtgttcattttcaccatgcctagtgcaaattaatgtgaatgaatagttacaaaggggagtttctttttttccttcctttcactgcctttgacccttctgcacatttggcggtagagtacgacattcagaatttagggattctgtgtgtgccatctgggatgcatgtattttttaaattgtttatgtgatatatacatgatacagcccagggaaaacatgctttattgtgcattttgaaagctttgcatctttttgtcttcctgcattacttctcattttaccctctgccagtctaaacactgttgtctttcacgtttgaccttctctaagagttctgctctagttctgtcgttgaacctctctcctctctaaacttctttagtactgaggactgtactagtttagcagcaatgccatgctttcttatgtcctttggttgtaaatttgaggcatttttgtttttttcttccaaattaacattttctttccctgccatctagcacaaggactgtgaatggagtgaactaaaagaacattttgtttaagcaagccatggtgttcattgaatgccttctctgtgccagtcactagggctataattgtggatgaaatagaaaaacagactctgccctggaagatcagagtctagtacagcagtttaaagtgtgatggaatttcaatttaaaatgtccccttcatggtaatcagtgatgcacatttacagctccactaaaaggagaagctccagtggggcatagctctttgtttcagtcactgacatatcccacatgcctggtgcaatgaccagtaaatagtaagtgctcaataaataattattaaattaacttttaaaagtttttatgtagagttattcctgcagggctgtgattataggcaaatcatagtgtgtataccttctaccttttttagtgtatctcccactcttgtaccccagaaaaactagtcttgagtatccttccagaaatgttgtattccagtcttgtgtatccttccagaagtattataaatattatattattatccttccagaaaaatcagtcttgagtatccttccagaaatactatatgtgcttgatatttatttatttatatttattttgaggcagggcctcactctgttgcccagaatggagtgcactggtgctatcacaactcactgcagcctccacctcccaggctccagcaatcctcccacctcagcctcctgagtagctggagccacaggcacgtgccaccatgccccactcatttcttttactttttgtagaggtagggtttcaccatgttgtcctggctggcctcgaacttctgagctcaagcaatcttcctcccttggcctcccaaagtgctgggattagaggtgtgagccactgcgcccagtctgtactttgttttctatatgagtatagcctatttatttttttctctgaaaatatattagatagttccatatctgtatatagtcatattatttttggtgactacatagtattttattgtctggagagatcataatttatttaaccagaaacctactgatgaacatttgagtaatttctgatcttttgctcttacaagcaatactacaataaatatacttgctcaacagtcattttacaacccctgaatgtaggacttttagtatacattcttaaaagtgtaatttctataagagtcaaagagcttatgcgtttgtaattttgatagtattgccaaattgtcctctacagagagtgtgagtgtgccattttactgtactcttactaacactgtgttgttttcaaactgatgttttctgttttgataggtgaaaaaatttctctcttttggctttaacatgcatttcttttatgtgaataaattggaacatatttttatatgtttatgagctagttttatttccttttatgtattgtgcctttataacatgctcagttttaaatttgtctattggcctttatcttactgatgtatagttgctctttatatatttagaaaaacattccttggctgttcttgcttgtttatatttccatgtgtattatagaaacagcttttctagttactaaccccattcatctaaaaaatgatccctttggtctttttatttatattatgtccaatttctagatgaatttagaaagtactgacatttctgtgatgttcagtcttatttcctaagaacataatttctctttacatctgttttttatttttaaaaagtaatttttttttttaatagagatgggggtcttgatttcttgcccaggctggtcttgaatgcccgactttaagtgatctaccaccttggtctcccaaagtgctgggattataggcgtgagcctctacacctggcctatttaaggtttcttgatgaaaaaattaatgacatgttaaaaataacctagaatatctttttaaaaatatgacataaagggaagatatatttcatttaatattcatattttattaaaatatcaattctttctaaaataacaattataaaattcagaagcttagattaaacatttcctttctgatcattttcttctcttttggcaggccctgaagaggaaagtgaggatgactctcatctcgaaggcagggatcctgatatttggcatgttggttttaagatctcatgggacatagagacacctggtttggcgataccccttcaccaaggagactgctatttcatgcttggtaatctttggaaaatcaaaattatattgaaactctagtgtctaaatttagattataggatttatattttgagtatgtcttatgaaataaacttttggagtattttatattaagagcgaaacttctttataagaacatgtaactaggtttttcttttttgagatattgctgattttttgagatggagcttcactcttgttgcccaggctggagtgcagtggcacaatctctgctcattgccgtttccacctcctggattcaagcaattctccttcctcagcctcccaagtagctgggattacaggcacacaccaacacacccagttaatattttgtatttttagtagagatgggtttcaccacgttggccaagctggtctcaaactcctgacctcaggtgatccacctgcctcggtcccccaaagtgctgagatttacaggaccatgcccggcccaattaaaagttgtttttctttttattctacatagatgcagagttcctcaaatatgctaaacaattttctggattctttatcagagatattaaatcatccaagtcaaattataactttaaaaaatactttcctgtccgtattagtttttagtagtgagagttttttttttttttcttctagttttgaatgttgtttcttctcaggaacagctgacctgacaatggggcctttctctcgacttgtcatttagttctttgggaagcagtttctcagttgtggttaggccaactgaagctgtggagtttgtgaggctttgtttttttcttctttgctgtaagtttttaattttatttttggactttctacttgttttctaatgcgcaatgtgtaaacagtatcattttttactcacaaagcttctcagggtttattctctacttggctcttgttcctgattatttggggtttatctcactcctatctacctggagaaatctactcatatgttgcttttggagccaggaagaaccagggctgaagcccagtatttatgataacagttgattcccagttaattgggtattttagagtctactatgttccaggtactgtgtaaggttccaggggagatattggaggtggatgaatcttggttcttgccttttgggaattcggagtacagaatagctctttaggccattctgccactaagcattttccaaattttagctcattgcctatgaacttcaaggttttggtcacaatcatgtacttctgcctaaataaagtaacttttaatctttcactgaattgaatttattttaaaaggagattttacatcactatcttaaatgggaatccagtatcactaggtataattagaagggctttagaaatataaatatagagaaaccaaaacagtactaagggcctgctacttttgtttgccggagatcctgagtctgagtcctattctgtgtttgttaaaagaggagattagtaacagagaggtgttaactgtatagtggtaccagtctgagactttctccttaatgtctgcaggaggattgggagatcattatgtagggtctctttcaaatagtgtgatttaatggcacttaatgtgatgtccctttacctcttaaattcttctcatggggagattcctgcatttcttgaacactgatctaagtatgcccttcatctcttgccttccatgtgaacattgctttgcagtttacacatcagtttcacacaagcagccccaatctcctgtcagctttgtgagggagatggcagagattgttctttttttaagtgatcttcctaaagtcacttagttatgaggtagaacagggaccagaatgggtggcaggcatcttatgcagtgcttttcctactctaaatggggctatttcaacctgatcccaatatactgaaatctctatgtgggaatgttttcagtgttaaggttctctcttccccactgtctctcctgcctgatctcaggaagtaagtttattttttaaagtccctaccccatcattgagtgtcatttgtaggtaaacattgtttcatttttttttgtaccacgcaaatacagatatttggcctgagtcttaatagatgttagtatcagccagtaaatcactttcctttggatactttgttcagaagtttctattagcaatgtatatctttcaaagaaataagagccagaatgttatcttttaaaatagcttttactttttaaaaatataaaagtggctgggtgctatggctcacacctctaatcccagcactttgggaggccgaggcaggtggatcacctgaggtcaggagttcaagaccagcctggccaacttgatgaaaccccccgtctccactaaaaataaaaaattagctgggtgtggtggcacgtgcctgtaatcccagctactggggaggctgaggcatgagaattgcttgaacccgggaggtggaagttgcagggagctgagattgcaccactgcactccggcttgagcaacagagcaagactcagtctcaaaaaaaaaaaaaaaaaaaaagtaaataagtactctaaaaattcagctatattccatatatttaataacatcttgtgtgttcttttctgattaaaaaagcaatatgtgcttatttgagagaaaagaaactctggaaaaaagagtctgaaatgaagaaagaatataaaaatcaggttaatgcctgatttaatatatttcttttcagtctttttctgtatatgtatgtctggaattatagtagtaatatgaataaaaccagatttactgggaattaatgacaaacattcttttaatcttctcagcaatcctgagaaacaaatattagctatactgcaaaagaggaaattgaggttaaatttatgtagttacttaaccgtggctgcacagctagtaagaagcatggattgtatcttgtcatcttatcccactcggggtctgacatcccatgtcaggccagccctccttctcccgtagggatgccctcctcaccctactcagcgctgaacgctgctcagggttcctgtgccttcttcttcccacctggcatgatgcctccgcctcacctaatggctttaagactaaattgttcaggaagggaagaaaagaagttaatgatattctgtttgtttcttttctgttcttcttaaggttatgggtttctcagggtttaagaactggattataggccaggcgcagtggctcacacctgtaatccctgcactttgggaggctgaggtgggcggatcacctgaggtcaagagtttgagaccagcctggccaacatggtgggaccctgtcactactaaaaatacaaaaattagccgggtgtggtggtggatgcctgtaatcccagctactctggaagctgaggcaggagaactacttgaacccgggaggcagaggttgcaatgagccgagatcacgccattgcactccagtctgggcaagaagagggaaattccatctcaaaaaaaaaaaaagcgctgtattttaatgaaaatattaaataatgacattattcattggattttggtgttataatgagtatacactgtaaaatatacattgggtcccttgagctattgtacatgataaacagaagaagttagcattattttataggagctgatatccaagacataatataaaatctactcttgatttcccatgtcttatttttagatgtaggtgatatagttggtatcctactgaactgtgccaaacacagcacaatatatcccaaagtctgcacttagaatatatatttttattaggatttattatttttattttatttgatttctgaaatgaatcttccttcatctcttttttttaaaaagtcaaaagtaaaagcaaccatggtctaatgctgccttttctctttacttttaaatccaaatagcacaaggagccccgtagagggagggacttcggccccgtgctgatatctgaaatctgaacttcatagcacttatgaaaaggaaacagtttagctcaatttataataatatattggtctgcagaggaagtgcaggctgaaccctgctgtctcaagtaaatactccaggggtgtctgatggggaacgtgtcgggtgcctgtaataaatccactgcccatggaagtgagtgaaggccttgttggcagtgcctgaggacatgcttaactaaggttgtcacggttttacttttaaattggaatctttgccctaatctcagagttagacatgaccagatttgcaaacagatttacaattttcactaattttccaaccaggacttcaaaacacactcagagaaaaaaaaatacactctggtctttctcagagtaggatgatttactttgccacagatgttttccatagactgaatgtaaccagggagttagggacttaaaagtggcttggagacaaaccatgggtttgttttttgtggaacagattatacagttcaagggacatcaacacaattatgtttattaaccaggagctgggtgtggaggtgggatgtttcaggacaaaggtgagtgctaggtaaacatttggggcaaaaaccctctcttcctcccttaatttgttattgttattctttacatgtcaccattcatgactctgttctctctgctctatttacatttgtttcttaagcacaactaaatctcactttcaagtatttgttgttactataccaatcagcagtttcaaaacttaagttgccaggtaaaaattccactgcaaaaaaagaaaactgcaatagaaatgtaaatgcatagcccttcttttttggtttttctttaccttgtcaacagtttagggtagagttgtgaaaggaccataggatttctatcaggtaaccaggtcccagactcaccgcattgtcaattgcctgtgtattgctagtgcctctcttagtctctgccttcactgtaaaatgggagcttaatgatacttccttctcagagtttttgggagtacaaataagaaaatgtatgggaataggctttgcaagctataatttgtaagtgcagacttgtgaagagtgggaactggaccatggcatattggagaaccagtgagacgactgggtgatagaagaatgctgaatgctgtgttcgtatcctgcttcatgcccagagttttgtcaccttcacaaaataccattccatacgtatatttgctacatataggaactacaagaaagggaagttttaccaatggattcttgagggtgaggagaattaatatctggtccattggttatcagagccctgtagtaatcagtcttactttggtggaggccagctttacttttagagcctggccagtagttttttatagattaagttcaccttccttgaaatacctatggcttagaggcagcaagacccagagcacagaaatatttgatgtggtctaaactgtaaattgccatgcttctgttttttgactcaacatggccactcccactggagtctgtagccctgtgagcaggaagaacagaggtctccaggagtttagactcttaagcgggggctcccttgggactgaacatggaaactgtggtatctttgtaaatcctccaggtgtccctcagttttgccctgatttagacattttattcaaaggaaaaagcttttgttatttctttctctgaccccattcccttcctcaccaacctctgaatgaccagctaaagtaaaaagtacacataatttatggcttaatcataaatttaaaataattatactttattacctctcatgggtcttgaaatgtaggtgctatgttctgctttctgccgaggcaagggaataatacagaaaccagtaataaattataacttcaggctgcagttggtaagctggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaatttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaaaaaaaaaaaaaaaaaaaaaaaattagccaggtgtggtggcgtgcacctgtaatcccagctactcgggaggctgaggcatgataatcacttgaacctgggaggcagaggttgcagcgagtcaagattgcaccactgcactccagcctgggcaacagagtgagactccgtctcaaaaaaaaaaaaaggaaaaaaaataattggagaaataatacatgaacacacatgtattctcattcaaactttgtggaactatatgaaataaaatgtagacattctctttccccttgctttcccatctggtcctttgtaagtgttagcgtaaagatagttatgttgacatatttaaatatatgttgctgctgctgtatttttaaaaaacataaatgatactttattataaatattactctagtgtttgttttttgtacataatatgtgctggaaatttttttatgtcagtatgtcattcatattattattgttattataaaaatactacatgcacaaggaaataaaaattgaaagatttaaaatggaaagttgaggaagatctaaaatggaaagtgaaaaactccacctatccccaagttccatcccttagaggtaactgcttttcactgtatttgcgttttattctttgattacctccctaacccttaaacatatatatacttgtacttttatttctttaataactttaagcattcttggttgttgatcagttaagaatgacagaaacaggcagattgctggagcccggaagtttgagtccagcctgggcaacatggcaaaactctgtctctacaaaaaatacaaaaaaaaaaaaaaaaaaagccaggtaagccaggtatggtggcaaacacccgtggtcacaactacttgggaggttgaagtgggaggatcagctgagctcgggaggttgagcctaaagggaactgtgatcgcgccactgcactccaggctgggtgacagagcaagaccttgtctcaaaaaaaaagaaaagaaaaagaaaaaagaattatggaattagtgctctgatactacctctcactcttgccaaatttggctagttaacctttacttttaggggtttatttccttaattactttccttagaaccagtttatagatactttctcttgaattttagtgtgtaatgtggggaattaaagttctctttcagccatgtcattactttgacatgattgaggtttacaactttacatacagatctgtaattttgataagacaagcacgcttataagttgatctgaaattagaaagccagtacataatgatgttgatgtaagtgttgtttattgcaaaatgagatagagtgatggaattaataggtagaaaatgtaatctactgtaactatccaacctgcgccaatgaatgaagaatactgcacatgtcaggtcaagattttatacttaatcaaaagctcaaaattatgtacattttagcttgctttgtatttgaatcatgactttgttgcatagtttccctctccccctggagacttatattcgtctttttttttactcttactgatagaagaagcatgctataatgattgctcaatatcactagatgtttcgtcatgtgacttgttcagtgtttgataaacactggcttcttcataccccacctaccacagttatcatactgggatttcttctcattggacacctttgccaattccattaaaaaatcattttaggctaggtgcggtggctcacgcctgtaatcccaacactttgggaggctgaggcgggcggatcacctgaggttgggagtttgagaccagcctggccaacatggcgaaaccccatctctactaaaaatacaaaaattagccaggtgtcgtggcaggcacccgtagtcctagtgcctgttttagttactggggaggccgaggccagagaatcccttgaacctgttaggcggtggttgcagtgagccaagatcgcaccattgcactctagcctgggtgacagagcaggactttgtctcaagaaaaaaaaatgtattttaaatttcagtagccttagggatataagcagtttttggttccatggatgatttgtatagtgttgaagtctggtattttaatgtacctgtcacctgagtagtatacatctgataagtgttttgttttttttttcatccatcacccccctcccatcctcctctcttctgaatctccagtgtccattgtaccactctctacaccttcatgtgcccatagcttagtgcccacttacaagtgagaacatgcaatatttgtttgtccattcctgagttacttcacttagaataatggccttcagtttcatccacgttgctgcaaaagacatgatttcattttttttaatgactgagtagtatttcatggtatatatacatgccacattttctttatctactcaacagttgttgggcactttggttgattccatatctttgcaattgtgaaatgtgctgcaataaacatatgcgtgcagatatctttttgatataatgacttctttttcaggtagatacccagcagtggattgttgggtcaaatggtagagttacttttagttctttgagaaatctccatactgttttccatggaggttgtagtaatttacatttccacccccagtgtataagcactcccttttcactacatttctagcaacatctattattttttgactttttaataatggtcattctggctaggataaggtgatatctcattgtggttttaatttgcatttctttgatgatatgtgatattgagcattttttcatatgtttattggccatttgtatattttcttttgagaaatgtctattcatgtcatttgcccactttttagtgggattatttgttttttttcttgctgatttgtttggattccttataggttctttgtcagatgcatagcttgcaaatattttctcccattctgtaggttgtctgtttactctgataattatttattttgttgtgcagaagctttttagtttaagtaggtcccgtttatttattttttgttgcatttgcttttggggtcctattcataaattcttgcctagcccaatgtctagaaagagttttcttctagaatttttatgggctcaggtcttagatttaagtctttaatccatgttgagttaatttttgtatatggtgagacacagggatccagtttcattcttctacatgtggctatccaatgttcccgcactgttttgaatagggtgtcccttttccagtatatcctttgtcgaagatcagttagttgtaagtatttggctttatttatggcttctccattttgttccatcagtctgtgtatctacttttataccagtaccatgctgttttagttactacagctttgtggtataattttaagacagataatgtgatgcctccagatttgttctatttgtttaggattcattggctattcaggctcttttttggttctgtatgaattttaggattatttttttctaattctgtgacaaattacattggtattttgataggaattgcatcaagtctgtaaatttgtttgggcagtatggtcattttcatgatattgattcttccaatccgtgagtatgggatgtatttctattcatttgtgtcatctatgatttctttcatcagtgttttatagttctctttgtagagatcttctactaccttggtcaagtttatttctaggtactttattattattattttttttagctattatcaaagggattgagttcttgatttgattctcagcttggtcattgttagtgcattgcagtgctactgatttgtgtacattgattttgtaacccaaaactttactgaatttgtttttcaaatctaggagtccttggaagtgttgttaggattttctacctacacaatcatattactggcaaacagagatagtttgacttcctcttttcaatttggatgccctttatttctttcctttgcctggttgctctggctgggacttcctgccaattccacttttacttggatcatttgtatttctctttcttagaattttctaaaaattctgttatatttaaattttctaaaaattataccatattttagattcttccaggcaaggactgttttagctttgtatcctgtacagcacctaacacagtactttgaatatggctggtgcttactaagtatttgttgaactaataagtgaatgaatgaaccaagaactggcttttttttttcatttcatggtagtgtgtcttggttatacaagcaaaaggaagtattaattctatccttgaaagcccctgcctgggaaaggttttgaaattccttctcaaacagatggccattcacctaatgcttggagattaccagagacagaatttagaatcttccatggcagcctattctttttcacagtaactcatgcttcttttccttacatctagtctaactaaccacgtgacatcacagaactttctaaagagacacagtatctggatccatctgtacattcccttctaaatttttttataagaaaaccatcaaagataaaaataatgtgttggtttcttttaggctgaggaggaatgttttactatgcattttgaaatttttttgttctctcatatttcattcaattagagtcaccctgttttggggtaattctgcatctgagtttggtggtggaatttttcccattggctaacagtcttcatatgccctctttggccacctgtctattgaacataattcccaaaggcatgagctatagaaaatttttttttttaggcctttatgtaggttgtatatcctgtgtgtgttatttgccactcctgtaaagacagtggaagaatgactgtgaatgatgccattatttttttcagtcgatctttattgaaggttcgaatttaggactaggccgggaatgagtttgactttcctcatctagtcagtcccagcagcacgtttcaaggtcagactatatacctcatgctggaaggttccttagactttgtaatctaagcccaataaacatctttttttttttttggggggggatatttatttaccaaataaataggacagcacacagccatccgtgaaggtgataagagctttgactagttttataaatcttcccctaaatataattttctatgggagtgaaaactcttttataaaaacaattgagagaccgaggcaggtggatcacttgaggtcaggagttcgagaccagcctgggcaacatggtgaaaggctgtctctactaaaaatacaaaaattagctgagtgtggtggcgtgtgcctgtaatcccagctactcgagaggctgaggcaggagaatcacttgaacccaggaggcagaggttgcagtgagctgagatcgcgccactacactccagcctgggtgacagagccagactccatctcaaaaaaaaaaacaagcatggaggtgaagatgatctcaaggtacataagatacatacctaaaggtacaaagatataaatcatagtccttggtcaattcattatagtggttttgtagtctgtcctacagttggttggggtaacaacctcttttcttatttttgttcacactgctctctctaccccctcatctaggtatgtgtatagctcatttatttaggggtgatgttaaaaaattgaatgcccttaatggcaagggaaccaaccaatcaatgtggatgccacaactttttcccctgttgactgttgttattggtatggaagtattttttttttctcccagcttttatttcaggttcaagggatacatatgcaggtttgttacatgggtaaattgcatattgtaggggtttagtatacagattatttcatcacccaggtaataagcgtagtacctgatagataatttttcgatccttaccctcctcccaccttccaccctcaagtgggccctagtgtctgttgttcctttctttgtgtccatgtttactcagtgtttagctcccacttataagagagaacgtgcagtatttggttttcttttcctgcgtgaattcacttaggataagggcttctagctgcttatgtcacctacttatgtcacctactactactaagctttttgagaacctggtctctctctctctctctctctctctctttctatatatatataggaagtcctggattctggggcttcgagggctgacctggagcctgagtccacaagggcatacctggtgctagagtaggcttggagccttcgtctttggaggccaccctatcactggggttcactggggtggacctctgcttggtttacagagaagttgggtactcacttcattctccttcccccacacaaagggtatccctcttgacactgtgctgctcaggcttcagggagaggtgacgtaggtaatttgaaactgttcttcctactcatcaatgtgtcttttcttatttctgtgctccatccaggcaatgtaatctttaacctggattcctttgctcttataaaggtattctgtgcatggatagttattcaaattgatgtttctacaaggagacaagtgctattctgacatcttgcttgaaagtaagggattaatttttaaaccagtttttaacaattattttcaagaactgtttagtgataagaaaacaatgctcaaaatataaaagtatcagggaaaaaagatgcaaaatgtttgtacaacatgatattaattttatataaacaaaggataaacatattactaagtataaaaaaaaactagaaggaattagaccaaataattataaataatattttctcttctttacacttttctatagtttgcaaattctctacaatgagcatgtaccctaattcatcagttccaaggtagacattttttcttcatatttaacatctctgaaattggaatccatcttaaactgatgccttctttgactggatgatatattattacttttaaattaagcaatacaaactttaaaaataagtatccttatgttttaaagcttcaaacggaaatgttcaataaagagattctcaggaaagaggtattcattcaccaaataaataggacagtaaacagtgatcagtgaaattggtaagagctttggctagttttgtaaatcttccccaaaataaaatttttccatggaagtgaaaagtctttcaacaaaacaagtatagagataaagataatctcaaggtacataacttcccctctccttctcccctttttttagaattaacttttatggaatgctcagtttgttgatgggttttgaagagaatagattcttgaggttaataattgatttttgctttgctttcttttctttttttttcctttttgtgagacggggtcttgatctgtcacccaggctggagggcagtggtgggatctcggctcactgcaacctccgcctcctgggttcaaatgattctcctgcctcaatctcctgagcggctgggactataggctcgtgccaccacgcccagctgatttttgtatttttactagagacggggtttcaccatgttggccaggatagtctcgatctcttgacctcatgatccgcccacctcggcctcccaaagtgctgggattacaggcatgagccaccttgcctggccgatttttgctttctaaataagcaaaaagatctttaatccactttagccagggctacctttctcctttattcttccaagttgtaactcttcccaggagactgcagagtatagcgagttggggaaaaggaaagatgagaagggagagaggttagattgacagaaaagataattaaatggttttctccattttcccctttgtatgtgcagagcccatcacttctgcccacagttccactaaactgtgaagaccagaatctctcaaagttaatgaatgaaacagaagaagccacttcaacctccaatttctgtttctatgtcttctgacctccttctttacacatcctatctcatatccaattttccattagcaattaagaaggatagctatggtttctggctaatacctggggagagaaaaaggatgttctctccaaatatgtggtaagtttctagtatgtgcaaggttctacatgctgtgtgtagtataaaaatatatatcactatatatcatatcaatgatatatatatttcattatatgatttatatatcatataaatatatatcactgtatattaaatatattttaatgatatttatatatatatcatatataactcataaaactcaatagcaggttaacaagtaacctgacctaaaaacgagcaaaggacttgaatagacatttctgaaaaggagacatatgaatgctcaacatgtatatgaaaatgtgctcaacatctagtcatcagtgaaatctaaatcaaaaccacaatgagatattacttcacacttgttacaataactattatacaatagacaatagataacaagtgttggtgaggatgtggagagaagggaacccttgtacaccattggtgggagtgtaaattggtatagccattgtggaaaactgcatggaggtttctcaaacagttaaaaatagaactttcatatgacccagcgattctactttggtatacatatccaaaggaaatgaaatcagtatctcaaagagatatcttcattcccatgttcattgctgcattattcacaaaagccatgatttagaaacaacctaaatatctgttaacagatgattgaataaagaaaatgcagtaggtatatctatatctatatctacacacacatacccacacatatccacacataatgaaatattactcagtcttaaaaaagaaggaaatcgtgtcatgtgtgacagtgtggaatatgttatgctaagtgaaataagcaaggcacagaaagacaaataccacatgatcttacttatatgtggaatctaacaatgttatactcataaatgcacagagttgaatgtggtttccaagggtttgagggatgttgggtagatgttggtcaaaaggtaccaagttttgtttatgcagaatgaataagctctagagacctaatgtacagcatagtaactgtattagtctgtcacattgctgtgaagaaatacctgagactgggtaatttataaagaagtttcattggttcacagttccccaggctgttcaggaagtaggacgctggcatctgcttggcttctagggaggcctcataaaattatgttggaaagcaaaaagggggagccagcccttcacatgcccggagcaggaggaagagagagtgaggggggatgtgccacacacttttaaaccacctgatcttgtgagaactcactgtcatgagaacagcactgagaggatggtgctaaaccattcatgagaaaccgccatgatccaatcacctcccaccagaactcatctccaacactggggattacagtatgacatcagattttgtggggacacagatccaaacaatatcagtaattatatttattaatactgtattacatatgtgaaattagctaagagagtagatcttaaatgtttttaacacacacacacacacacacacacacacacacacacgtttactgtgaggtcatgggtatattaattagattggttttagaagtcatttcacaatgtatatgtatattaaaacgttacattttacattgtagatatataaaatgtttgtcaattatacttcagtaaagttcagaaaatgttttaaatcacaaaataatcttctactttggttattcaagttttttgatattatatatattgctacagtgaacatctttgtacatatatctttatttccataggaaaaattgctagaagttgaatgccttggtgaggtattatggtgtggacatttacacagtacatactctgttgtcagactgttacttagagagattttcattttcattcctacctgcaatgtatgaaatgtgatcatcagttacttccaccaacctcctttaccctactgtatacagtgctaagtgttccaatttacaaatatttttgccgatttgatgggtgaaaatatgctattattttaaatgtcatttatttattcatgaggttgaacactttgtatttttgttggccattcttctttctgttattcattggctgatcgtattttgctcatttttctgttgaggtgttagtgtttttcttaacatttactttatcccttctgcctttaactttattgctttaacccttctgcccacttcccagatattttcttatacccaattttcaattttgtatttagatttttaatatttattttaggtgaaacatctttccatttaagtcttaatcgcaatagttgcattaaattaaataacaatatttgaaattatttaactgcgtttatgcttactgctagcctttttgtactgtgatttaaaaaaaattcttgattgttctcttggtcagccaaaatgtagtttctaataatatttatgaagactaatggcaggggagtggtcgtggcatattctttgagtctttgcattatagaagagtgacttcctatcctttcacttgtgaatatctgcttgattggctataggattcttaagtatcaaacttcccccttaaaactctgtagaggctgggtgcagtggctcatccgtgtaatcccagcactttgggaggtcgaggtgggcagatcaggaggtcaggatttcaagaccagcctggccaacacagcaaaacatcatctactgaaaatacaacaattagccaggtgtgatggcacatgcctgtaatcccagctactcaggaggctgaggcaggagaatcacttgaacccagcaggcagaggttgcagtgagctgagattgtgccactgcactccagcctgggcgattagtgagacttcatctcaaaaaacaaacaaacaaacaaaaaaaccaccaccaacaactctatggatatcgttctgtgacctctgatatttgatgttgggagatgtctgaggtgatctacattatggtttcattttggtaagctgtattttctgtttggacatttgtagtattttatatttaattttttaacagaatatgtttatgtccttgctcaaccattttatagtgcagactctggtcttttcacaaccttggaaaacattcttctagtgtttctttgattattcttatatctttctgtatcttacttttttttttttttttcaagatggagtctctctgtcgcccaggctggagtacattggtgtgatctcggctcactgcaacctctgcctcccaggttcaagcaattctcctgcctctgcctcccgagtagttgggattacaggcgcctgccaccacacccagctaattttttttttgtatttttagtagagacagtgtttcaccatgttggcagggctgatcttgaactcctgactggccttaagtaatccatctgccttggactcccaaagtgctgggattaccggtgtgagccaccatgcccagcctgtattttacttccattctgtgattcctgttaagtacatttggatctccaggatctgttcctcatgtctaaggttttccatcactcatttcttgtattttccctgagttataggagaatctcttgagttcactcatccagctcagtaatttggtttttctgcagcatgttttctgctgttcactccatctattgccgtgttaaatgaagaaatgctattaaaaaagtcagttgccagtggttttttctgatctcatactgtttcagcttcatgtctgcttaccgtattttcacagatgcagtgccttcttgaatcaagtgtcttcttgaaaaactgagaattttctaaaattttatcatgtcagttcgagtaaacttttttcagaaaagacagttttgatcaaagtgcctccattcctttgaactgtagtaattttgcatagttctggcaattactccttgcctctttatcctcatagaaagtagactagtactggctgataggcaagtagctgagattggttctgtgagagattagtatggattcctggccaaatcctttacttgaaggtggaagaagatgtgtccttacacagtcatgtagagattttataaattggagtgtgcttaagaacttgtttttgtctttatgtggatgcttgcagtatgagcaaaccatggtaggttttggcccactcctatcattgctgattgctccagttccttgtttctgcaatgcctggtactcagagtcatggcttataacagcagcacatccaggggtctgtgagtatcacaggttatgtgcacagaattctggctacagtgagtatcacaggttgtgtgcatagaatgctcgctacagaggcaagagccttgctctctgagtgccctgtaagcttctcttgccctcctgctctttgctttctgagttaagaggtgagcattttgctcaggatttgattggtatatttatcaggctcgctgctcttttggagagacaatcacctgtcagccttctttgcccttctttaatctaattccacctatactatattcagcgcaatcatttgcacttctggcatattgagcacctttctctaatatatagtgccaaaagaggttttgatccatttttatgttccattgattgtctcattgagaatctaggaatgggacggggcctgtgtctatactggcatcttgccaggaaccttcccctccccctttcattggctatcaaattctgaaaatgttttcagccatgggtggcccacatctaggaaaaacaaggtcataaatattaagattgagagatgagaatggacaggtaagtaagaatgaaaagcttcagtgattgtttgaagctgggaagactggatttcagtactgggcttatttaccccaagagtgcctttagcaaaagtcatgattgtttctctaagaaatttgggtgaaatggccctggtaatgtacgtgacagcaaacccaaggaagtaagggctggggtaaatttagggtgaccaactgtccttttcgaaaagtctgtgggcaaggggatctcaggatgcaggactttcagtattaaaaccaggaaagtcgtgaacatgaattggttaccctagcataaattatagcattgcttctgtggtcttttatatatgaaatgagatttcatgctacagtgaatgtccagagctctcttctccactgccagggcacgcagcattcagccagcaaagagtgagagcgtcttttctttttgtgtgtgtgttgtcacatcatctacaaactcttactccagttggatacagtgtcagtcaagtttcagctgtattctgagatagctgtggtaaatagacattctttaatttattttttctaaaaattattaggaataatcttttaaagctgggagggtcttaagtatatcctttgagatgcacaatccatgaagcttgtgtcgcttttatagatggagttttcgataaattagaagctcttaaatgaaaattacaagtttctttttttaaagtcataaaggattagatacagttggaagcaatttcaaaagaattgtttgattagagagttgccaaggatttaaatgaaggtggaagcctcaaagtataccttctagtgttgtgtttgccatttggcctgagtcactaggtgactcagtgttcccctcagtggaacaaaagcacttaacaaacctactcattaaggtggtgatttttcccctaattatgactgtgggtcccagtattaatagcataggagtaataaggcttttatttgggtagatgagactggcatttatgtatttcctagacattgtcccagtcttttatgggaatttatcctgggaagcccccttcaaactccactttttattattttgcttgactctgaaacctcctttaggcaacatagtcaggatcaaccaaaactgctcaggaatgtcctcagagatggcaaacgggaagagagaatggccacttagccttcctcattaggccttacagccacacttctgctttttatcctctatattgttgtgtttatatttggatttaaaactccaaatgtatcactgatgttttcatcctcacctctaattgcattttgtagttattattttgcaatgtcctaaggttttgtgacttattcaccttcagtcagttgttgctgtgaaaaccccaagagttgttcttgagtttattttttcctgacttgactcatccagttcattagcatgtcctattgtcttttcctagaacattctgaatctgttgtctgcttatcgtctcctcccctgtctctgtagttcaagtcactgttaactcctgcatgacttactgcaacagcttcctgactggccttctgctgccattcttgtttcccctttagttcttcctctttcctatgaaactgccagtcagattagattattgattcttttgaatttgctacacagacaataatataatctgtgaacaaacatactctaattgtttccttctctatttgtataccttttgttttcttttcctgtcttactgtgtcagccaggtcttccaatatgatactgaaaaggaatgttgagaggagacatccttgtctttttcttactctgagcagaaaagtttctagtttcataccgctaagtatgatatttgctgcaggtttccttacacattctttatatgttgaggaagttcttctctatttctagtttactgagaattttttatcatgaatgggtatcacattttgtcaaatgtttttctgtacctattggtatgatcatattttttttctttgtagcttgttggtgtgatagattatattagttgatttttgtatgttgaatcagttttttatacctgtgataaatctcacttggtcgtggtgtaattctttttatacattgttacattcaatttgctaatattttgatgtggatttttgcatctatgcttatgagagaatactggtctttagttttcctttttgtaaggtctgtctgggcaatgctggccgcaaagaatgagtttggaagtattccctgtgttaccttctagtaaagaatgttaagaattagtataatttcttccttaaatgtttggtagaactcaacagtgaacatatttgggcctggcgctttggaaacatgttaattattgattcaatttctttaatagagataggcctattcatattattcatttcttcttgtaagagttttggcagattttatttctcaaggaattggttcattttttataggttttcagatttttgggtaaataactattgacatcattttaaaattatccttttaatgtccatgggatctgtagtgatgtcatctctttcatttctgacattagtaatatgtttcttgtctcttttttcttagtctgcctagaggtttatcaattttattgatcttttaaaagaaccaacttttgctttcattaagtttctttattagttttctgttttttatctcatcgaggtgcattaacttttattgtttcttttcttctgctttggattaatttgttctttttctttaatttcacaaagtagaagcttagcttattgattttagatctttcttcttctaatataagcagaatgctatattaatgctatacatttgtggcatttaatgctataaattctcctctaagcagtgctaatgttgcttccaacaaattttggtaagttgtgttttcactttcatttagttccttttttttaagatttttttgacccacagattattagaagtatattgttctatctccaagtatttgggaattttccaactatctttctgttattattttctagtttaattccattctggactgaggtcaaatattttttaaaaaaatgtttcagacaaataaaaattcagggaatttgttgctagtagacgtgtattgcaggaaatttgtcagaagaagaatgatatagatcagaaactcagatctacataaagaaaggaagagattttgagatggaataagtgaaggtaaaataaaaaccattatttttcttacccttaattgatagaagagataacaatttattcacaataataacaacaatgtattcaattatgtacgccacatatgtgtgtgtgtgtgtgtgtgtgtgtgtgtgtgtgtttgtgtgtacctatgtatgcttatttgtaagtgaaagtaatgataacattctcttaaatttggtaatacgtgttttatcgcccagaatgtggtctgttttggggaatgctccatgtgagcttgatactagtgtgtattctgctgttgttgaatgaaatagtctatgtatgtcagttatattcaattgactgatggtattgctcagttcaactatgtccttaatgattttctgcctgctgtatctgtcgttttctgatagagggatgttgacatctccagttatagtagtggatttgtctgtttttccttgcagttctatcagtttttgccttatacattttgatgctctactattaggtgcatactgttatatcttctgggagaatttaccactttatcattatgtactacccctttttctctgtgataatttatctttgctctgaaatctgctctgtctgaaattaatataggcactccagctttctttagattaatgttagcatagtatatctgtcttctttgtttctttaagtttaatctgtgtgtttctttgtatttgaattgagtttcttgtagatagcatatgccttgttttttatctattctgataatctcttattttttaatgtgtgtatttagaccatgggcatttaaagtgattattgatacacttggattaatatctaccatatttgttaatgttttctatattttgtcttgttttttcccctgtttttgtcttccactctttttctgcttttatagttttgagtatttcatgatttcatttcatctcctttcttagcatatcaattacatatgtatttttttactttttaagtagtgacctagaggttgcagtatacatttacagctgttccaagtccactttcaaataacactatactgttacacagatagtgcaagtacagtaaaataaaatattcctaatttttttctctcatctcttatactcattgctatcattaatttcacttacaaataagcatagataggcacacatacatatatatatatgtggcatacataattgaatacattgttgttattattgtgaataaattgttatctcttctatcaattaagggtaagaaaaataatggtttttattttaccttcacttattccttctcaaagtctcttcctttctttatgcagatctgagtttctgatctatatcatttttcttctgacaaatttcttgcaatacaagtctactagcaacaaattccctgaatttttatttgtctgaaacatttttttaaaaaatcctttctttctttctttttgtttttttgagacagagtttcactctgtctcccaggctggagtgcagtggcgtgatcttggctcactgcaacctccgcctcccgggttcaagcgattttcctgcttcagcttcccaagtagctgggattacaggtgtgtgccactgcgcccacctgatttttgtatttttagtatagacagggttttaccatgttggtcaggctggtcttgaactactgacctcaagcgattcacctgccttggtctcccaaagtgcttggattacagacatgagccaccacacctggtctgtttctcctttacttttaaagggtagttttgtaggatccacaattctaggttgctgtttttttttcctctcaacaccttaagtatttcacttcacttttgtattgcttgcctcgtttctgaggaaacgtcagatagctttttttttgctccgttatagataagctgttttttccttctggctttttcaatattctttatctttgactttctgcagtttgaatataatatgcctaagtgtaggtttttttcctgagcttcccgagtctctagtttggtgtctaacattaatttaagaatattcttagttattattgcttctaattttcttctgttcctttccctctttcttcgccttctgttattccattatacatatattacacctattgcagttgtcccatagttctgtttttttttttttttcagtcttttttctctttgcttttcagttttggaagtttctcttaatatatcctcatgctcagagatctttcatctgccttgcccagttctctaatgagcccattaaaggcattcttcatttgtgttacagtgttattgatttccagcattttgtttttgattctttcttagaatttccatccctctgcttacgttccccatcagttcttgcatgtcgtctacgttgtcctttagggtccttagaatagtaatcatagtttcaaaaacatttctgataattaatttctgccatttctgactctgggtctgatttttgctcagttttttcaaattgtgtttttttgccatttagaaggccttgtacttttttcttgataggcagatgggatgcactggataagaggaactgcagtaataatgtggtggtaaggtatgttgggaggggaagcattctataatcttatggttaagcctcagtcttttagtgagtttatgcctgtgaattgtgaacctcacaagtgcttctcattttcttttttctcattcttagttccaataggatggctagcaggggctaggagttctaggtggcattgaagtatgttcatgccactacactccagcctggatgacaagtgagaccctgtctcctgagaaaataaataaataaataaataaataaagtcgctattttttcccttccttctgccagaagcatgagaagatgtttttggatcttcactgtgagaacctgttagagcttttggagataaaactcacaaaagtgtgggagttccctaagatggagctcccctggactttttaactctcagtcccgtctacgttgaatctccagcaattcagtagttacagttacggtttttctatcctggaactggttcccatgtgtgtttctgcttcttgttttttactctgataaattgtcatctctgtttccagtgtgtctctctctccagagtgaggaatgacaaaattacatctcattgaaagccactgctcttggttttataatatctttacatctttgatttaccacaatgtaactttgaatgttgtaccacttttccttccatcctcttttgtgctttttcatgtgttttacgtctgcatatgttataaacctcagaatacattgttattattttggatttaaaaaggcatttattctttcatgatatttgttacttatgttactttttattcctttgagcagatctaaattccttctgacattatttttcttttgcctgtagaatttcataactattcttatagtgtaaatctactgaatataaattgtttcattttctttctgaaaagtctttatttcacttttattttggaaagggtgttcactatgtatagaatagtagattgacagttttttcctttagtattttgtcaccagttgtcttctgagttttataacttctgatgagaagtctgctgtcattctaatctttgtccctctgtatttaatgtctctttttctgactgcctttaacctttccactttattactgattttaagacatttcattatgacatgctttagtttagtcttatatctttttttgcttagaattcgttgagcttattggatctctgggtttatagttttcatgaaatttggtgaattttggccattgtttctataaaaatgtgtgtgtttttgtcactctttcttccctagaattcaaattaaattttcattaaatggcttaatattgtcctggctgtcactcatgccctttcatatttttgtagtcttttttgtttagccactttattttgcatagtttttatttttcatgtgttctagttcactgatcttttcttctgcagtttgtaaattgctgttcatctcacttagtgtgagttttgtttcagatactgcatgtttaacctttagaagcttcacttatatatatatatgaaagggcagatatgtacatttagaagaaaagagagatgtgactacctcgcatattttgtgtgtgtgtatgtatctttcatttctctgttactttttgaatggatgttgggtattgcacatcgtatttgttgggtgcctgattttgttatatacttttacatacttttggcttttgctctaatgaataattaaattactaagaagttggatcctttttttttttaaattttgagatggagtttcactctcgtttcccaggctgcagtgcaatggcgcaatctcggctcactgcaacctctgcctcctgtgttcaagcaattctcctgcctcagcctcctgagtagctgggattacaagcacctgccaccatgcccagcgaatttttgtatttttagtagagacagggtttcaccatgttggccaggctggtctcgaactcctgacctcaggtaatccacccacttcggcctcccaaagtactgagattccaggcatgagccactgtgcctggccagaagttggatccttttgaggcttagttttaagccttgctaggtgggactagagcagcctttaacctaggactcatttagccctacttctgcagtgatgctttcctaaggattttctagtatctcatgtagtgggagccattttggctgctgggatcatagaatactcctggctgtgtgtgaaatctgaaattggttccacctgctgcattctggtgcttctttttttggcccttgggaaatttttattcatacatgcacaggtcagtgctcttccaaatacttgagggaaccttcctgcagtctgtttgctgtctctctgtatagctgtttctgttccagcattctgcctttcgaggccctgtggccttggcctccctatactccagtctttgtcttctcaacttggcaagaaagaaacagagactctgggttttgacttcctcttctctattctgtggcattgaaactgtttccatggagtaagttagggcaattgtaggcatctctcacctattttgtttctcttctccatgggattatatcttgctgaaacctttgattcatatttttggcttgttttgtagttgtttaagacagaagggtaaatcttgtcactgttacttcacaatattcataagcagaaatcctgtcttaatatcttgcatttcttttctatgtttagagatgatattgtaggttgtttttgctgatacataaggggcctggtggcatttgcctcttggtttaagtcattatcttttttggtatcttgataaaaatcttgtgttgcctgtataggatgccattgctggaaacattacaactctctttttttgtaatagaggaagtcatgtcctgagcagaggttgtatagattttgcctgacttgtggtatcatttcttaggatatataacaacttggtcattggtttttctcccactgcttgtggttttaggaatattcttcaactgatgaattcaccacctacttcattcttgggttgtgaatccctacacttgagttctgttctaagagccaaacatgcaacatgctgagttggttggtttattgcctggaaaattgttagggcaaaattgatactttgattatggagggaaagaggcagatttttcagatgaaaggtgtgcaactccaaattctggtttattctaaagataagggtagaagtagatgtgtcatgagaaagtgaaagaagctcaattcatatatagtgaattttatagtgggtgggcataataggaccacaaataagtagagtgaccctatatctcatttgctgaggacagtcctggtttatacttgttgttctggaataattgttaatagcatcccctttcactcttcaaagtgtcatactttgtatgatagaatatatacatatttagttatatacatatgattatatatatctacttatatatacttgcatatgtataagtatatataagtatatcatatttattgtatacttatatttatattattatacttgttatgtatctacatatatataatgtctacttataagtagatacgcatataatggaatatatatatatgtagtcacctacttataagggattgattaaagaatacaaggtaagtattgattccttggttattgttatttcttggaagatagatttactgtttactttgtgttttagttaaataatatatagtatatactgactaataaatatggttttatacatttctggtgtttttcctgtagatgatctcaatgccacccaccaacactgtgttttggccggttcacaacctcggtttagttccacccaccgagtggcagaggtaagtgtaaataaaaatgtgattcacacctaattggatgtgacagaagtggttgaatgagcaatttactatagagctttggaagagtatttgatgggaaaattgcttccatctaacttgactttcgtctctgtttacttgctttttgagctttggattgtgttggatacagttttagaaagcatattcatgccatgggataagtgtgttttgcttcttggggttatgtttcttggagaaggaaaatgccgttgacaagtgtttatagttagaggtttatttagagggttgtatctgtcaaggtcaagggcaggagatgaccagaagaattggggcagatttttatgcttgtgcatgtgttagctgtggctgggttcagatgttgagaattttcatttcccttaactttttggtcagacttctgggcatgtgaatgtaaagagaaagttacagggttgccaaggagtttctgagctccacagttgtgttcataacccagactttattgctaaattctgccaccacttgcaatggcccatggttagctgttcagactagttcagaatggaaaactaagaaatgagaaaaactcatattagtcatgttggggtcccatgtactcagttaagaggggttccagagagcaaggcatgaaagggattacaagtgaccttctacctaagcttgctatccatgctttgctttatagcttgacctttcatggaactacaggggacaagtgtgagaaaattgggcggaagtggtacaacaaagtgagaggtacaggtgcaaggtcttccagtggcagtactgcgtgagtctatacggcagtgttgtgtcttttggtcattaagtagctttaccagtggaacgatcatattgctgtgtggcagagagagaatgaatgagtatttaaaccaagatgccagcaagcccatccagcacctctttcttcctttctcccctttcttctcttttccattcactcattcatttaaatatttgagtgcctgttatgtgtccaaaactgtaggcctgggagatagagccgtcaacatgcccatgatgcccaccacttttgtgaactttagttgggggggacaaattttaaacaaataaacacagaaataattgtcttagagacctaaagggagttctgttagaaaagagggaagcgagggaggaaggtaggtaaggacgaacagaggaagaaaagaagggagggagggaggaaggaagagagggagggaggaagggaggagcaagtatttatagagcatctaatatgtgccttgtattatacacaaggatttcatttccccagttataggcatctgtctttctagctataaccctcctaagaatccctttcttgtggatcacttgagtatatggctacttaagtgcgcccttctacgtctttcctaatctaatccagaagagtggacagtctcattagtgctgggttcaaagggctgtacaaaatgataaataaaaagcttgggaaatatgttcatggggataagaatcgtacctaatcgtagtgttcttatgaggattaaattagttaatacatgtaagtctttttagaacagtgactggtatacattcaaagaagtttgccactactattattaaattacttctactgctactactgtcttttcattttattctgttgaaaaactaataggagatgggaacaactaaagttcactgtgtggaaggttattctgtcttcatttgtacactacagtgtacataataaagcaagagagattaaatcatcagcaagttttgattgtaggaactactattcagaagggatttcagtttgttctctcttcaaacttttattgaactttatagtgttcaaggtattcttgtagggacttgtgaacaggaatggttatattcagtgtcttcaagatgcttatggtctaaagagtatgtacagtgcagaatagaatgtagcagatagcccggctaaattttgtatttttaatggagatggggctttgccatattggccaggctggtcttgaactcctgacctcagtcgatccacccacctcggcctcccaaagtgctgggattacaggcgtgagccaatgctcccggcctagattttagtttttgataattgtgtcagaatattcttgggattcaatacagaatgtctttttaaagaaatttacattttatgaataattatattttgaataggtagttaatgcaaatggttcaaaattaaaaaaaatacctaaaggtatacagttaaagtctctttctcctcaggccaaccagcccctcattcccagaggcaaccaatgtttaaaggttcttgttactcttttggtgatatttaatatataagtaaaaatgtatgtaatttcaaaaatatttttaaatataaatggtagcctactatatatatggttctgtagttttgtttcagtaaactttggtaataattactcatcaatatatagcacttagcgaggagtaggtaatggctttttagatatgacatcaaaagcataaacaactgaagaaaaaaacagataaattggccttcatcaaagttaaaaacttttgtacttcaaagggtaccataaagaaagtgtagaggacccatggaatgggagaaaatatctgcaaatcatatatctcataaagcacttgtgtctcaaatattccaagaattcttagaactcaataattcaaaagagaaatgatccaatttaaaatggcaaaggaatcgaattaacatgtcacaggctgggtgcagtggctcatgcctgtaatcccagcactttaggaggccgaggtgagtggatcacttgaggccaggagttcaagaccagcctggccaacatggtaaaaccccgtctttactaaaaattcaaaaattagccaggtgtggtgccacatgcctgtaatcccagctattcagcaggctgaggcaggagaatcgcttaaacctgggaggtggaggttgcagtgaggcaagattgcaccactgcactccagcctgagcaatagagcaagactccgtcttcacacacacacaaaaagaaggtatacaaatggccaatagacaaatgaaaaatgctgaacgtcattagtcactagggaaatacaaatcaaaaccacgacgggataacatttcacactcactaggatagctagaataaaaaagacagtgacaagtgttggtgaggacatgcaggaagtggcacccatgtgcactgccagagggaatggacagtggtgcagccactttgggaaacagtctggcacatcttcagaaggttaaatccaaaggtaccctatgacacagcaattccatgcctaggtagtttcccaagagtgatggaaacttctacaggaatgttcataatcaccaaaaagtggaaacaacccaaaggttcatcacttaatgaatggataaataaaacgtggcatatccatacagttgaatattattgggcattgaaatggaatacagtaatgatgcatgctacaacatgaataactcttgaaaacatacgaaatggaagcaaccagtcacaaaagatacatattatataattcatttatatgaagtgtctagaataggtctctctatggacatagaaagtagattagtggttgcctagggttggaaatgttggtagaaatcagttggggttgggggtgactgccaaatggcacagggtttctttttggggtgatgaaaatgctctaaaattaattgtagtgatatttgtataactctgtgactatacgaaacaacattgcattatatgctttaaatgcttgaattttatgacgtgaattatagctcaataaagctgttaccaaaaaaaaaaaacctatctcaaactaggcctgattatagattatttacataaaacaaaacactatacatccagaaaaaaattattccacatcccacccctctctctttttgttttctgcaaccatacgtcattaaactagttttcctattgttaagaaatttaggttgtttctaatcttgcatgaaaatgcaattaataacctatgtagctcactccatacttgggaaagtaaaggtgcaagtagggaaactttctagatagaagtcattttaaaaagatgttgtaggctgggtgcagtggctcatgcctgtaatcccagcactttgggaggctgaggggggtggatcacttgaggtcaggagttcgagaccagcctgtccaatatggtaaaaccagtctctactaaaaatacaaaaattagctgggcgtggtggtgcacatctttaatcccagctacttgggaggctgaggcaggagaattgcttgagcctaggaggcagaggttgcggtgagccaagatcatgccacgccactgtactctggtctgggccagagagtgagaccccgtctcaaaaaaaaaaagtgttgttgtagaggttgctgtgggacaaaaatgagtggtcattcacctttattctttgtggggttttttttggcaggaaattggagctgcctgcccttatgcacccagcactctgggatcttcatattaaaatacattttagtcaagcttctgtttcttggcacagaaactttgtttttcccaggcttgttgatgtcgcattgtataaaatggcagtaaatgtgcaaggaaattttatatcagaggattagccttcaaggttatttacaagggctcagtttaaattataaataataaaaccaaaatattttagggatacattttcctcattgggactgaagggtatttatagctgactttttattattctaggaaatcattttaatatcaaaacaggcagatgcactgcccatgtgcattggcctcttttccaacatatgatcatttataaaaaggagtttgtccatttgacctctgttttgctcccacggactcagagagggatgaactagttatctgtgtccttgctgaggcccaggtactaagttatgcctttgaatgtgccttgagggcttaagccaaatattctccattatttgaagaatctattctgccaaggactgccactgcctagtgtatgctttttgcagaaaagagaaatgagttctttgccttgtgattataactgcatttttccccgctgtcattatagaaccatttattgtgcttttgaaccagctttgcagcctggttacctttctttcctatctttagtctcagggcatttgagataaaaagtcagtgtccttgacttcttggttaaccagttattcatccaataattatttattaaatttcttccagttttcagactcagttctagatgttgtagtatatatagaaaatgtatttaacatatataaatagggcgttagcctccgggacccaaatgtttagttagagatatgaggcccacgtaaaagaaaaccagcaaactaagtggcccaagtgaggccaaactggcagcacagagcccagtggaacaggccactctagtaattcttgagttcgtgagtataggccgggcacagtgactcacacctgtaatcccagcacttttggaggctgaagtgggaggactgcctgaacccaggagtttgagaccagcttggataatatagcaagatcctgtctctctctacaaaataaaaatttagaaaaattagctgggcagagtagtgcctgcctgtggtaccagctattcaggaaggtgaggtgggaggattgcatgagccccagaggttgaggctgcagtgaaacattattacaccactatactccagcttgggtgacacagcaagaccctatctcaaaattaaaaaaaaaaaaaaaaaaaaaaggagtatagactgagccatggggcaacaggtgaattcacagccagggacaaatatgaacaatcctaggaaggatggtagagtaaacttagattttgcccataattgtgattgctggttctgtctcaacagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtaaggactttctttttttttttttgagatggagtctcgctctgtcacccaggctggagtgcagcggcatgacctcggctcactacaacctccatctcccaggttcaagtgatcctcctgtctcaagctcccgaataggtgggactacaggtgcatgcgccaccactcctggctgattttgatatttttagtagagacgaggtttcaccacgttggccaggctggtctcgaactcctgacctcaagtgatctgcccgcctcagcctcctgaagtgctgggattacagtcatgagccactgtgcctggcaagactttcaagaattgtgaaagatctgagattctaccctacttgcaagctaacaagttaatctgccacaatttcatattgttataagacgtgagactcttaggtcacagatggaggacaggttattacgtatatcaatagcagtcaccagagtctccgtatttttgtgttagttcacgaacttattctgttcaggctgcagtaacaaaattgcataaaccaagttgcttctaaacaacagaaatttatcctcactgttctggaaggtagcaagttcaagatcagatggcatcaagttcaagatttgatgtctgctgaagacttgtttcgtgattcatagatggcaccctctcactttccttagacggtgcaagggccaggcaagctccctgtggtctcttttataaggctactaaagtcttttatgaaagcagagcttcgtgatctctcacctctgaaaagccccacctcttaatgccattgcctcggatgttaggatttcaacataagaattttggagggacatggccgggtgtggtggctcacgcctataatcccagcactttgggaggctgaggcaggcggatcacgatcaaaagatcgagaccatcctggctaacacagtgaaaccccgtctctactaaaaaaaaaaaaaaaaaaaaaaaaaatacaaaaaattagctgggcatggtggcgggtgcctgtagtaccagttactcgggaggctgaagcaggagaatggcatgaacctgcgaggcggagcttgcagtgagccaagatcgcgtgactgcactccagcctgggcaacagagtgagactccgtctcaaaataaataaataaataaataaataaataaaaataaaataaaaaagaattttggagggacatacacatacagaccatagcattctcccagcttctgtttctatagggcaatgcaaaggaggctagataacatgtacatattgaggagttacattataggagaggaaccatgagctatgggaacctagtctttttcaaaggatagtaagcatgcctgtcttttgctgtaggtcaagacactgtcttcatcttccaagcctatatgcacacctgccctttgttctagagggagaaactctctctgtcaaggttgttgctatgtaaacatccttgcaatgagagtctgtaacacaggacagtcattgcttactcacaagacacgcagaagcacaagagactcatgaagaatagtctcccagcaaagactgctgggaattgagggtaggccctgggagcaagtgtcactgccttgcttttcactgatgaaatcagttgcaattctgcagtctgtgagaccagcaggtctggatcccatgggtcaaagtttcgcaaactctacttttcccactaataccctctcaatatttgctttatctttggactacatacattgtttagttacttaatattttactttaaatcaactcttttttaacatgtatacatttctttaaaaagggagctttatattgctactttaagtggaaatccagtatcattagccaaaagaaaaagtatccagaaaaatagatccaatgaaaacagagtaatgttattacattccagcagatattcttgtctggaggaggctctgagcctcaagtttcctttcttcatgttaagaagggagattagtggtaatggttgcacagctttatacattttctaataattattggattctgcacttacaatgtgtgaattttatggctgataaattatacctcaaaaaaaaccattaaaagaaaaaaaggagacactaaaatgtggttgagaactgaagttcattcaccaatctgagactttctttttgatataataagaaggattgatggggaatttggagttaaaaaatgttctcatgcatcctttctataattaattactgagcacgtgccagacactcttctgggcgctttagaatatattggtaaataaaatagacattctagtacagggagatgatggtaagtaatacacttaacacactggtaaattatacagtatgttagaagttgataagtgctacaggaaaaaaaaaaaaaaacagagcaagatgatagaaattgagagaactagagagcctccctgttgaaaagatgtcctttgagcagagaattgaaggacatgagaaacagccatgtggatatctggggaattgcattttgggcataaggagcagccactgcaaaggctgtgtggtgggggaatgcctggagtccgtggaacagtccaggaacagtatgtttgagtgaagggagtaaggctgctacttgtaggagaagaggtcatagaggtagttccatgagactggggagcagcagattgtataggtccttggaggcccttgtaaggacaaggcctttcctttttactctgcaggaaatggggacccattgaagagttttgagcaaaaggagaaataatgtcgtctcccatggcaacatataatatcttttcaatgcctttataagttatttaatatcttgtgagctgctccacactttgtgaaacattgtcataatctccagaaccacaggggaagcaattctgcctttcaggggagtagtaaccacttttgatgctgagctcaagtctgacttgctgcccttcattgtgcctgatgggtgttctactttctctcttattagtccctgctggagacattgctgatagccagaacttcaggaaagaatacatttatgggcctgatgacctccctgaattagagcaaagttatgtctttctccatatttatagtatagaaattctaatctcaaaatgtagttatttccttcgcaaaaaatctcacaattttcagtgtcagactagcagaatgggtgctttctttaacatgcatatgggctgttgtatttccctatcctttctcatctcttgtgactgactgtgatgttttttaccatcaatggatgggagaaatctgtaaaatcacactgtgtatataacagaatatcgtcatctaagtctgtctgcttcaggctgggtgcggtggctcacgcgtgtaatcccagcactttgggaggccgaggcggtggatcacctgaggtcaggagttcgagaccagcctggccaacatggtgaaaccccgtttctactaaaaatacaaaaagttagccaggtgtggtggcgggcgcctgtaatcccagctacttgggaggctgaggcaggagaatcgcttgaacccgggaggcagaagttgcagtgagccgagattgtgccattgcactccagcctgggcaacaagggcgaaactctatctcaaaaaaaaaaaaacaaaaaaaaaaaaacaaatttgtctgcttcagaaagtgactggctgcttttgatattatgtgttagggaggtggggcagagatgtactgtatcagaaacctcggccccctggggttgaatagagagattgatcttgaatttaaatagcgtgtgtgccagtcttcaccatccccccaatctctgattcttcaaggtcatctccttactttcacaattaattccatatgtcagggcacattgtcagatattgttcttttgccatacaagttggcctgggatttagcagttgcatgctcgctctctactttgtcctgttgttcaatgaaagcccacgtgtctgtaagagttctcccagtttctttcttgcttgcctctttctgcaaggccatgtgtcttttctggacaaatcacaggatgaagcccttggttttacatactgcaagctctcagtctgtgtgggttgaaaagtggtttgttttccttgtctaggatggtttctaactaagcagtttcggaagtttgggcatatgttttggagtaccttatgggagatagtttttccaatttaagatgcttaggaaaggttcttgtttaattataagcagaatcttcttccatgttattaaatggcccactttcctttttaaagatagtaaaatgtggaattcagcctcttctcttagtaaatgtcccctagaagaatggaatgtttgatggtattgtttggctctcattttcttctgatcagacctgtggcttccttataactactgcaaaagggccttcatagggtatctctttgtaggcagagccttaccatgtcttcctggtctaatttctttctcagtgaagtaacttctttccgttattacagtgagacattaatcccaaggggcgcagtcacacatctcataagggagctctatggctgacttgggaccaaatcaagagcctaaataaacttggtagaagaaaagtaggtgacgtttgctgacccgttggaatgatggatatgatttacaactatatggtgataaagtggctcagaaatattcttttgaagtcttattagctttgctctccaatgcctaagtgcccaatgactgaagtccagatatgtgggttgattccatttctttctcctcttctaggcttatttccattaagtgcatgttcaaaatcagggagtttggtttgtaagtatcatgaaaactttgagagaaccctgagagctcctgcaggttgtttccctgctattgaggtcttcagggatgtgtcacccgtggaatgttccttggccccaagtcagcatttgtcctcctgacggcttgcctcttatttctgctgtgttagctatgagcatcctttggcggcctacaactctggagaagggaggaagacccaactcctgtcatggttaccacttcatcagtcagtcaatatggttagacattgatgtttgtttggttttttagccccaaagtaataaggactcactgtattttgcgttctgactctttggttttgtgcagtgtccatgctgtagctttccttcctaatttccagagtttattacctcagactctgaatcaagcaggtggagattttttttgccttcttaattaagtttaaggagagagtcagctacttctttctcttggcagtggggaaactggtaaacgtggcatttgattaaaatcctgtaatagtttttacccacaacattgaaatgaaaaagtcaggtcatggagttgaatagaaggcatgccagtggacttgatgtccagagattgtatctcatgggcagtacttcaactcatgaataaaattgtgttgggagaaggtcttcagtgctgttgaacgtttctgactggcattagtgggaaagggtgggcatgaattgacaaggacattaaaacttttcctggtcagaaaattggtaagattgtgagatgcttgaggacaggaagtccaaagccttgtggtcttgtttagtatgcattcttgacatctagcaagtgcctaacagatagtaggcagtaattgtttctgtcttacagatgacatagctattctgtagtggtacccacttttgaactgactccagaacccatattccttttttcttttagagacatggcctcactgtgttgcccagactggagtttagtggcgcgatcatggctcactgcagcctggacctcctggctcaagtgatcctcctgcctcagccatctaagtagctgggagcacaggcgcgtgccaccacaaccatctaactttgtttatttgtttattttgtagagatgaggtctcactatgttgcccaggctagtttcaaactcctgggctcaagtgattctcctgccatggcctcttaaagtgctgggattataggtcagagcccttatttttaaccatgatactatctgcctcaaaacatggttgggcatccaagggaagatgaaggcattatttattaaaatagccagggctctctctttgctctcttgtccaatagcagagcccctagatatagccttctccttgcttccaagttttaatttactgaaatccagtttctagtgtaccctgatagactggataaactaattacatatgataatctatttccagagtcaccatggttggcgagccttatccattctgtcctcttcaacaggcataaccagcccaaagactggaaaatcttttaaaccttttcaactctttctaacatagggcttgatgttttgctaacaggctctttccatagtgtgaacaaattttatgtgaaatccatcaaaaagaactcatttttttcttgaagtaagtatgttgttaaaccagtatcttcacagaagttgaaccacacttgtattaattcttctttcaaagtactcaaggttacatctgttaaccactgtcttttaatagcacagataagttttagcaactgttgttttaatattgtctacattccttttttgttttgttttgttttgtttaaacaactttaactgaaatcagtcctacatagcaaacaaacatttagttaatgtaaactaaaaccttttcatacaacttggtattctcaggttacttatttgagccatttccaccatcgttaaatcttcacaagttgcttttgtttgcctcatgaaagttcaatatggataaacacacaaaaaaattctttgcggtaacaggtgaagattataatagctccatgtctatatatggaacatgatcaccttagcaaagccagacaatccagcctgaagctgtggtggctccacgtttctttagcgggcagtggtaaaaagagtatttaagatcggtagcattgtaccttgattttcaagttgatgaatgatagaagacttagaaaatggatagaaaacaattttatatatttccataggttaactcagcctctcatctaaatatgttgggattattttagttgcaaggggcaaaacgttcaacctgaactagcttaagtaagaacagcttcaggaatagttcgatcaagggtcagttgatgtcatcaggatgtggtttttgtcttttcatcttgcagctacccctactatgttggctccattcttcccattgctggcaaaatagctgcagagtcttcttcctgtagtttctgatagtcttgagactcattctgatgggacatattcctattcctctcaatcctagttctgtgactagagaatctagtgggctgattggcttagacctgggttgcatattccacccctggcattggagctggagcctcctcagaccacatgggctgtttgggggaagggatgggtgggatttgtctggaataggaggactgccaaggtggcaaacagttgaagtttaccatagtagattcatcggaaggaaagtcaagttacttgagtatttctgatctgaaaatctgaaatctgaggtgctccaatattcaaggctttttgagcataaacatgatgctcaaaggaaatgtttattggagcatttcagattttggatttgaaatgcttggccaataagtatataacacaaatattctaaaatcagaaatacttttggtctcaagcatttcagataagagatattcagcttgtactaatatgattgctactcttgtttttaacctattgtcacctgccctgagttgacaagtgacaatttgaatggctttgtcggtttaatgtatgcctccataattagttttatatatataggttaagattatcaccagctcctcctggcccatgggtaagttattttaatttattgtaatttaagaaacttataattaatatttcctaatatatattggtgttttgcttgtaataccagccttaaataaagacatttaataaaaacgtattcagtttatgcctttcccatcaaacatagtacagcctgctttataattaggatctcagtatttgttgttgattgacttatagtttcctcacatctgactaataaatgtgtttgaaaacccctctctggcgtgagctgggttgtgtaagagaatttcagctttttaattgttttattttattttattttgacacagagactcttgctctgttgcccaggctggaatgcagtggcacaattatagctcactgcagcctcaaactcctaggctcagggaatcctcttgcctcagcctcccaagcagccaggacgaccagcacacaccactgccaatttatttttaaaaataaaaataaattggccaatttattattaaaaataaaaataaattggccaatttattagtagcttggccaatttatttttaattgttttattagtagcttggccaatttatttttaattgttttgtagagacagcatcttgcaatgttgcccaggctgggcttaaactcctggcctcaagagatcctcacgtctcagcctgccaatctattaggattataggcatgaaccaacacgtctggccagacctcagttttaagactactcttttcttagctttgcagatatgctctggagatgccagcttacactgggaactggttaggctgacctttctcaccttttctcatcctatggccatcaagttactggaggagaattaagagacgaagtcattgtcctcgcttgtctatcacaagggtattaaaaccaccatcttctctttatggtccacaggtcgagtttgagtggctgaggcagttttggtttcaaggcaatcgatacagaaagtgcactgactggtggtgtcaacccatggctcaactggaagcactgtggaagaagatggagggtgtggtaagtccatcagacctgggaccgtgttttctgggctgctgtgttatacaaatcctccactgcctcatttgcttaggcaaatgtagatttaattattcctaattatcaagttagattcttcttggtaaggtgatgggtatagccaggattttgtcagtacaacctcagtttagttcaataagcatttattgagtattttctcctcatagggcatgtgctggacatatactatgaagtggtgataagaggataacaattcgaaaataatatttaacattcatttgcatttttatatgcatcaggtgctactctgttttctcagtattaactttaaaaaatttttacagcaatgctaagaggtatagaaacttttccaggccttaatttgtggatgtgaaaactgaggggcagggaaatgaagggcctcccccagggtcactgagtaagtggcacagcaaggtggaaactcaggcaggctggctccacagcttatgctctcaaccactgtgtcccaacagttgaacaaggagaggggcacgaatatcaccaggtatgacattagctaaattgaaatctggtaatagatgtgaaacgttaaaagaaaatcatagttccagaggagggagtattacattcagaccacttgagccggctgggatggtggtgaaatggcagatgtggtttttggggcccttggatgctgaggagtatgatgggatgggggatctggggaagaacattagaatccagaaactaaaaacaaggccagaagtcaggtgtgaccagagcaagtagtgcagatgatgtgggaggaaatgtagctggaaggcaggttgaagccacatggaggtcttgcattaagtcttaatttaaataatagtaataataataataataacaaacacttacataatacttattaagtaccagacattattctaggtgttttctgtaaaacttctttaacttttatgacaacccacaacataggtgtaatatattccccatttttctaacgaggagaccaaaacacaaagggtttgtgtaacttcctcgaggtcacccagctaataggtgagggagctggaatctgaactctagaaggctgcctctggggtccttgcccttcaccacctcactgttctgccttcaaacaattggatttggaatgtagtagaaaagtggtaaaagcctgcaaactctggagatagtacctctgcacagaatttgaaatgtactggaaacaatgaactaatctgcaaaaatggatagctattgctaatccctattttatttttttaaagccattttattggggtatgattgccctacaaaaagctgtacgtatttaatgtgtacaacctgagtttagagatacatgtaccttcatgaaaccatcacagcagtctatgccataaacctatccatcacctccaaaagttttcttctgtcttatttattataattattattattgtgataagaacacttaacataggatctaccctaattcctactttataataatgaaaatgtcaagtcacaactttgaaggccccagtttaaaagtctggatcagaatccaaaagtccttgctttccagacatctcaaatctttaaatcataccttttcatggatatacgtctggggaaggaatgttataatccttttaatgtattaatagtatcacaaaaattgatttctccaaagacctgaatcgatgcaaaactgagcattgtgaaactgaattggagttaatgaaaagtctgtgcctaaatctccttagtcagttctgttcctaaactaagcctgttatgagtactctccatttttatgggctgcttatataaaggcagcttcaatttcagggcaacattttttccccctactgtgtaattctgattttgtccatttacatatgagttagaacctcttaacttgatgaaccttggctctaagacatcagcttgactttgaagttgtaatttgacaactctgtgaattagagttgaagagcaaataagaaaggagctcttattgatttttttttttttttgagacggagtcttgctctgttgcccaggctggagtgcgatggcgcgatctcagctcactgcaacctccgcctcccgagttcaagtgattctcctgcctcagcctccctagtagctgggataacaggggcccgccaccatgcctggctaattttggtattttttagtagagatggggtttcaccatgttggccaggctggtctccaactcctgacctcaggtgatccacctgcctcagcctcccagagtgttgggattacaggcgtgaaccaccatgcctagcccttgattttgttttttaaaaaccaaattaaaaaaaaattgtttttgttcaagagcttttttttttttattttttttaagtaaaatctggcccagcatggtggctaatgcctgtcttctcagcactttgggaagccaagttgggaggattgcttgatcccaggagtttgagactagcctgggcaacatagtgagactttgtctctactaaattaaaaaaaattatccatgtgtggtggtgcatgtctatggtctgagctacttgggaagctgaggtgggaggatcattggagcccaggagttcaaggctacagtgagctgtgatcgcgttactgcactctagcctgggtgacagagtgagaccttgtctcacgtacacacacacaaataaaaaataaaatatttggtattgtgagcttacaagtgatattcattatgaattcatttaaggaatttagttatatctatgtaaatttgtgtataaataatttgaaggtggtggcacatgcgttaagaggaaatatctgttatttgttttgtcgctcttgtataaaaaatactaaaaggaaaagcaattctgcgaactctctggtgctggtttcccagaagttggcgtgtcatttctaagtgttctgagggagatcagtggcctcagtgtctctcctcagcgtgtcttgggatgatctttatcagcagagtgaagatttaggtccagataaaagggatgtttcttccaaattaaatgtaagcattgcttcaagccttttacagtgactttttacaaattcatagtgatttcttttttctattggacaagacagaacagaataattgttggatgaatctacggttctgtggttctgttcgtttagtaccatctggtatttgtatactcgggtggaattggcagtggctggttagatttctacttggtaccagcccacctcatattttctcagttgcaagcagtagggggcaatgttgagctaccagattgaggccccaagatgttagcctttcaggaaaacgcatacaaaaataccattaactgtcaagaattatccctgttgcttcaagttagctgtaatctccaagattccatagcacaggatatcagttgtgggttaacaaattcaacagcaatttaacataaaaagtacagtgtttggtgcacatttggattctatagcattagactaatccaaatggaatttctgagtgtcctcactttgcttccagggactatcttactcaaaattattatcattttagacaaatgattcttttttatctttatacttttttttgaattgtaaaatcgtgcgtgttgtggaaggatttctttaaatcaatgcattttgtctgttctgcaaaataacatcgatctcttttgctgagaaaataaaaaacctcagggaatatgtgcattacttttccccttttgcttatgagtaaagcaacctttatcggccctcgtaccagggaagagacttgcgctgtgatttctgtctttgtgctcttttttcactttgtggctgcaaggtgtagtctcaggaaggatatagaagaatggaaaatgagctttgaaatcgcttttcttccattaatggtaattgcttcacatgtcataaccagtcacatatttcaaaaagtttagtcagctgtctctaaaactcccccatcctccacttcccatttcctgtcccagaaaacaccatttttatcacactgtttattcttgccattttttctcccagcggatagttttactccatccatgctcttgtgatgtaaatgttaaaccttatatttgaatgacattctgataaaatatcacattttccctgaatattacctcatgaatttatgagccattaagcccaaagcaacataaccctttcttataacccaggaatttagtctggcctttcccctcctctttgctccctattgaggatggcattataacactataatactattcaaatatttgttttttattttaatttttttaaaacccgatgcacttcctacccccaccgcccctgccatccaagatgattgtattatgagaagactcttcaggataagagagagttaccatttgaaagaaactgtacagctgctttgctttctgggtaaagagaaatatgaaaagctgaagtctcctgtgaggtgggcaagtcttgctgtagccagagattcaatggataggccatttgtctctcagggtctggtatcgctctttgcaaaactgacatttattttacctataaaaatgttttaacactatcaaattcacaatgatacagaaaagaatgctaggtgcgaaatcctctaaattgatgacatttattcatttcctattgaccttaaaaaaaaaaaaggtcaatttggtataatccagtggaaatattcgacaatcgtttccagagtaaacattttcgaaagtagtgatgatttcgatactggagagaaattcttcttgctgttttccttggttttttcttttagaataaaaagtagatcctgatggttttgaatgttttgaattgcgtttcctgttctgacaattccttgtgctgttatagcaatgcatttatatggcagttggccttaataacctttattgactttagtgggtaggagccaagactggattattttaatgtatccgtttggaaacagtgtaaaacacaacatataattatgttaggtaagctataggctacatttaattctatccatttatgttaaaatttggcacaggagagcagagacatgtggaaaatgagtaggtgttttatttaataatgtaaccagtttcttgttgttaaagttttaagagagaaatgtacttaagaaggtaaaggttgtgcctgacaagttagttataatagtttaattttaagatgagtcatgccttttcccctgctattttggcctatgtaaatcatctgggaaggcccttgccaggagcctgcccatggctgtgtggatgagtcttcctcagcataggttacacttcatgtagtttacatagtcatagggaatgactgagccgagcagtagtttgtttatttttggagagattaatgaagttctcatcacagtgctttagattaaattctttaaaactgaatacaggaacaaggctgctttttcatttactgaaatttttactgagtatactggtatttgctattgtattatagttcaattagctaagtttattttaaacttccttctaggattgaagatttttggggatgtgcagaagaaagtgatggaaatataaatatcgaatttttttgtttgcattaatgggaaagtcaccaatttttgtgtgtgtgtgtgtgtataatttttttcacccttcttttcagtgttaatgtgcacattaagttacatcagccaacataatccagtctcccatttttcagggttagcatttctgatttaagagcagagtatattatagtaatttaggatcagatgtgagatgtctagtggttttaaattaaaatgtaaattctcttttttgactggggcagtgctgagtgactcaagataagcacagattagaggtggataaagagtcataagcatccaaaaattcagtttctgaaactggtgtgcaggcactgagttttaggacctttacgtttagctttgaaaatctggaaaaacgaaaaagtcacttgcagctggagcagcttaaaatctttggtttaaatctttggtttttggttatcttaaaggtgttcagggaagctcggttctttccattctccttcctacccacccactctaattccccacccactccaattccccacagctatattgttctattaaaagtaaaacatctggggagaaattttacatgtaatttagcagtgaatttcttataagtttttattccttttttgattatcttatgaatttcagagttttccatttttttccctgagtgtctgtacctttagtaaggaattttacaagaaagtgttgtgtatcctgtctttttgggaaaaaagaatatacaattccaagagaattcaggcttaagcctcaaaaacacagtgtgcttcgaaagcacaaaggactgtgtttatgattctctttgaagtgtttttgcaactggataaggaaaattttagaaaccgtctgatagtgttcagggtaaatacttaaacccctttagagaatttcacacacagatactgtgcagcagaaaaaagggatacttatgtttcttaaagctgctacagcctacagctttgtacttaaagacagaggtgttgaatagaattctactgaggatacatccagtgacagtatctccaggaacatcagagcaaaccagtgggtaggactttctgtttttaacccttacatgagctgtgtgagagttgagctttactggtaccaagtcctaggatgtgcctggtacatctcaggaatgttaagaggatcgttcctagtgcctctgctctgcacacaataggaacaacactaaaaatgctgaagatgctgagacaaagtgacaggagctaggaaattccaagtgacagccttgccatctctcttaactcttagtgtgtggagagaaaaactggagtaaacagccagggtttgtgttttaaccttgtttctgtaggatttggctaaattttgacaaccttcgttaaatatacacacgcacatgtgcacacacacacatacacacatttcacacattctatatgtaaagaaaaaaaagatgaattctgctgctttaaatagttttaaccaccctgaaattcaaattgatgtaaaggtgtgaagatcctgctattttccctggggtgctattttagccttggctgctagaattcattttggattgctttgactagcagactatcatagcatttcagatatgaattaagaaaccctggtgcaagattggaatgtcagaaatttctctttttcctggaaaagatataacataaaacaaattatgtaacttatttcatctagggtttttttttttttgtggggagcatggtagagggattaaattcagctctagtctgttatttactttattataattacctctgaaatatcctagaagaatctcagtctagaagaatgaagtagtgtacaaaataataataataatcaccagacctacagatttgaaaggaaaacaagatttccaaaggatgtcgtgccatttatttggaatattatcaagatgttagaatctttttcccccaagttggttaatgaataatcactaaaactgttgcctcttgaaaaatattgttatgatgatccaatgagaaagtttgtaaaatataaaacatacataaatgcaaggtatcaccagtattgattttaaaaggaagcgtggagagtcttcaactgaggaatccttacttcgaggccggttgaccgagtcttccttattgacagcatccctttcctttcctaattttccttcctctggagctggggttcagtccaggagctaaagggactcacaacaatttggaactcagcgctcctcttgcaatgcgtctatccactgtgggttaaatactttgagaggctgggctgggaatctttccatattgtacagaaatgtctctatggagaaatgtactcccagtgccaaaaaatgacttacagagagccccgggaacacattaagttggcccttccgtgccttatggtaacataaccaccatcctgctccctcctcattgacatctgcaaaataatgacccttttttaaccaaagggaactgtgatctattttttttctgtattcctgaaaggatctctgtgattatttgtagatgatatttttaatagcatgttttccctaacaagttaaatgtgattgacatttttttttgcattttctttgcatgatctcagtccatctggaaccacctgtgacagtctcaattgtaaatttttccttcatatgtataaaaatctcaggcagatcatctcctacttgtttcttttaataccgctcaataaatctcctacttgtttttgattgacaaaattagctttcaactaaaaatctggagtcttcgggcactattcataattaaattttaatgttttagacatatctgcatagccatatctgcattggttataaagacttagagctggtggtagcttgagcatatatagccctcttattaaatattattaattgaaatgacaaattatgaaatatccagaattatgcgtcagatgttctttaacagatgttgggggattaagaggtttcaaattttacttgatgacataaacttttcatgcagttagcagtgacattttttaaaggatgggagtggtggcatataccaatgcttgtaatacattaatatgttcttgatactgaagtctcatgtcctggatacctgaacattgtttgggaagggtgggcagtattcagccatccagtaataaatatctcaaaggtaccaaatccaaaacccaagttttgatttctgtagtccctagtgtttcacagttcagtaatttgaactgtccagttgcccagactaaaaccttggagtcttcttgatgtatctcttgatttatcagtgaatccagttagctctactttcaaaatatactcatgacctgactacccttcactacctcctgtgctaccaccttggtaaaaactaccatcgtttataaaatagcctctcaaccagctttcctgcttctactaccctatgtccatcccagtcagaatgttcctttgagatacaagtcaggtcgtcgtttcactcccctgtttcaaacctactatcatgtttagaaatccaccttccttgcagtggcctaatgccctgcaggatctgtccattcctcgacctccatcagtgctccccctctttccctcccctaatgtctgccttactatgtctagaacatgcccagcccactcttgcccaggatttttgcatgtgccgctgcctttgtctggaatgtctgtccttctgtaatttacatgactctctccctcatttcattcagatctctgctcatgtcactttcttggagagagttgctctgaccaagcactctctcattgtagcagggccttactcttttctactgtactcttaacactttccaccaactgcaattatcctatatatccatttgttgtctgcctctacctgaaataatctccatgagggcagcagggacttggtctgttttagtcactcttatttccccagcctctagaacagcatctactgcataggaggtactcgacacatgtttgttaaaagaaagagttcacgtgaggtctgtgttctagtcctgccttttcctcccacccatgttgatcagtgtggccttaaatctttttttgggacggtcttactctgttgcctaggctagagtacagtggtgtgatcatagctcactgtagcctcaaactcctgggctcaagtgatttgcccacctcagcctcctgagttgctggaactacaagccatcatgcctgactaatttatttttatttttgcagagacaggttcttgctgtgttgaccaggctggtcttgaactcctggccttaagtcatcctctcaccttggcctcacagagtgctgggattacaggtgtgaataacagcacctggccaataaattctttttaactttatacattttcctaaaatattacctcttattacctgcttcacaggaatatttttgggttagttttattcttaaacaaacataactctcacaataataccccaaaacgtctttaacttctttttaaaaacaaaataatactgagggcacagaggacagtcttgttttatgcctctggcatttatagctgagaagattgagcaatcacaggcaaacaacttatgcaaatatggaaaatctttttttttttttaatgagaggcttaagtaggttattagtttcccagagtaccagtgttgctaaaagttagaatcatagtgttttgtcttatttgtgatcatccttcatattttagatttccctcttctggaaaaacttagtaaattgtcacaaaattaaatgacttctccaacaaagcttggactttcttgttacaaattttcaaaattatatagagaaagcagcatggactggacaggttttgggcacaggactagggaagtccctgaggagtaaactgacttcctctagacaagctgaaaactgattaaaatatttatcatcctttgggtatgcaatagcttttgatgatggaaggcatattaatattcatctttgctgcttgtctacacttcagacagatcccaggaaaggatgttcagatgaccagttttctttcctcaccaggagtccttgagaaaccagtacagcttggaaccaagaaatgccttgtgatgtggattgagcttttcctttgggggacgggaataggggaatacaaaccaggggagacctttggactggaaagctttaaaggatgactgctttcacacaggaagtcttttgctagaacaaaggaaaaagtttggttgtaattctataagcagcagaactattattgcttatctgaatacatgaagctgacttcattccttaggtaaagtcggaagattgaagccttataaaagattttgatgtgaatgccactgggggctgaagatttttcttcctccccaccaacccaccccaccactttgttgtaggagagaaatcagttgtgtttgtagccgatgctcaggtcttctgactggttctagagtgccccatctcccttttgtcctgagacagaattcgaatgcatatggcatccacatagcctggcataagtagcacagggtggccttctgggattctcaggatctgtcttttaatttttttttctttaatgtgagaaagagtctggctttattagttgagttaattaagcagtgttgttttttgtctaggttgaaatagccttgattacatttttggatgcaaataagacctctgaaagaactcgatctttatatgagcagtctgaaaaatctgaaagttaaatagaatattctcaaaaaaagggcaatgtgttaagactcttggtttccgtcttttaaatctgaaaattcagaatcctcttctcttgcatttcagtttttattattccacactactgagatattttgatgaaagctagccttaaacattggataataattatatttgaaatctattttaatatagtgacatcagaagtgctctttcttcatcccagtcatttaatcattcatctgctcctttttttttttttttttttttttttttgcagataagtgtggagttatacaaagagctaggacttatgtctcccaggttgataaggcacaaggcagtaagtaattcagaggaagaaaaaggagaagagcagattctgacagaggcctttgggaatacgaaggattttgatagatggagatgggtggagaatattcaaagatggcagaagcagggccatcgcagtgggaaaacacagacctgctcgcaaacttgattagactggatggagtttggtttgtgtgagtccagcagctagagataagattaggaagattagcaaggacctttttttctctaatgcatttctttgcaaggtatggcactttcaccccttaatgactggcttcctatcaaagtcatgggaagcaaagtgctaaacatgtgcaactaaaaataaaatgaaaaccgtttgattatcttgcacttgcaaaggttttactttgaaagcaagtcaaattcagttatttgcactactttcaagacctgtctgctttgtgagtacagcaaacaagcaacaccatacatttttagaatgagaattacaaatgagattaggtaatttttctaccaagattctttgtttttctctgataaattgaataccagcttaataattttggactttggtcagaagcaggtcttcccatgtatgaaccacttatgattctcttccttgttaggaaccctaagtgtatttcatttgatcttttgctattagagttgtggtttggaagaaatgacatcttcattgcctcttgtccaggtgacagtcttgtgaactcaatacttgcataaaaattattttgaaataaagccaaagtgtcattcatgagctatttgatttggttcaagagagtggatgtggtcttctctcacttccactgctgaaatagagtggtttctttcccacacatacctctccactccttggctaacagtcccacattagtgattgtgcactctctgctgtctctatttgccattgcacttcagcttgtcagtcacaccaattgaaagactgagtaaatgttcagaacgtaaatggccgttgttcactctggtctttcccacctttgcacataaatttctgctagaccctcatgttttccctctctatgtgatgctgttattttccaatgactggttttattacttctaaggcacaagatgttaattgttgagtgagtaataactctcagtttgttcttcaaacgtgggcttctgaaagattgcctttactttgattctgcttaggaatctagggtcttggggtaaatttagaggccactattctccttaaatgatagtgacatagagaaatgatactatgggactactgtttcattttaccaaagaaactgaagaaagtcacaccagagggtcattgctcccctagagaacaaatgggcttcaggctttttagaatgccttcttctttgatatctcattattgctcataatgccagagaaacaggtaacgtcggcatagtgatattgggcattgcttaatttctttcaaggcctgaaacatttatcctctcttctttatatattaggtattcaccctaatggtactcaaactgctaggctctgacaagctgaggtccaagtgccatggcattcaggaatgtcaatgttggaagggacctgagaggtgatcatcttctcttcctttttggaaaggaaggactcagaaggatgtaggcttttctggagggcatagagccagataatatagaaccccagatttcccagttcccagttcagtgctttctactactccctaaatatccatggctgtgcttgggatatttctctgatgcattcgccaactttcaacggtgtgccaatagcaaaataagataaactgagtgtttctctggaactttttctctaccctgtgtttggacctggcatatcaaaatgaggctctctggtgttgagatggacactgtttttgctcacccagcattcattcctccttctctggcagcatcctcatgttgccttgtggagccattttcttcattggctagagggtgaggtgcattgtcttattctggctactccatgagcatatgacctgagccagatctttcacatgagctttctcagagctgtttgcttataaatatacatacaatatcatagacacaggatgcagaattcaaaagttatcaacgtggccgggcatggtggctcattcctgtaattctagctcttagagagactgaggggcgaggatcacttcagactaagagttcaagaccagcaacatagcaagaccttgcctctacaaaaaatgcaaaagacttagccaggcgtagtggcacatgcccgtagttccagctactcgggagggtggggcaggaggatcacttgagtctaggagttggaggttacagtgagctgtggtagcaccactgtgctctagcctgggtgacagagtgagaccctgtctcttacaaaataaaaataaaaacaaagttataaaagcctatgctgtgaaaagtgtgtttctgtcccctcaatcctccagccactcattcccttcccaagaggctagcactattcttagttctttccatacctttctagggatattctagttttttttttttttttccttgagacggagtcttcctctgttgcccaggctggagtgcaatggtgcaatctaggctcattgcaacctttgcctcctgggtccaagcgattctcctgcctcagcctcccgagtcgctgggattccaggtgctcgccaccacaccaagctaatttttgtatttttagtagagacagggttttgttatgttggctagactagtctcaaactcctgacctcaagtgatctggccgcctcagcctcccaaagtgctgggattacaggcgtgagccactgtgcccagctaagatattctatgtagttacaaacgtttatgtgttttttccccacatggataacactatgtcttagagattgttccaaatttgtatgttcttttaaattactgtgtagctttttattgtatggttccataacttatgtaaccagacttctactgtctttagtcttctgcttttacaaataatattgtagtgagtatcctaatacataacgtttttcacaagtgagatctatggtaattaatacctaggagtaaaattgttggatcaaaggatgtgtgcatttttaattttaagagagatggtcaaatgccttccatagagtttgtagcagagtttatatgtgtgtgtgtgtaaatgtgtgtatttgtagatatatatactatctatatgtatgtatgtagagtttatatacatatataaatgtgtatatttacatatagattagtttatttacatatataaacatagacaatatacatatatgttatctatatacatgtgtatatgtatctatatttacatatagatatatgtatatacatatacatatatgtacatgtgtacatatgtgtccatataatgccagtttcccaacatcctcaccagtgcagtgtatcatcagacttttttgcaagaatgattggtgaaaaatggtgccccatttccatttgcatttctctcattcctgttttactgagaaagaaactaaggctcagatgtatgaaaagatttgtcaggtcataggagtagggagcaacagagctggggtttgcactgaggtgggagcaactgttctcttaattgctataataatctttacccaggctccattctgttactgcaactgaagaatcccaatacatatagcggttcccatgaggaacacccatctgtccttgactggtaaatgtgggaaggttgttctctttcaccatggacttgtgcgtcaaatcaactgatcagtctgggtgatgggtgcggttagcgtgacatgcagtgatgttattacgtggtggaactgagttccacacgggatgtaggtggccctttatgtaccctgctgagttctaggcctttgtgctataactatttttggcaatggaaggtgaagggagggctccccatccctggaaacatggcactttgcctgattttctgtttaaagttatgttcctgttggaatctgttcaggtctgagtttcagttgtcaccttctgatatgatgagcctccttggcctctcctgctcgcctcgttcttcctccacctgtcagtcttcattaggatcatttaaacactgactcattctctgctctgggccttttcctgcttggctatggaactgcaggttgaagcctttaccttgcacacatagtttgttaggtaagagttttatttcaagaagactttgcggggaactgtgatgactggggagtggttagaacaatattttctaataaagacaaggacgaaaagagatctcagcaggggaggagagctttctttgaccccttactatatttgagtgggtggacactaattctcaggagttgggggccttactagaccacatctcttgctgtgttatctcatgctatgttgtaaagtgagcatctgttgctggctgtatgacccatgtgatcagccactccatcacctttgaagtggtcaggcttagatattcttgggttaagagctttagctttcaagttaatcaaactggggtttgggccctgacttcatcattttgttgtgtatgacagtggcagtcatatggagagtctcaagtttcttcatttgtaaaatggggataataatagtatctcccttagcagatggttgtgagatttgcctgagataatacatgtagtgttttgtccattgcctggcatcttttgcatttttgctttgaatctacttcttttattcctcccgccatcctgctaatttggtgaccccttaactttcacctgagttcctgttgctccttagactctcatcttaggtttgtgcatatgtataatccatgctttccattcagttctctgttcaaaagtcacctcacagtggccctttctctttttaccatgttttatttttttcctgagagtatttatcactgtccgaaattatgttttatgtgttcacctattacctgtgctattctataagcaccttgagagcagggactctgtctcacatactgctgtgttcttggtgcctgaaacaaagtcataacacaacacatattggatgaacaagtgaagaagcaaatgtttcatgggtgtacgctctctctgaggtgcacccttttatgctagtggtgctttgtttgtgatatttgttgaatgccttgctcttccttctttttggcgtaatccatttgaaaaactcccttattttaaaagattcaataattatccattactaactgcagaaatcttatctttttcaccttctctggaatgtaatttctctgcattagactctgtcaacattagcatctatatcaaagacacttcatgcaactttttaaagacataagcaccagctccaggcatcggggttcagtagccatagctctcgatcttggctgcatatttgaaacacctaggacaatttttaaaatttttcatcagttaggtcccacctccagagatacagatttaattggtctaagctgtgggtcccatgtgattctaatgtttcaccaagttgcagtatggttcaaaacctcccaagtaatcctgacatgtgtttagggttgataattactgttcaacaggcacctgacttctcaccaagttagatttgattgaacggacgaatatatgaacagattagcgaatgaacaggaaggctccctcactttaaacgaacagagaggtattgagtgcctgctgtgtttccttcattctgtgggggactcgggagggaaacagctatgtttatgattcttatgtaaggtggaagatgatgttgataactatagtagaaacagactatgaaagcttggaagatggtaggatacatttaggtggatccgatttcaaagcttcacagtgaagcattttgagttgattcttatagaatggagagaattttaacaggaggatggacatgagaaaagagtggctatttcctatggagagaataacgtgtagagtggtagaagcaggaagatgcaggttatataaggcttctaaagtggaccagtggctgtccgttcccccaaactagcccccttctagagttccctaactgaagaagcagcaccactccacatccaggtcttcatgccagaaggagaggaatccttcttgaaacttccctctctccaccccaggtaccctgtgggagaactcttacctttgaaatacctctcaaagttgtctgcttttcatctctcctgctaccagccttcctctgggctattgcagtagcttactctatggtctcctatactcttcacacagcagccagggtaatattatcatatgcaaatctaatcatactcctctctgtgtaaactcattaatgggttccacttgctcttaggataaagactaaaatatagatgctcctcaacttacgatgggtctgtgtcctgatatacccattgaaagttgaaaatattgttaagttgaaattgcattcaatatacctaacctacccaacatcatagattagcctagagtgacttaaacatgctcagaacgcattagcctacccttggcaagatcatctaagacacagcctattttataataaagtgttggatatctcatgtaatttattgaatacagtacactgtagagtacagtattggtggtttgccctcatggtagcttggctgacggggagcacaaactctctgccacagcccagcatcgtgagagagtatgggactgtgtgtcgctaacctggccaatgatagaaatgcaaaattcaaagtatggtttctactgtgtgcatatagcttttgcaccctagtaaagttgaaaaattgtaagtcagacaaaccatcataagtcaaactgtcataagtcagggactgtctgtcctttatcctcagcccatcttttcctcctcacctttcctccaaccccttcactccctgtattcctaccacaatggccctttctcaatcagtctaatcacatcatgctcccttcttcttcagggcctttgcacacgtcatttgttcttcctggaatgtcttctctcaccaagagaggaatatatttctactcacttttaagataccagctcaattactccttcctcagtccagactcccttgatctgtctgactagatcaggtccctgcactatactttaccattactctcatgaaagccatgcttgagagctcaagctttattctggaggcactgagattctatggcagatagagtttgagagtacttacctgtttcgtgaaggtccagtgctgctagagacattaaagttgctgaagtggtttttggtcatataatttgtgaatcttattaaccatcccttgacaaagaactgagaattgttgatcatattgtaaaatagaatgtaaatggccatgcagtttctttgtatagattctccaaattattggaatatgagccaattccatgggattaatttaggtcctattatctgcaataagacatcccttgtcagattttcgttgtcaggggcaagtctaaaatgtccaaccattgcatgcaaactcgtagtaaagccattgtctagttattaacaaatgatgagcaggtgagtgaattgacaggaattattcttttgggatgttgcctctggcagaacctcagttatggcctctgtcattctcccttcctaatttcattatcttccaaatattattgacctcagatgttaagaaaggtccaggttcctgggggtcggcacatcgttccttcttttgccagatataagaaactttggggaccttggctaccagccttttcctgtcaggaaggtctggtgccatcctctttgatattgccctgtgcctgtctaggttggcagtcttgtgacaaatcagtacctgtcatggcccgtgggtactttggcacttcagagccatgcagaatgtggacagtgggtttggaattgtcattgagatgccactttcttattcttcttgtgttggtgcctagagtcacaatccggcctgaagggccaggaggttttctggcccagggtagatcccccttggcccacgtacaagaatcttcatgctgactgagttggaatctcctggtgagaagtgatttgttgtcctgatgagaatgtaaacacttgctaaagttgagtatcgtttctcatgtgagttctattatagccttctgtgtttataaacatgtcttgagcatgagggagaaatgtggtaacctttgagtccccaagaaaatgttcatttgttttctctgtgggctgaaattaagataactcagcatccttctctgagcatcccatatccctcttgcttttcctagcaggcctgggatgatgcccagtttgccatttcctaattgttccatcctcttccagtagagtctgttatcttttgaaaaagtacagttcatattcagcaggcatctaccagcggggctcaaagtccagggaagtcctcagtccagtctaacaaactgttattaaatttttttaaaggtttaaggtgtcgaacatttgagaaaacagagttgctgcccttgtgctgctcacatgtgtgttagcacatgtaacagacatatacatgaataaggcatgatgtgcagtggcaaatgagggggtagaaaatacatgttctgagggtgctgcagagaacagaagtcagattcagaaaactgggcaagactttatggaagaggagtgcctttcaattgtgccttgaaaggtgaattagattttaacaggcagagatttggtgggtgaaaaagagggacagagagccccgccttttttttttttttttttttttttttttttgagacagagccttttttttgagacagagtctcactctgtcacccaggctggagtgcagtggtgcaatcatggctcactgcagcctccgcctcccaggttcaagcgattcttctgcctcagcttcccaagtagctgggattacaggtgcccgccaccacgctcggctaatttttgtatttttggtagagacagggtttcaccatgttggccaggctggtctcgaactcctgacctcaggtgatccgcccgcattggctttccagagtgctgggattacaggtgtgagccaccacgcccagctgagagcctctttttttaaacaattttttttaagggacaggatcttgctctgtcatttagactagagtacagtggtataatcatagcttactgcagcctcgaactcctgggctcaagcgctcctcctgcctcagcctcccaaatagctggaagtatagctctaccaccacacagtctagctactatgcccggctaatttattatttgtggagatggggtctcactttgttccccaggttgggacggagcccattttagacagtacaaacaataggcacaagagggatggctctgtaacgttagtagggcatatttgcagaaaagtatgtggtgccttgtaaccagtacttccggtacctaggtggggtagaactagagaacaagtagaggggggagaatggggccagctgatgaagagctttgaatgatacacttagaaatttggcctttgttctggagacagtggttggagctggattcaaagatttttgagtaggaaagtgatccaatcgacccattcttcaaaattagaactggtagcagcattgtggatagactagagaggagaggctggaggcatggggacctgctgcaaaaattttgctgcaaaattatgaggttctgaaccagggcaataattggagggaattaaaaggggtggtaaattcagagtttttgttgattgttagtttgagactcagtcttactgtgtcacttaggctggagtgcagtggtgtgatctctgctcactgcaacctccgcctcccaggttcaagtaatcctcctgcctcagcctcccaagtagtggtattacagatgcgcaccaccatgcttggctaattttcgtaattttagtagagacgaggtttcgccatgttggccaggctagtgtcaaactcctgacctcaggggatccgcctgcctcgacgtcccaaagtgctgggattacaggtgtgagccactgcacccagcctgttttgtttttagataggtacatagaattcaccatcagtctggatgacagagctgagagatgatgaagtcacaggcaattttacaagatttcttctagtcttagttattagatggatggtgataccatttactgagctacacccaagaaggaagtttaggggcaaatgagtttgagcagccggtataccgaacatctcagaagagctgaaaataccagtttggaacttggtagagacgtcagagccaagcgtagatttgggagtttgatttatgtctgcagtaggcattcctttcatgcctatcatgtgccaggcagtgttctctcatatgttaactcaggcttgaaagcacttagcacatggcaggcatctccacagagacagtggctgagcgattggagtgagtaagagagaatgtagtttcaagagtaaaggagaacaaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatggtaaggacaggaggacaaggtgggggaagataggtgaatctatagatgcatttgtgtcatctgatctgaggagacatttctcagaaaccattctgtgtggcactgatgtttacaggtcaacctggaggttcctgagaggaagtgcactgtagccagacatgtggtatcccagctagctttactctgttctccagaaatcagcctgtaaacattcagttgcctggtagctgactaaatacaggctaacctaaagccttaaacattttaatttgcaaaacctttgttgtattaaatcacaaatgggaggcaatttagcaatgcatctctaaaattgcactgggctctggccgtggttttgcaatttatgttgaaaacgaaaattgaactctgtggcataaaaacagattgttgattttgtgattaatttggtctctaaggccaaggaaactgttaatgctgtatatcagttataaagttgtggtagtatttgtggagcaaaatgaaaaatcaatatcgtaactacaggatagctcttttaaaatccaaggtgcattttgttgcaaattgcatggaagaaactgtcccccaaagggacaaacataccttccttatttcacaagtgtgtgtctgttgtggaaaaacagaggaaaatggttgggcattattacagtatagctgggggtactaggagaaggatcaaattgttcaatttagagtaaaacctcacttacagttacctgtgtcctaaggcaacctccaggagtaatctctaggagggttgtgagtcagaagtccagatacctgggtaacactttagcctctgctaatcacttgctggtatcagatgagcctcttcccctccctggcgtgttttgtggttttatgtgttaacttcagagatgcactgacatgcgtcagtgaaaaaggagtgtcttccattagcatcattatgaatactacaccaaaggggtttgtttatgttttccattcctagaagtgaatagacttcttttctattaagcttgtgtatttagagaggagtgtggggaaattctttcttgttttgccttttgttttgataaaagcaaatggttcccactcgccgtagaatcatcatcaacagattgcatggggaatgttgaggttggagcctcttcttaatggggattttgagaaccaggacatgacttgttcaccggttcatttctgctggccatgatgcttagatgagaagtagatctctcaacatccaggcacatttgttctgcgattccacctaccattttcctgggtagtgctgggattaattaagtctgatacgccatccagttgaaatttactaccagcttcttagcctagtatatattatccttacaagtcaggcctcaccttgaggtcagaagaagatgcagcttgttcaagaaagaagtgttagtggaaatacgaagagttccttccagtgaactgtgcctcaagtggcctttgtaaactgcttctgttctgtgtgacttataattatctgagagctgggggttttgtggtagattttctttgatgtatgggcagtggtggtaatttgtttctttcttcccccttctattttgctttgcctcatttcaacttaagcaatgaattgtgtggtcttttataatatagagattagtgtagccatttttagccagtttttatcatctcccttaggagctgactctatgcaaaagaaacacttctgtcttgtcagaatgacggtgattaccccacagtttggatcatctccagcagctttgttccctgaaaagcgaatttgatttgatgaataaaagtttggtgtatttgatgagtcagagggcaggagaatgtccttgtctctgatgaggctcttacagtcagacacattgaacatcagggataaaataaaccttaatctctgaaggaaaaaccctggagcatgaaactgttcccactagaaatgctgtaaatcttgcaaaccatgtaggttttctgttgggggcaacatcaaagcccagtgactttagagattaaagtgtatttgacaagcaaaactttccctgtgccttgctctttatgagatttggcctgtctcttgcctttgtttcacctcgctatgacttcctttcttcctgagaagtaggaagtatcacctcaagtctggggtaggcggccatggtttgttcatttaaagccactcgtagacctggcgcagtggctcatgcctgtaatcctagcactttgggagtctgaggtgggtggatcacctgaggtcaggagttcaagaccagcttggccaacatggtgaaaccctatctctactaaaaatacaaaaattagctgggtgtggtggcgcatgcctgtaatcccagctacccaggaggctgaggcaggagaattgctggaaccctgggggcggaggctgctgtgagccgagaccacaccactgcactccggcttgggcggcagagtgaggctctgtctcaaaaaaagaaaaaaaaaaaaaaaagctggtcataggccctggccacagtccctcggccttctcgcattgtcctgccccagtggaggacagcgtcttctcacgatcacttcccagggactctcttatttgtggaagagtttcagagccttttgctgactcgaagaagatcaaaagacaggaagacagtggtttgcctcagcttggactttagcatttctgtttcttttaaaaccatctcctgtgatgtcttagaagaaatacttcttctttctttcttttttctttttttttttgtcctgtttcaaattctgtttcggagttctcagtgctttctctttcacacattggaaataaatgactgcatttttgttgaaataattttttttttgcagataaataattgtttaacagaatagaaacttttcttcagtaacgtctttttttggaaagtaagttacaagattttgctttaaaaatacaaactatttttaaagaattgtactctctaaagtcaaacattcctgcctcctgtcaagtccctataagatctggtctgtggcaacttctcagggtggtcagatagcaagaggaggacagattgggaaggcaaaatggctttaagggtaaaccccacagcgtaaaatctcattactggaaaagcgctttgtgtttaaggataggtattcccgtgtggaaggacggccatggcgaatgcttaagggactcactaaaatatcttaaattgtctccgttaaacatgtagcatccttagaggtcagacagagctgaaacttgaacagctgtacaacaagcatctgagattgtttttaattgtgtttcctttctctaacagcagtaattcttgtttatattgtcaagaacctttccactgagcacaagcgcaccatacttgaaggtcaaatgcttaacccttctgcatggttacaatgaaaatggacccttttgttttcattaatgtataccccagccatgtctacagggagaatgggggccccaagcgttcaccaagctgaagcaacttattgtaaaagagccacaaagagagcatatttttgtttccatacaacagttgtttagcttttgccttgtgcacccaaccataagacggtatgcttacttatcaatgggcagaattttgggggaccattttgttcctttgacctgtgttactttttactgacccaaccaaattgcttaaaaattttccctttctgctgtcagtgtttaaagctgcttaatgtctctgaagtgatcccttctttctttttaacactttacattcctgtttatcacagcacctgttactatagtgaaccatgaaatcacaaatgctatgcagctcttattgaccaataatactttattaaatataaatagagtatcctcccagcttctgtatggtgtataaaggtctcagtatatgaagacaaatgcacatatgtccataggtgcacatgtattgtttggtgggcaacaatcgggaaaggaggatgttttatttatttgtcaggcaagaaatgtttctttttctgctccttaagagttaaccaaaactaaaggggccagttcagcaaacactaaatgtgagcctccaacatgaaggcatctttgttactgaaacaaaaataccacagcaggtggtagactcgaacacaggagggaggaggaggttcagttgttgcccatttttctaatcctttcagaatacccattgtctgaaccccaaagttaacatgttcctgctcagtctcatggagacaatttcagcgtgaaagggctgtgcccatcactggttttcgacaacagtttaatctttgggtatggaatgtgtaaccactcaacaaggcaggagaggcaattgtctgtctgagatgagccaataatatctgcttatcaaagcataaaactattctggatgtggcaagtcagagttaagtaggaattcatgccaaccgcagcagtagtttgcaggttttagactgtattaatcaagacagaaacatgacttttgttgtccttggggcagctcaaagcaactttgtggcaaccacactggctttctaaagctaaggctaaactctgcacagtctgcatctatttatatcaaggtgcttcagtggggatatagcttttaaaatggattcataattgaagttggaatattgttttcattccctaaaactgaatgaaatgtagtttataactctggacctcagagtgccctacctaagtgggaggcattaaaagatgagttaaggggcaaaggcgggctagcagactgatgcctattactgcttatgatgaagggtaccactatccggttcatatgcttgggtctctctgtgttctcattgagccatccacaatcgtttcttttattctaaatcaccgttggaatgatataagaaaatgaatgcagtataatgagaattaaaaaaataaatttgtaagaagtatagagttggaaatcttgttcctataaacgtaagacacaaattctaatgagcttatagatggtccgtaaatcacgttttgctcatgtgaacattgaacattgggtattctttcctaaccagagagaagctacgattctgctgcctatgccacactttagatggaatgatggcctcttttagtggcactaaatgtatacacagagcactaaacatatacacagagcagtatctgcaaacttaaggacttgtgtgatcttctggataatactagcactcagaagttaacatttcatctgacgcattcctttcatatgtagtattcataaatgtgaaaatagccttaaatcattattttcacccttgacctgggacactatagctagggagaatctctgggatatctggaggggagctaaggctcatcaactatttggtggttgtctttctgagtttaaaaaatgatgctgtttactgtgacctcaggtgtctgtctgtgtgtccaagtgagactgtagtcggggagagtccctgattggagtctcagtcaccagaagtccagtcaccacttcttccaccagtggagactgtctgtgaaccctagtctgtcagtgaaaccatggtcaagggcgtagcatcattaaccccaattctgccagccatccttactctgctaccccatgagaatctgggccactcattgaacactccaagcctggattccttcacttggaaaatgagtttgctgaagataccaacctgccgtgtcagtttgttaaagggaatacatgagatgctgcattcctgcctcacagaaagttccttatagtttgtcatttcatagtttaggaggtaagagagtgaactctactacccactgggtttaactcttgtccccactacttatcagctctgtgatctgaggcaagttacttaatatctttgtgctttgattttcttttctgtaagctgggataataataaaaccgatttcactgaattgttataaggatttaaattggggttacatgaaaagtgattaggacagggcttggcacacggtaagtgtaaaataagtaatagttattgttatgtttttgttattgttgttgacacatttctgattatgtgttttaggtagtcattgtgatgggtttttttttcatggctactattaatatgttaataaatgcactgatatttccagttaataggtcctgaattcctatttgagagccataccacaaaattgagtgagtgtgtgtgtgtgtgtgtgtgtgtgtgtgtgtgtccatctgtccatccgtcgtccatctcctctgggtaaatatgtgccgagtagcaggtagttctgacattgaagactctgtagacagtggcgtttaggcagggactgcatttgtcttaggtagatattatctaaggacaagtacagcaactctgcccgtgtgattttcactgaattatccttttctaccagattgttattttatttaagttttaatcgttacaatgtcagtagcatgagcttagtgagacatagctttgacctcaggaatcttaagaaaaataagattattcttatcttaataataatagaaaaataagtttattaagagtgggccgggtttgtggtgatatttgttagttatatctttgttcctacaggtctacattttagttccattgtctcaaaatgaaaagataatagcacagtcatgtgttgcttaatgatggggatattttccgggaaatgtctcattaggtgatgttgttgttgtgtgaacatcatagagtgtacttacacaaacctagaaggtagagcctactacacacctaggctatatggtgtagtctgttgcccccaggctataaacctgtacagcatgttactgtactgcacactgtaggcaactgtgacacaatgataagtatttgtgtatctagagatatcgaaacatagaaaaggcagagtaaaaatatggcatgataatcttatgagaccactgtcatatatgtgatctgtcattgactggaacatcattatatgacacacaactctatttagcgaatcagtattaaatgataacatgaagattatgataggcaaggaacaggacattctagtagagcagagtaactattttataaatcaaaatcaaccctaaaagcttaatcaaatttaacagttattttatgtcccccttggtcatcctccaccctgtgtatatgttgtatttcccagcatagattgtaagctcctagtggccaggtattgtgaccttctggatgtcttctgtatagcagagactcaaatgtcattgattggtttatcacatggcagtttaccttcagtatgttccattccatatgttctgtataaaccgtgctgggcctggagttagaacacctggtttctagtctgagctcaacttctttacaaactttgatattaaagagttacttaatttagctaagcctcagtttccttgtctataaaaatgtgattaatacttgctctacccaacacacatagttagtatgaggatcaaatgagatgaagttaatgaaagcactttccgaactttgtcagtttacgtatatgttagttttgggcacaggcgcctgatgtctgggttagatttggctctgttgcttactaatgatataaaatttgacaaattacttaacctttctgagtctcagttttttcatttgcaaaatggaaatgataatacctttatcttatagacttatttttaggattcagtaacatagtatatgtgagcagcacctggcatatagaaagcacccaataatgttggctgctgtatcattatcatcattatcatgagtcagaaagtgtcgaggttaagagatatcagcttacctgatatcagtgcactctgctaccccatgagaccctggggtaagactgaataggggttggaaaacagtgtggagatgccttaaagaactaaaggtagaactaccatttgatccagcagtcccactactgggtgtctacccaaaggaaaagaattcattatacaaaaaaagatactttcacatgcatgtttatagcagcacaatttacaattgcagcaatacggaaccagtccaaatgcccatcagccaacaagcggataaagaaattgtggtatatgtatatatgtataccaaatggaatactattcagccataaaaagaaacaaaataatggcattcacagcaacctggatggaattggagaccattgttctaactgaagtaactcaggaatggaaaaccaaccatcgcatgttctcactcgtaagtgggagctaagctgtgaggaggcaaaggcataagaatgatacaatggactttggggacttggggaaaagggtgggaaggaggtgagggataaaagactacacattgggtacagtgtacactgctcaggtgatgagtgcaccaaaatctcaggaatcaccactaaagaatttattcatgtaaccaaacaccacctgtttcccaaaacctactgaaataataataattttaaaaagactaaatgggggaaagagaggaataaagaaaggcttcatttttatgactcattttagtagatttaatgtgactctgactggctggtactttagatttatcctaaatctcagtagcaaaattctagggagaaaaaggagctaacacttacagactggctgccatgtgtcaggtactatggtaagggccttatgtgtaaaaactaaatcctgtgagctctctgaagtagctgctataaatatcctcattttacacatgaggaaactgaggtccagagaggataagtaacttgcctgtggccagcttggtcgctaagttggccttcagggccttggttcttccttcctgtgctaaagtcctcaagtacaagggagacctcctgaatcaccaaaaataattttttcttcattgcagccaaaagcagagaagtttatgcatcagctttgctctaatttgagtttttgtactgtccagatcgcagcctacatagggcacatataaagtgtagaatttgtgtgtgtgtatatataattttcccaaatctttcatttttagctatacatttctctcatgttccaaaatgctgtctgcttaatgttccaaagcatctccaactccatgtgtctagtatggaacgcgtcccttgtgactttgcagtggcaggggttggcatgagggatatactgtctttgtgcctcagttttttcatctttaaaatggagatgcttgatatatggtgattgctggatgaagtgagataatgttgatggaatggttgttggcatggcaggtcgtaagcactaaataaacatagctgttgttcttattgccactctggggggaccagttctctaggcctgggggcagtagtaaggtctcagtaggaccttctggcttcactctcctgagcagataaaatttccactagggctttggtttgggtattgctgaaagaggagttgggtgggtaggtgggtgggggtagatatatacaaaggagtgaattataacaaagagccttttctgcttcaattcttgtgtagaaaacatatgttcagtgatgcaggcagcagttgggttaaagacacactgtagggccgcagacaaaaggcctgtgcccttcctgcattcacaatgtttccaaacatattcacttgtctcacttgttagggactgagctgtcagctggatcctcttgcaagtgtgatttctttttcccgtcccctttcaaaggccatccctcccttcccctctcccccagtgttttacacttcatataatccagtgtgcccgacagaccacttcagcctttgtgctgctgatgtttaggggaaggagagaattgatctgatggagatcttgggtaacttttcacttgtccaaggatcggaaagtgctaagccacttttaggccaaacatcatcagtggctcaattatttcgtacttggtatagttagccgttcttcaccttcaattaacagttaggacaacgaacagattagtgcagtggaattcttagaagtagcgtctgggaattaggggcatgtgtgtgttgtggtggggttgggagagttcttgcttttatttataaagttaatagtttttgataaaaagataaagataaggcaaggcaccgtggaagtatttggagagaagtcagctgtcattctagtattaattatgtgaaatgtacaggtatgtccatgtttaattctagattcaggtagtattgctatgtgccatggctgcagtttgagcattttcattttctttattgaaggttttgtggctctgatggttttattttcatcagtgagactttaaaaagatatatttatgtatattactttttgtgatatatatatatagcataacagtattaggtataatacttttatgtataatctaccaacactactattgaggtaacagcgagctagagatttaaagaattagcatgctaagtacttccatcactgattactcttgggcatttcaccctcccaaaatggacaagtgaaaatctgcaaaatgggaattacatgatcatcatactttataaagcgtaccatagtaaaataaaaacagttttatcgatgatggtcaacaacaacaattttcttgtctttgtagagatcttggattgtgtcttcattcccatatcattgagtcagttttaatgctctcatttcctttttttccccaagagttttgctcttgctttctgtttcatgctattgtttattagttgggttgctcatcctgaaaagcagcagcatatcccaaggaaggagaggcagtaggcaggcagagaatttcccattggcttaaagctgtaaatgggttgttagctcattttagcagtggagcaattataatcctgctaatgaatacgcaggcaagtggagtttcccatatatggtgtcttctggtgtgaggataatttcaacacctaaaaatccacagacaaaaaaaaatgtcatataagtattttttaacagaaaatgccaacaaagtcatcctcccaatacgtgtcagaaccgacaaaggaaactactgatggtgttataacttttagtactgtcatctgaaaaatccttgaaaggaaaacactgtggtaacgcatacatattcccctcagactgaaagtaacagcctgcaaagatcttagtagtgggtgaagctaatagactgcaagttgggatgaattgcacctaaggtggcacctttctcttgtgcctggagtggaatgtcacccagaaccaacagtagaacaactgggaaataagttgatattctttccaacatcgaatggattcatttcacagagttggggaggaagtgagggtaataagagtgtgtttctgaggctcttccttccagcagataggttttgttttcttggttgtaaaagaggctaatgcttcagaagctagagtgattcctggactctcttggtaagactaattatgctgtttcctgctcccgtctgtgaatcagctttgttacatagaatgcacgtaatagtgacgaagagtagactctactgaagcaaaccaatctattaggctgcttggaaaacagagggagaaagaagaacaatgattttgtaaactccataaaggccaaaaaaaggctttcagtaagtatgcagagactagaaatcaaatcccatttcctatcataagaagcctgttgtttcagccgtagtagttaatgtactgtatgtgaaagatttaagactggttggaaagctctgcttctgttttattaggctgctattgaaaagccaacagcataacttcgactaggtgctttgagatttcttaatgggctgtcaggggcaagacaccagggctgtgctatactagctctttcctgtacattaaaacaacaggggccaaacgatcacatacagaagtatgaattacttgatgctttctctgttccatatggccagccatgtctttggcaattaatcatgtacaaaatcagtcgagtgctctctgaagcattgaagtcaacatttagttgtacctgtgccagtaggggcagtggggttgcaggcgtaaaatagcaggatgaggggctgctggcgccaaggcccaagcagctggcttctataaacaacacttttttttcctctttacctttctcccccactttttctttctttctatttttttttttctttccttgacaagtacatggggctgtttttcaccatcatctgaaacaccagcgttgccaactggagctctgaggtctagctttcgtacattgccccagcatccgagcttaaacgtatggggcaggccatcttttcccacagcagcctgaacattccagcggtcgcccacatgactgtccccgagagtttctgcagtggcaggcaggctgctgtggctccatggctttttgtcaaacagaggaggcagagtgatttctctactcgtagaaggagagagatgggagatatggtgtaagtgctttggggaaaaaacaaaaataagtagtcattcatagtcatggctgtgatattttaggattttgggttttgtaaatcaatatccatatcttttcttctgtgatatttcccccaagacttcatacacataatgctgctgccaatagtcctaataccaatttctaacatttatcaagcattttgtgtatgctgagcactgtgctaagcactttacatggattatttcatttactcttcacaagagcttcacgagttcggtgctattacttatacccctttatggatgaggaaactgatcaaagaaacattttccctgaattctttcctcatagacattcttgattactctcagctagcccccttagctcaatagtacatgatggaaaaacactaaaatatgtcttactggcacatttttgaggagtcatgtggtgaactctgcggagatgttcagtcaaataaagtgggtctttgagatgaactgaaccaagtgtgtctttaaggtgggaatgaaagcctgctttgttggcagcctcttgaagacttctgcctttgtgccttcctttcaagacagtggagtttatctcctgctttcctgggtgagtagactatgaagggcgggggaggggaaggaaggatgaagacagcagccttaagtagtccagtagacgtggcacccagtggtgacttggtgttatctcttagccgaggtcatccaggatgcgttttctcaaattcaggaaacaggggaaagaaagttttaacattgtgtaaacattggcacccccaaaacctcctccgggagataaggtaggcagaagggctgggaggaatgtttatttgttctgccacgctgtggatccaagcatgctggaaatctttggtggtgcccagtccagtttagaaaatgtgaaggcatcactcagcattgagccaaagaggcctcacaaaagagccatcttaaactgacaatcactaaatgaaggaagacctgagatcgacctttctttgatgggactaaggctatctcagtgggttctgtgcctttcttcttttttttctttctttcttttttttgtaaaaaaaaaaaaaaaaggaaggagagaaaaaaagtgttcctggacttttgaagaggggagccctggttggggcttttgacagcctgtggcaatgttgatgtgaggaaatagctttcccagctgataacatcttaaaccaagtttcttcacaagttgaacctttagccctcattatcagtcagagcatatctttgtaatttgtgtgtgcagaggggaaatacagccctaacatgagacagctatgtatataaaaagtgttgggggtgacatttttcccgtaatgacagtattacttctgtggtggtagtgaggatgggtagatggggaggtcagaaaggtacgcagttctgggatcctggtgtttaaatgccttttgaaattgcaagaacagtagtagattttttttttaatgaactctgaagagggattaccagccatatttgtagaatgccatcctgtttccatgcatttccttagacaacattctttgatttgtaagacggagagattaagtctgagttttggggttacaggcctatcagaagccgttgcatcatatcagagaggaaccaaaaggattaaagacttgtatagaattattagtaaagagtaaatggtgtaagtctccttttaaatttcagagtggttcctctctgaaaaccctacatgcaacaaattctgctatgatacagtggaattaggacatactgaaagttactgactgtagcaatatgccccacaagaattaggtgaattgctgagttttaattgaatccgttcagaattgggagactttttccaagaaagacaggaaacttaagcataaaattcaaggctccttagagttcttggcttttcttttctaatttgcattcagtctctctctctgtctctctctggctgtggattttttgctttggttttatacatgaagttttgagccaggagaaatgaaagactctgggaaattcttaggggtccttaatatgctgtgtgttgccagaatccaaactagttttctctactgaaatggagaaagtgggacttcttcctcctatacataacctcatattaggagggtatatttttaggcacgtccatccaaatgagtattgtccttttaagtagtcacctaccaagggcatatactcatttttcttgattctgttacttaaaaatagtttttccgaccccgttcttagactcatcttcaggaatagtttgaatcaaatcacagatggtttcacatactgtttttgaccttgaatagtgctctctggcctgatcattagcttcactccccagacatgtttcagcatgtcatttggcttcatttattccaaagtatccatcaggagtccacttccgtggcatgttgccatattaggcaccttggagattattaagaaatggtcatggacccttctggtctaatggagcccacactctggaagagaaaaatttaaatgaatatgtaagtgcaatggagtacgacatggtggtgcataaagagaatgatcagctccatctaatttggtggaaggacgtagtttgtggaagacttcacagaggaggtgtttttgagatgtttcttgaagagtgagtagttactggaaagttatatggcaaaggtacaaatcgaagtatagtatagaatagccatgtgtttttagggaattacagttttatatgaaacagaagatgatagaagataaaatatgagaagtaagcaggacctgtatcaaaagggttttttttttccccaggctaaggaatttggatttaaaaaaaaaaatcattttttgtgtgtgtcctccaaatgccaataaccgaagcatatataaacaaaggtgctctggtttaggtgggattttgaagccaaagctccttgtctccttggtgaccctaagaaacttcgtggaagcactggggcttcatgacgaaagcctaaaaaccactattataggtgatgctgaattatttaagaggaagtaacatgtttggacatatacttttaaaagatcactcttgaagcaggaaaattaatgaaaggggtgagatggacacagacagatcagtttggaggccattacatggtccagaagagagatgggcctgaactaagcctatggcagtggggaaggggtaagtttcagtcatattgaagagagaagaatcacaggattttttatgtttaggtataggcagtgcaggaaaggaaagggaagaagattagggtgattcttagggttctagtttgggttattgcattgatagtagtgcagtcaccactctagggaaatacggtggaaggagagcaaaaatagttcaaatgtggacaggtgaaggtcaaatcttatgtttgaggcagtgtgtttaaggaagatagtcagttgttggctgtatgggaccagagcttagtggaaaggtccgcttgaaggtagaagcgtagagatgtccgcagtctacagggaacccttaaagccattggaagggcagatcacccagagagagagcaaaccgaagagatgagaggaggatgaaaggtatgaccttgggataacaacagttcctcatcctagaatgaggaaaggcatacaggagactgagaaggaccagcttagtgtcgggcactggcccaggagagagaggtgtccactaatggagagagatcaagtgaaatcagaacttgttctaaaaataaaacccaccctcaaaggataaagagataaagattttccaccactagggatatgcaaaaagatatgcctctggcttctggtacataaaaattttatggttgtgattgttcagtggttgcctgatttcctttaaagtttttccacttaaagtaatagacattttcaggaatccctttgttaaactagcataacctagcacaaggtagattggcagagtttaagatgaaagtaaacaataataatcatgatggcatatgtaccaggcaactaatacaagaattgtggagaggttctgttattatcaccatttggagttatgggaaagacccacagctaggaggtgacagcggggatttgagcagccagcactctaaagaatatattaatacttagttctttctgatctggcctgcatttccatagatttctattgaaaaaaagtactaataaaatgaaatttagccaccaggacacgtttcctaatgaaatgaaatttagccaccagtgcacgtttcctaaacctgtgggggttttctcctgtattttgggaggaggggagggagaatgtgtttttggtaataggagactgtttaaaaattgttacttgtttgaagacagttctatgttactactaatgggaaaatggtctataaacatttcctggggaagtcaacccttgaaaagccgacactattataaggagtaaaaatatcacattaattgccctgtaaaaagaatgctcttttgacactgaaatttccttttgtgcaatgatttcttttcaccctaaattttagagtttgaatgttcaaagttcacccttccttttctaatattaaaatagttttttgtaacagaatttgtttttgtcgttaagttatatttctttatatttttactacttatttgctagatgtgtttacttgaaacttgttttctgcattctttcttgttttaaaaatgtgatgcaaatgaagtttttgagttaaattaaattttataaaatttacatacaataaaattggccttattttggtatacaaccctataggttttttatggtttttatttgtttgtttgggtttttttttgaaatggagtctgctctgttgcccaggctggagtgcagtggcatgatcccggctcactacaacctatgcctcctgggttcaagcgattctcctgcctcagcctcccgagtagctgggattacagaagtatgccaccacacctggctaatttttgtattttagtagagacagggttttgccatgttggtcaggctgatctcaaactactgatctcagatgatctacctgcctcggcctcccaaagtgctgggattacaggcatgagccacatgtcctatgagttttaacatctgtataaactcacgtaaccaccaccacaatcaaggtacagaatggttccatcatgctcaaaaattcccttatgctgcgtcttgcccaaccgaatccctagcaaccaatgttatgttctctgtccctacagtattgcctgttccagaatgtcaaacaagtggttttgttcactgagcataatgtctttgagatgctgagtgatggcatacatcagttgctcagccctttttattgctgtagtggtgttctgttgtatggatgtaccaccgtgtatttatccatttaccctttaaggaacatttagattgtttccagtttttggtgattatgaagaaagttgccataaacatttgtgtacatgtttttgtttgaacataagttatcatttttttagataaatccctgtaaatgaaattgctaggtcatatgctaaacgtatgtttaactttataagaaattgccaaaccgtttgtcagaatggtagtattttgcattcctcctagtagtgtctcaacttttaaaaacttaaatgctattttagatgctcttgggttggggttggcaaattgtgtttcgcagtgccttggggctttgagaagatgccccaaaacaaagggaggacttctaggtcctccataccagcttcaaagagaactgttccagttttgtttgttgtatatattgggagttgcatgtaaggatacatttggggagaaaagagttttatctgcaaagtgtttaaaaaccattgcagtagggaagtgcacccacaatgtgagatgtggaccacaggtgatacagggtgatgctaggtggcacttggggactctgcacatgaggaccacactgtgaggcagtgattctctcttcagctccatctgtttatgtgattatgtcaaggaagtcttcatttaaatctgctgcatcgttattctccaccacttgttaatatcttcctttacaaagagggagcatgctttagtctcagagccctcagcaagcaacagtatctctctagaatgaaataaatatatagttttgtttatatttacttttatgattatcttcttttttttttttttttttttttttttgagacagagtctcgctcccaggctggagtgaagtggcgcgatcttggctcactgcaagctctgcctcccgggttcatgccattctcctgcctcagcctcctgagtagctgggactacgggcacctgccaccacgcccggctaattttttgtgtttttagtagagacggggtttcaccgtgttagccaggatggtctcgatctcctgatcttgtgatccacccatctgggcctcccaaaatgctgggattacaggcctgagccaccgcgccaggccaattatcttctcatttataagtaccatttttcttttgaagtgaacttatagttttaaaaaatgagccaattatcatagtatcattttttctttttttacttttatctagaaattactacgaaaaatgagtcaatttaaagaaaaatattaaatactgtattacatagttcatatacaaatgtggcaagaattatgaggatgtgctagaataactgaagtttaggaaactcttgaacttctagaggatctggttatttaaagaaaccttagagtgaatccttttgtgaagtgaagagctccttgataaagcacataactatttcttagtttatccattttatgagtttataatttatgtaatagttcttaaaagaagatagccttcattgttctttgtttttgtaatacttatttttcaagtcccttctttattcactgatttgacagatattttgtgggcaatggggatacggtgttgaactaaacaggcgacatcccctttctttgtgaaactttctttcttacatccttcccctcttagaggctgttcagagcctatggaaaacaagggcccctggataaaatgtaaatgatatgaaaggcaaggaagaggtaaatgactttaaaaaataaacattttaatagattcacaggggggaaaaattttgttttgatcatgttagctagctagatgtctactttgtctttcatttgatgcatttttgcattttggtaaaataatatgtatccacagatataaccacaaactatgtgactttttttttttttttttttttttttaagacagaggttcactcttgttgcccaggttggagtgcaatggcgcgatcttggctcactgcaacctccgcctcctgggttcaagcaattctcctgcctcagcctcccgaatagctgggattatagacgcctgccaccacacccagctaattttctatattttcagtagagacggggtttcaccatgttggccaggctggtcttgaattactaacctcaggtgatccactcaccttggtgtcctaaagtgctgggattacaggtgtgagccactgcacctggccgataaagtacttgactttttgaggttcctttcaactttaagaacatgaagtagggtgtcacagacaaggagtagtaccgttgttagaatacccgctaatgctcagacctctctgaaattagacatcttttagattagagatcacaaattggtagctgcctaagttctattcagcccattggtgtttctcatttgacccacatggtatttttttaaaaaattttaatgagtttacaagatttacaaaaatcagtttttacattaaacacacacacacacacacacacacacacacacacacgcacataccagatttcttgtttattttgaaaattcatgaatctagcatcagtgagccagcttttctgaatgtcagagctggctggatctgaatagtgcgtgccttttttaggcagaacatgtgctgtctttcagtaacctctgcttaactcattcatgttatgtgcctggcccagtgagtatttgaatttgcaacctgtggatcctgggtttcatgcactggaattacctagagaagctgaacattcctccttgtgctggagggctgaaaatgttgttgccacagaagctgcttgagtgtccaactgggcatatcttccagcacagtagatggaatactgggataggaggcagaatcagggtccttttcctggctagtgtcaggtggattatccaggcttcttcacaatggaggtactattttctgacttacctgtttgtatcagttaacatttttgatagcaacagaaacagattctgatgtggtttttttttttttttgagatggaacctcactctgttgcccaggctagagtacagtggtgtgatctcagctcatgcaaactccatctcccagatttcaagcaattctcctgcctcagcctcctgagtagctgttattatatgtgcacgccaccacgcctggcaaatttttgtatttttagtagagatggggttttgccatgttagggaggctgatttcgaactcctgacctcaagcaatctgcctgcctcagcctcccaaaatgctgggattacaggcatgaaccactgcactcagccctggtgaatttaaacaaaatgggactttattgaaaggatattgggtgactgacactatcaaaggaaaagcgaatgatctggcctcggaaagttctggaaactagagatactctgaggaccatgggtggaaggaattaagggaattgataaattgcctcagcattttcccccgtttctttatcattcctctcaagagtctgaaatcctggaaaagaatcaatttggtctggcccacatccttcataggggaagataggacaccttggttgacagtccctctaagactttataccatgaaagaaaagactttgtaagaagagatttaggtgatgttgccagacaaaggggatgaggtatggatttaagcaatagaaacaacaaatgttcactactcctcttctcaaggttgtcatgaagatattaaatatgcgctgtcaaatgctatcaaagagtaagggagtagtgtttcaagttacaggagaaccaggttatgggtatgctctttaagtaaacaaatatattggcgtctgttagataaggaatatattgaatgacttagaacacagacaatttcattgaaattgtagtggcaatttcattccttttagcaattgctttggttataaaatctccaaagaagccacactaactttaaattataaaacaacatctataaaaatctaaagatgttctttgagatactcattcaaagaaatggtctttctgatttttgtgttcccatttttttctttgcaagatcttgatttgcaacaggcaaggaaaatgagtgaatcttcccccttcttcccccacaaaacattgctggcatgggtagaaatttaaagtaatgattcaaataagagaggcagagaaagcctcagctgggtggcaggaaacaagagagtgaaagtcagaggctgctcttttttaaaaaggcaaaacaaacaactcacagtgaagtgtacgtgaaaatcatttctaataatagctcatggtaggcaattcccaggaaaaaaaaaatcgttggtgtgctgagaaaattagagtaagaatgcgcagtatcttgatgtgttacttaaggcaatggagctttagagtttaccttatgtgccatgtacattgattaaatacaaaatatatgccggccatttttggccatcatttactgcattgatttgttagcaggggaactgtaataaaaaagccattgatttactgtccttatttgcttatgggcttttttttattattaatttttcactttttctttctctgttttggatcatttcttgtagacaaatgctgtgcttcatgaagttaaaagagaggggctccccgtggaacaaaggaatgaaatcttgactgccatccttgcctcgctcactgcacgccagaacctgaggagagaatggcatgccaggttagttctgttgtgaaatgggatttgttgttcttgacaaacaagaactatatttggccaagcccttccttatggctggcctcatccctttcctttgagggcccatgaaaaataagcacgtttaagatgctttcagctaaagttagctttcctgcccacggcacctacattaattgtaatgatccattgacgtcatcagtatatttacacaatttgttcccaaatataacatttagcataagtgtttgcattttgagcataatgtaatataagtacctgatgctgaagaaccctttttaatcaacagtgtaaaagactagcattgctatttcattagagcagatgtctgagaaatccatatagtgctcctatatcactctatgcagggcagattacttgaaagtatagtcatgcatcccttaatgatggggataggttctgagaaatgtgttcttaggtgattttgccattgtgtgaaccccgcaaaccttgatgacatagcctactatacacctaggctatatggtgtcgtctgttgctcgggggctgcaaacctgtacagcatgttgctgtactgaatattataggcagttgtaacacaacaataagtattagtgtatctaagcatagctaagtatagaaaaggtactataaaaatatggtgttataatcttatgggacgggaccactgacatatataaggttcgccgttgaccaaaacctcaaaatgttgttacgtggcgatgactgtagcctatttatcaacccgatttttagggttgaccaactaggaatgactcttgtttcaacctggtctctttccatagagttgcctgtgcttagaaacggtgttactggtgaaaactttctttaaatcatcagtttttacagaactgatgcttgcatagtaaatatcatgtggtcctattctgttttgaaaaacagttgatatgtgggaggctagaactagttctcgcaaatgttaggattatcttttagatctgtagtttgtaaaaattattgaattgtcatccgtctctaagccagagggagaggaatcaggaagcgtatggcatattttgtctcagagtcttatttggtgcttaaaaattctatgtgcctggaagtcaagaacatttattgatagacataatattctccaaatgacttcatgcaacagaatttataataattgatagctttactagtaataattatcataaaaataagtttgtctgaacaaggctgaagatgagcattttccaagaaaggagacagtatgagtatttattctcattggatatcagaaagctgctttttcaaatatgtattatctttaaattcagacttgtatttaaacagtaatttaaaaattcccaatgatattcaccctccccttcccccatctttttggtggtgtggtcggagtaaatggcagacagtttcttttttttctttttagaaaaaaatgtttataaaaatagacacaggatcttgtcatgttgcccaggctggtcttaaactccttgcctcaagcgatcctcttgccttgacctcccaaagtgctgagattacaggcgcgagccaccatgcctgcccagtggcagacggtttcaactaaagtaatgactaaatgatttccaatttacctttcaataattaattttaaaattttctctgtattataagttaagcatgtatattcattaaagtatacatagtaaggaatggaatatcagtttgtggacatctaaggggtttctttgtctctgtttgatgtcttatgtcgccctcacgatgattccaattaaatagaaagggaggaagaaagaatttccctgtaatatctcctctgcttcccttccgtccaaagaccgtgtggcccagtgagagcataaatggatgtcttttgttgagtgcatttggtttgttaacaataattttttaatacaccaaatcattagacaacatggtcaaagtggcctgtttaaaaggaatctgctttcagcatttctggcccttactgctaacaatttaatcaggagctggagccagtgttgaagttgatgtagtctagcaactgaaacaaaaattctcaagtcctttgtgttaagggaggaggaaagaaagagcttaacagctgacactgtgcagacccccttaaaactaaacacctgaaagaaaatttcaagaggctggtgtcttgagatctcagaaggaaaagtgtcctcagagtattaaataaccataatccttctccccaccacttctccacctccatttgatgtttcccatcttagtgacctatctacagactcatccatgcgatccgtataaacagacggttaccatacacctttcttttcctcatcaaagtgtcatctggctgtctggaattgggcattgcctcgagtagccgtcaaatgggtggtggtgaaagttataaaacatccactgcagtgcttactaagcagcctgtgttttagagattggcctattgtgtacttcggaattacacaaggaaaaatgtgctttgacagaaaataattagcactcaccaaaggccaagcaataggttacagtattttactttcatcaaagctatcaggggatcagttagattagataatagaaatttttttcctctgaaagttaaatacacatgactctaattaccttatattgcacattagagagtgcattatgaattgtacaacttcaagaaatttaggtcaacggagccgccgcagctggcagtaactttagtataagtcttttgtaataaaggtttttacctctctttagcaggttcatttgcgatcatattagggagaatttttaaagtaaaacttgtaacctggttgtaaaatatttgtctgtctctcaggtcaggcgccaagccattgtttgggactcactgaagtctcttaaactgaagcatatgttccttgtaatttagctttttgaggaaagtgtcaattttgcatgacttggggtaaccgagtttgtcacagtgtcacacaacccagcgactctagaggcacatctgagtgctgtgggtttccttctccaagcttcgtaatcccataaacaaccctctccaaataggcttattagggctgtctattcacttccccagagttgaatgatccaaaggacatcgggagaagctgtgtgaatgcagggtaagtgttaacagaagtgggacagaatttctgaagattcgcctttgtttatccagtcccctctgcctgatggacagcttgttatagcttttaaagaactgggcgagccctctgatctgaccccttcttgacctgcgtagcccaaaggtcagtctgcagctaataaactctgaggttcttagggtctactgtaggaaaaggcagaaaaagagcagctgcaaggaccgggtgtcccaggataggctactttagggtcactctctgataatgaaaatgattaccaaattatatggaagtttaactgcaatcgtgagtgagaggagggtggggcccggcgtattaggtttgataaatgaactgtgaagaggcccatctggctctcaacatcttttctccccctctttccctaccaaggggaaacattttaaaataacagcagtacatatagactcaatgacccatgcaaggagctggaatggattaagatttaatggtgacagtggaagaaattatcatttgaaaagtgctccaaagaaaaggtacagttcaatgtccacacccgagttgtctttctaaataaaatataataaaaatcagcgccttgtttattttctacaaagccctggcgtctttcctagatggctgaaaattttgagggtgttgtttattatgggataattattcatagtttagcttcaggaacggaatgggcttcctttgccttgaagaagtcagaatgagaatcaaagattttgttctgcctgcctgcttcatttcagtgatgtaggtaaatcaagtgttagagaaaatgcttttccaaaaaaagtgtgtccatgtcagcatctgaccactgattattgtgcactctttagtactaaatatatgtgtgactcttgaacagagtcttattcctactacaacctggcagtttttctgtaaatataagaagaaagcacataatgttaactgagtagttacgtttggttctttctttgttccttttttcaaagaaacatcatggtgatgctaattattgccaacaatggatggggtcactatacgctattcgtctatttatttatcgctaattgataagattagtctatttaaagctctcccccagtttctcatgaacatagagtcttgatttcagaccagtgatgatggaggccatgtagctctgttcttttgcagagatgagtggcacatgccatgagtccactttctgaagggagaatgatttcattcagtgagcatctttttgtgtattttgtatacctactgcatgagatgctgtgcataatagggagtgagctaagtggccaatttcagggtttatctggggatgagaatgtagaaagttcctagaaagaggctgtggaaggcagtggcagggaaagcagtggaaccatcgttaccacaacagagcggcaagttctctgacccactcaggaaagtatttaatggtagatgtcttggaagactagaattgttgtgttactgaaaaccctttggctgggcatggtggctcacgcctgtaatcccagcactttgggaggcctagacgggcggatcatgaggtcaggagatgctgaccatcctggctaacacggtgaaaccctgtctctactaaaaatacaaaaaaaaaaaaaaattagccgggcttggtggcgggtgcctgtagtcccagctactcggaaggctgaggcaggagaatggcatgaacccgggaggcggagcttgcagtgagccgagatgacgccactgcactccagcctgggagcgagactctgtctcaaaataaaaaaagaaaaccctttatattgaactatactgactcgtaatacaggcctcacccagacaataattatgttaaaaaatcaaaacagaaggcttctaaacattatccaaagttagcatatttttcatcaaggttttggcttgactatctatgtctgggggcatttcgagtgagcagaaagccaggtagaggataattcagggagatggcaaatactttgagaatcaattgtgctttttaactttaaagccatggccctaaatttttgctaagtgaggtgtaaatacaaaaagcaaaccaaaaaaagagatgaaagcaaggtcattagggtttttaaaaaattgaggtacaagtcatatataacgtaaaattgcatataacaaaatttatcgttttaaagtgtacagttaagtgattttttagtatatgcacgagattgtgcaactgttaccactatccaattccagagcatcttccttccccagaaatgaaacccggcatctgttaacagccaccctccattcccccttctccccacagtcctgagcaaccaccagtctactttttatctctacagatttgcctatttataacatttcttataaatgaaatcatacaatacgtgaccttttatgtctggcttctttcatttggcatactgattgtaggatgcatccatgttatagcatataagtacttcattcttttttactgctgaataatattccactatatcgatgtgccacattttatttatccagtaatcaactgatgggcagttgggttgttggacagtaataaattgatggacatttgggtgggttgactttctggctatcatgaataatgctgctgtaaacattcatgtacaagtttttgagtgacatattttcagttctcttgggtatatacctaggaatggaattgctgggtcatatggtaattctgtgtctaactttttgaagaactgtcaggctgtttttcatgtctgttacaccatcttatgttcccaccaagaacgcacaaagtttcccatttttctatgtccttgtcgttacctgttattttcatttttttggactgtagatatcctagtggtatattattgtggttttgaattgcatttccctattgactaatggtgtcgagcatcttttcctgtgctttttgaaaactattgctttttcaatcggacattttaaaacatggcggacttaaggacttacccctcttgttggtgataaagagctcagaagcctgttaagaatatttggcttgtagaagaggtgaggttccaaatggggctgtcattaaattgcagcagtgcacgtttccccgttaccatggtcaggcctggctctttatttatttgcatgtggccccacttatttttttctagagattacctacttatttctcctaccattctcttacatttcattcaacattgcacactggataggaatgtagcctgattaaatggaaactcggtacctttatagctctttagcttttaggctcaaacaggagttactgtactcccataggagacaacttcatttgggtcgaaggagccttaaaaatggtgctgagattcatttcaactaatgtttatggaagtttcttcgaaaagcttttagaactacttgcttctacttaaaagtgactctcttaagatccagataactttatgtaaaaatatcttcctcatattggtctaagttcccatttttttctggactggtaaaacaacggtcttattattagtcatctttctattctctgtgaccccagccatcccatcaccacctacccccagaatggatccactctggacatctttgttaaggctgtaaaatctggttgttggaacctagaatgtgtaatgaataggatttactattccaagttaatcagctttagaactttgatcggggctcaacaagtataacactttgtataagttacttatatggatcaactagcacactgaggtgttctccaccggtatctgtctccccttctgcctcctagctagtcacggattatatgcaaaaccgacaagtcggcaccgtccagtttagcaattaactattatttattgagtgtttgttaggtgcaagtaactgtgctagacactgtggggaatatcaagatgagtatgacgtgagtctcaactgtggaataatttactttaatgtggaggtggtagttaataagaatacaatggctagcacacaccctttaactcttttttctatgaggcactgtgaaaccataaggtaatttagcaatggggtctgccctaagggaacttatattttgatagaagcttaaaaaatgaagtaacctgacattaattatatatggacttgattctgtgtttacatttttatctctcctaccagaatgaaagttttatgaggattggacgtttgtttgtttaccagccgtaaaacatacacctcaggccaggtgcagtggctcaggcctgtaatcccaactctttgggaggctgaggcgggcagattgcttgagctcaggagttcgagaacagccagggcaacatggtaaaaccccatctctgcaaaaagtgcaaacaactagccaggcacggtggcgcacacctgtagtcccagctacttgggaggctgaggtagggggaagcacttgagcccaggaggcagaggttgcagtgagccgattgcatcactacactccagcctgggtgacagagcaagaccctgtttcaaaacaaaagaacaaatttgcaccccagatctttgtaacattaagctatctcttccatttgaataatgccctctatcaaaggacctcattgcctgtttaccacatatccctggcatctagaagaatgcctgacactcagatttgtgaaatacctttcctctcaatctattccagtgtttataagtactttgtctgctttattaattttgaagaggaatgaccacttgtgatattggcctgttgctttttttgctctttttctcaaccttgcctggtgtggaaatcttgaaattcgaagtcaggatggatctctgatattggaagtaagcactggttattcatctaaccttgccaggggtggaagccttgaaactggaagtaaggagaaatctctactatgcagttctctggtgtttaagccccaacatggtaccacaggcccttattccagcatgagcaaagagggatgccatgtgcacaggctgactccagtgtacttgaggaagagaacaccatgggactgggctaagaccaggacaaaaagacatggtctcctccctgagccaccattcctaatttgttgactttcctagaagtgaaatggagctgggtgagaagaggaagaactggcatggcgaggaagaagagagttataaagacagccctgggacatgcctctgaataaagggatgggttttagttcagtagggataggaacaaagctgaggctaatatggcttccagtctgtaggcagctgttttttcctggtcacctgctaatgtcctcgtctgctttagtgatatcagcacagttatgaactttagcgttggtgattcggcatgtggactagaacttggagctgtgttcacaaaaagtggagctcctcaccttgaggatgggctgtgggataatgagactgatgcagttatctgctgagacaacctgtgattgtgtcatcggaccacgtcagctgctatcattcatgctaaagagactggctgcttactccggcacagctggttagttggaaactagaagttgtggcatctgtagttcggtagctgtcagttgctactaggtaaacttgtttgcagtgttggggtgggcatgaggaataaatggaagagattccagggagaagcagggaggcactggcctgctagttgccatccgggtcttttttaagacatctgtcccttcgcttttaataattacagtctctgctttttgctgcccttagcagaagaaagttctttgtgtttctgatccagattactccataaaacctgataactccataaaacctcctcaaaaatgtgtaggaattgaaacattgtataaatttagagcaaagattaaatgagtctagagatagggttacttttttcccccaagatacagcaacttatcttaaggaggcaagtgttgttaatgttattaccattgttactgtcattatttgaacagttttatgggggacaaaagccaattgacttctgtgcatcttatttataaaatcaacacatgggctttagcatgaactctgtttctggcaggtttctgactgtgatcagttgctggctggctgtttcttaggggcagtgcttcttaaactttttgagaaaacattgattcatttatttatccaacatacatttattaagtgtctattgttttctaagcactgttccaggttcacagcagtgaacagaactgatgacagttctttcatggagcttatattctagtggaatgacagatatgaactcttttcctaagcggaactctgaaaatttcttttataaaatgtgcatatagttgctatgccctgtatattcaccagcactcaacagtgaccaaaataaagtcattcagttgagataaagatacacagttctcttttctgagctttgttataaagtaatcacttgttataaaatttacatttcaagttgcagtgggtcatatttgggaagtagccgtgggatgccagttttctgaggaacaccatcctagggaatccgtaacataaattctccttcaattatccgtaccgtggttcccatttacttttccaagacctgcgtcactttaaaggtcttcatttgaaggaaggcttaaattcaggccacattatattgacaaatctctctgaagagagaatgggcaaagccatacctatctcataggtgttgggggattacctgtgataatgcactcaagtacttcataaatgctgggttttgttgttgggagtgatctgtcagtcatgcgttggttctgcaaatatttcttaagtgcctacctggtatgaggagctatcttaggtcctgaggttgtagagatgagtaacatttgattaggggaaatgtattacacaatgtagaatcataaatactatggaagagattgagtcatgattccatagaaacccacatcccagggaagaagacaggctctccttaagtgttctcataagactctcattatgtgcccagcgacagtgagaaatactgctccattccccaattgtgttggctaccagtagataggtagctatttgtctcaaagcatgagtgagaaataggagagaaatttatacgtgaggataggtcattgtataaaagttgtgctaccttctttccattgtataaagtttgtggaggaaaaatggttttctttcagagtaaatttaattaatatgtttgggggcatagattctgaatcagattgcctgggtttgaatcttggatccacttctataactccaggcaagttacaattgtggattgtaactagatgagttacttaacccctctgagcctcaattttctcgtttgttatttgcctaggggatgataataatagaacccatttcatagggttgattaagtgattaaatgtaaaacacccagagcaagtacctgtaacgtattaggtgttcaataaaaatgacctatcatgatcttcagatcaaaacaataaagccaggaataaacccagccacccttatccaaattggcctctcctttgagagaatgcctcatgaagtaaatatcctagcctcctggtaggggcctgatattgcaaaattggtgcagggaagaacactagacagagttggtgctctgtgctcagcagtgtcacacagaattgacaggtggagggctggactccagtttgaatcccatcattagtgactataggactctgggcatgtcacagacactctacgccttagcaactttatgtaagaaagaagcgacttgatctcgatcgccccaaaagtgggaggcatcttccagctctcacaaggagtggctccatacgtgagatccccgggagcagggaaaagtggatgttactcctgatgggtttcactcctctacttccactttccctgaagtctgcaattgtactaattttaacaacaatagcagctgacatttattgagaagtcactgtgttccagacagagttttaaatgttttatatgatgagaaaaccgaggcacagaggtgcagagtaacttgcccaaggcaacagctagtaagtagtgaagatggaatttaagccaagacggcccaggttggccaagagcaataacaaagctttagtttttaatcaaccactgatacgattcacttagtattttagagaccttctaggatccttctcagtgtggagataggcaggtatgtatctttacatatttatttcctctggtacctaacatgttttacactttttagttgtgggtgcatctctataaggaaatagtatccagctaatgcattatcaatctccctgccatggatcttttaaaggaaagttatcacctttatatgctctgtcatttcttttatattggttacagtcttttagaaggtgggagagtaggggtgaaaattagaacaccaaagtttagcctccaagaatctgtaaatctctgtaaatcctctaagtcaagtaattttggggctgcgttagtcaaggctgatttcagtgggtgcccttaaggtgaaagggtagcaatttatctactccataatgggttaatcaccagctgtacagtttgtttatatctaggaaacaatttaccacacatgaagagtagtaattttattctatctcaggggtatccccagtgtattttacaaatttactctgtaatgttatagataaaagtttaactctggctttcagttgaggaagtcatggtggaggaggatgggggaaggggaaggaacagctctactggcctgtaggggacactgttgcatcatttattagaattttccagtctattgtcccaggacaaaaaaaacaaaaccaaacaaatcagaaaacaaaaaaaaatagttgaatcaccttgaaaatgcttattagaattatttgaatcgttccaatgtgtttagaatgttcaggacttctcaggtattggtcagactgttcagtatccatgcgtgaaagaaataggttagtggttctttctgagacaggagtgtttgatgggactcttctgattacctttctctccatagtcaactttggatagggtgctcaggacgttactttttagtttaataaacctttaggtttagttaaccatcttcattttttattaagatatgctcatattaagttgttttgcttccagaatgtatgctaaataaatgtcccaatccttggaagggcgttttggaagttcctattgtcttctttttattcttatattttttttcactgaaaaagttgctgtttactgaaaaaatgaagtcatatctacaaggaaggcttatgtagggcctggtctgaactccaggaagcatatgaccagatgctgtgctacggctctctttccagactgttgacagccattgtatctgtccaggtaccccatggcctggccagcaaaacctccacccctctgcccagctctggcctctttcctaccagaatacgggcctgggaggcaactgcaatgaaccctcggaaagcataggttttgctaaggcagcctgcacagtaatgatattgttagcttgcttcatttccagtttcaccatcaattacgccatgtgtttcatccagttggtgctaccctcccagtgttaattataacctacaagactgttacagttaattttatggcaagcatattgtctcttcaaggctccagagcagctcataaattatcttgaaggtaaaatgtaacttggggaactagttatgaaaattccatccatctcgcttaggagctgcagctgctactgtcagctgccttgctgctgcactgtgaaggaattatggtgggtcaagtttaagagggtaggcccaggctgtcactgaggagaaaggctgtcctggccctgtcagacaagtaccttctgccaatccctggtggtttcactttgcaggcaggaagaggcaggcagcgcaggtggatggtccccaagctgtctgtattcattactttacagaaacttgttgtaggtaggcaggtccagagacctttcctcttctctgttgtcatgatgttaggcatcatctgcaaagtgtgagatagataactctataactaactctgggcttggttcaggagaggaggagaataagggggcggaagctattagtggcagcacttcccagccaccccttactggtctcctacttggtaatttctatcttgcaaaagcccctggcttgaacgagcattttatttgtggtggtgatttttcatataatctgataaagcgagatttcactgtggacgaatgtactcgaaaattgcctactaaataaattaacaggttatcttattgggataataaacacactccttttctatttcctcacacgaagtctaagctttacatttcagccctcggggctttagcattattatttttaatgactgaacacaagtctttcatttagcttgtttgtatagttactgtaaatgatctttctgctgttggtacttcatttgaaattctgcatgttatgctagctttaaaagctttgagggggccttggagaattgggaagctgtattaagcacagcatcttctagtggcattggaaacgggctatggcagaaaagtcagagagggtgtgttaagaaagtacgcctgcatgtataaatcaaagtctgagtttgagtgacgcgtacacaaacagtggtggtttcggtggcaggttgagaactcgccattgtaaagtaagagagccattcccttagctggtgatttctccttgtgtgtttctgagcacttttattgcattcacacatctactagtttttgtacgaagagtgcctcagatcattacactgcggctgtataagagacctggtttggagggatttgaaggacacatggaatagtgaattcatgtccaaagaggcaccgggctttctgaaggaagtattcgtctgagcttttgatgatgggggcatgagagttggatatttgtgagttttctagtgaatgctagtgaactcagaccagggattgcagattcagatgtctgtaggccatggtaatcatgtatgtagataaagccagagaggtgagacactgttaagttcaaggcaaaacacacgtgtgtgtgtatgccagaatctgcatagagtagaacaatgttacaaggtcacagaggcaatacccagattgtcttctggtctcctggccagcggacattcacactttgtctcaagtgggcagccaggcagctgctatccagccttgcgaggaggcaggatctatgttagtaggtcttccacattttcaacagaagtggaacattcatattgtatgtgtatgcttccgaagtctcacagtgatttaaatgttagcatgaattcaaatatttgtaactgttaggctaatcaaaacatgtgtggagcctggacattgtgggcaggattctgctatagaatgaaagtcctgactgctttgaattaaaaaccttctccatcttctcacacttctcaagaatagaaggaatgaccctggctgggagaccagtacacaatctgtgtattgcctctgtgaccttgtgaccttgtaacattgcattattccatgtaggttcttgcgcgtgagtgtgtatgtgtgtacgtgtgtgttgccttgaacttggcactatttcatctttccttttataaacaaagtatatgagagtttccaaaagtgaatgaggtgtatatggtgctcattgtcaccataaaaaggtgtccacaaaaatgttggcagttttgaatttgataaagggtttaattctcagaaaggaaggactgggacttattgctagtgaatcaccatttctcctgttacacccttgagctcctgctttagctcccatctcctccatgggggaacccagctgttctttcactgtagaagtgaagcttgaacaaagatgtcatgtggccagaatcatcttttagtctcaccactccacactgatggtcacatagaggtgtgagttgggaagttgttaaatacaagagggtttgagcttctggagaagaggaaaatgtaaaaatattttttcctttaagaaagataaaaaggtaagcctaaaccttggcggccaccgaagtcagctgttacgcatgtgtagttaaatttcactgtaaatatttcataagggttcttagaatggagccaggttgacatcacagccccaactgtaccaaaggaaccatttcattaaaataagccaacatttccaaagaaacacgaatgtctatggcagagttaacataaggtcagaaaatcctctggaagaaatttcggtatcaatgtttataatctctgcatttatggatttgcagtttgtgcaaaaaaaaaaaaaaaaacccagtgagactttattttggttaaataagactagcttgtgaaatagtctgtatatccagatccatcctaacccaatgccttggcagccttttggataaataatgtcttttccaaaatgtgtgtatttgaaaaaggaagaggaaaattaagtggcaaactgtgtctctgggttgccataaacgaacagaatccagaaacagaaagcaaagactgacagttcattcgttctttaaacaaattacatagctgtacgtttatttactgatgcatgaagggttgcagtgaagagcaaaatgtttaccctaactactttcattttctttttttggggggggaaagtaaaggtttatttaaacatttttttttttttggtgtgtaacacaaaatctatatgaggtttagaggcatttggcaggaaaaaaaaagatattcacatttgtaaaaaaaaaaaaaaaaaaaaaaaacttaatccatgctcacagatggtcctgttcaggtgctattttaattatgaggtaaaaaaacagccccacacagtaggaagtcgtcttaataaatggactggagcttttgtcttcaagcgtcaaaaagcctcgttactgagaaatttaaatactttgtattataggggagagtctcaaaatgaccaggatacttggagaaagcaaaatgatggattcttctaaagatcaaatgagtatacgagaaatgttttacaattgtatagctttgagcttccttagtattggtcattttagtgatattttttccagtgataaatgtcgtagatatattcatgcagccagaggaaaaataaacagaacaaattacaaatacatttaaaaaattttaatccacgtggaagtatttctttcctgttcttaagcgcaaagggctgctttgcccttcatgtgagagagtgcccagaagaactaatagtaattcaaatgatgcggtaacttacagcttgcattaataacacacaaatagaacagtcttcttactaaatattagtaatataataatgttttactgtctttcccatagtggggaattatgaggacctcatgttaggacctcagtgtcctgacatagttaattatccgtggataatggcttcagccaccagagttctcagtgaggcagctttgttgttgagggcttattaagtgtttgcagactcaggtgcggtgcacctaggctctttcctacagaagcaaacagctgtgttggctttaccgtattatacatcacataaagcatctcatttattataacgaagctaatgatgctagtggaaacctttatgtcccgttctatatagtgataatatatttgctgtaaagttgttagcttgtttttcgtaagtaattaatcttttcttataccaaatgtatcacatgaaaatgggttagcacagggtcaaaatacatttaaaccagtctgcagagattggataagacctttgaatagagcatcactttttttctttcacaaggacctcaccccgtctccaagctaccccccaacacaatgctcacattactaggaacttaggctaataacagggaactgctttcagttttttagtgctgagataggattcagacctgaatgtgtactaagccaagtaagcttagtgacagtcatccatgttcagtcccttaacaaggctgtgtattgtccatgtggataattttggtggtgggtttctgtctaatctacagtgactttgagtttgtgcctagggagactctagtgaaatgtgccaaggcctagttcagagagtcctgaagtagtgcgctgtgcgtggcacacaagatgattctgtgagacactgatgaatactttttatttgaaaatttatatgctttgctttttgtgtatatagggagacatttgaaattcactctcagcaattttgaaatcatgcactctattattattaactgtgttacactgctatgcaatatatctcaaaaactgattcctcctgtctaactgaatatattttacgttaggttagaaaagcataattagaatattggatccatggttttcaactaatattattgaggacaagactcaaatcaatcttgtttttttttttaagttgatttaaagaaaaatgctagaaatgcaataatgtgggtggttcatggatatggctaaaatcatgatagtggatcacatcatcaaagtttataaaatgctggccttataaactggaggggtgcagaaacatatgtttcaatcataattatgctattgattatgaagaagatgctgatcatcatcatcatcataataatagcagctaacctccactgagtctttactgtatgccaggtactattctacgtgttttgcccatattccttacttactcctcacaccaacccagtgaagtagttttgttttgttttctttcattttatagttaaggtgactaagacccagagaggttagggaatttactcaggatagcacaggttgtcagtggtcaagccaggatttgagcccaggcagtcagcttctggtgtcttcttcttaatctacttccttttgtgatagattaagaaatattattctctctctgttctctaaagaagaaaggtggagaagcaacatggaaacatgcaacatagcatatgataatgccatgattatccatgttttctgaagggctctaacctgtgcagctgactggaccctgctgagcctttggcttccttatgtagcatcctggatgtgtactagagcagatgacaagggtcagtggagcaaaaaaaatctttggcaacttcccatattttcgtacttagaaaagtatcataattcttttccccagtcactttaaatatatgcaagcagtatctaatcttgtgggaaactgaaagtgaaactctctagcaaagagcatggttatattccaaggcagaagagacagagttaacctatgaaaattaaccttgactgtcaacaaatgtgctgaaatgggtggaagaatacagcccacaagactgagatgtgggtgggaattggatctgccaggtcccagagctagacctaatgcacatgtttgaagttcttctgtgactctcgattaaccttgatttaaagttccagaaaaatgctcaagcaggtgagaattctcatactgtctttctcatttgatatttttctgagccaaagtgcctactttttttgagcggtatttatgactagttacattgcacaaggaaacttgacttgggtgaggtgttaaggtatggagaaatggataattgggaaacttagaaaacccgtccaatgaacgtttccaagtcaccctccccacgggcctagagtcatcatgaacaattacttgagaattgtgaagggctcaaagaggaaaactgcagaacaaaatgggttgaaagaatgtatacttttgtcatttcgacttgaagccaggggctaaaactcatgtcttacaccattgtagtctacaaccatttaatttgctaacaagacttaactgatcaggatctgcaacctccttctccagtataatcaaaacaagaagcatttggctctggaaagtaaacgttgtctatcttttattgtctggccccaccattttctttctggcaggctgagatgaaacagaaagctgatatttggagccactggaattgtaggccttgtaatttagaaatatccattttatcccgtgtaatttcttccctaagattcctcagtctaaatctgatacaggtaggagccaagacaaacagtaaccatttatagtcacccagaccagtttgaatttcactctaatgtaaagcaaaaagagtttttggcttcatttcaggtgtgtaacaggggtagaaaatgcatttaaaatttagcagcaaatgttaccatatgtttccataacaactgcaaacttttatgttagaaaagcaataatataaacacgtaggaatcttggaacagcaaactattaatttaccaaatataaaaaaatccagcatgaaggggcttttatagccacagaagccatgaggggcccagcatcctgtgaatttctccattatgtggcagaaaatgctgctggttcatttaaatgagcaaatcttttaaaattataggtacagtgtccattctccacagtgcatttttgtgaaacaatgtgtggtgatgccagctatggctgaattcttcttaccatattgaactagtaaaatacgcttcggaagctactcccaatgtatatctgtaaaacaacagcattttctaccttcacttatagcttcaaacttaatgacgaaggctagggtcctgcagaaagtgtagtgcccagtagttggccctaatgcttggcaaggagtagatgttcatagattgttgatagatatgaacaaggttctcagttttctcacctacccattttgaaatataaaaagacaaggggaaaaggggaaaggtggatctatttaagcacatctcgagaatgaggagttagtaagagttgttgaaatcaaattctctgttctctgatttccctgtggaacaaagaaataatcttcttttaacatggctacctgtggatgggcctttcatttaaaaggaggcagaactttttttttccctagacctacctcagagggtacatagggttttgaatctttactacaataaaaccaacaatgttaccttgtcatttaaggcagatggcgtaccttgactattcctgaaacttgggttcatgatgtcactatcattaaacatataccaatcaatgaagggtaagtaaagtcaaagagaaaagaaggtcaaagggaagtggctgacataaaacttaggtgcagaactctgggtgcacaggggatgcattcaggaagggtgctggtgtggctgcagggtagagagaagggtgaaatcttcagaactttagaaggcagagtaaagagacgacggtttcagctgtggcagggttttcaccttggcccctctttagctttcacagtagagcccatgggctgttgagccggaagtggtgcagcaggggcattggttaggaaggctcacgtcgttagtgggccaaaggagatggacgctaatgtttaaggagcctgaatggatctgagaaaacgtggccaagcagaagcaagagtgagtggcatgatttagagtagcagagatgggactggcaaaagaagagctgctttgtgaagacctgattcattcccaactctttggtggacctctatttttagagcagaaacctaatttcacccaagttaccaccgtctctaattagaccagtaagaaagtttctcctgtttctgtcagtgcttgaccacttctggagtgttttatcccataaagcattctttaagcattagtgccattggagtctagcattgaccatatgggtccttaatttgtatctgagtatccagttgcatgaagatggatggttaagaaaaaaaccaagagctattcatttattccacaaatatttactgaacacctaacagtgtccctggaactgggtatacaagagtgaacaaaaaaaccacagcctgtttcttgtgctggtagagcttacagtctagtggcaggaggctgactaaaaataagcaagcaagtaaaaaagaggatgtcagataatgacatgcactatggagaaaggcaacaggtaggcaattggggaggggaatggaactttttagggaagcctcatttaagctgagatgagggggaagagaaggaaccagtcaatatgacagagggagaagtaagtgagatgggatgagagaggaaggaggggtcacattttagggttggagtaaagacttcatcatggagtttgctgacagatgaaacataaatccaaattctatttacaaagtatacggaaagtttccactgtgtggccagtgctgtgttaggtgctgtggaaaacacagttcctctaatcaaggttatagtttagttgttgggaaagagacataattgattgtgagataaatgccaagttaaataacattgaccataagtacatcatgagctctttgaaataagtagtcagtgtgaattggggaagtctttatggagagaaagagggcatcaaaattggagctcaaaactattgaggctgggcgtgatggctcatgattgtaatcccagggctttggaaggccaaggtgggaggattgcttgaagccaggagttcaagaccggtctgggcaacatagccagatcccatctctacaaaaaaatttttaaataaaaattgaaaaaaaaatctattttgcacctcctatgtgttgatggtttgtgtgtatctttaatttttttccttgtagtaatcatacaaaggtgagtggtttcatccccatgttatagatgatgaaactgaattcagagaaagttaaagataactattgacaaaacttcagctcaaaccatttaacatctgagaacctaaaaatcactgaccactaactaaaaatatgacgggctttgagcatccctgtgatatttctctccctgtctctttctctgttttgccgttgatatgctaaatgtcagaaccaagaggatctgtgtgcttgtttttagggctgtggggaggaaagagtgctctggggagtggatggtctattatgaagcctgtctttgggagaaaattctccaaatcgagcaggtagtggcagctactaagtgatgaagaaagcagatctagtcactggaggagaagaggaaaattagtggaagaagtaggtacttcttccttaccttgtaaggttcaggagaccatcaggatgaaaagatcatgaagactattgcaattagaacacatctcaccggtgtatttcccacagacaagcagaaatgctataaaaggaggcataatacagtcatgaaacatctaaattttccttttttttttttcttcttttttattttttagatggagtttcattctcgttgcccaggctggagtgcaatggcacaatcttggctcactgcaacctccacctcccgggttcaagtgattctcctgcctcagcctcccaggtagctgggattacaggcgtgtgccaccacgccaggctaatttttttttatttttagtagagacggggtttctccatgttggtcaggctggtctcgaactcccgacgtcaggtgatccacccacctcggcctcccaaagtgccgggattacaggcatgaaccaccgcacctggtcccactttggttttagaactaaggcaaccctatttaaaatgtatttctataatatgtagatgtttgcttcagggatcctttccttagattatctttttaagggttggcctgggcatagataggtcaactttaagatgatcttttttcaattgagggcatatcccaataaaattttcttatcccctggcttgcccggggctggcatttctgacagacgtgtaaacagatgcaagcattgttgctaatgacaggtgattataagaggcatggaggccaaggtaattaaaccacgatttgacagggacatttggcaatgtgatatttcagcattagaactctctttgcaacgcacttcctccacttggcttggtgaatataattcatttttattcttcagagtgtgttgctttgagatctgaaactgtcctctctgaatttcttcatggttcattgtagaacgctagaaaatgattaccattggacgttgtgggaatctagtcagtatctaagaccctatccaaggttcgtccagtagtagtggaatagggtctgtgaccctactgctggcattgtatttgaatattattatgccctatgtgatagtgatagtgcctttggagagaaacatgagttattttcataccactctaatttcagtttctctgttacctggatttacttgacgttgttctcatgaatcaaaagatagcttattcaaatctcttcttccctaaatttccactactggcagtaggagaaatctcaaattatcagtaacctggtattaggaggaatgatagtagaaatgatcatcaagacatggaatttatttattcattggagttgaatgtaatttttttaaagtaccttctttttgctatcagtaacaatgcctctttaggcatttagagaccacctcctgctaaccgctaatgtggcaaacttatgaatatatatttgggggaatcctatcttctattgtttaaatagcagaccctcatggactgaatatttatagttttgatattgactagctacatgaattatattatttatagtgaacatagtagtgtggtttcatctaataaaataacaggtcacatttactatttgttatggtcctggcacttgtctaaaatagcaacttttcccaagtaggtcaatccattccttgactgcaaaatcagctttttaatactcttggtatagggcatgcgtggccattttaagagatcagtgaatcggcccacttagagaaggttaaccactagctagatagctgttacttttcctcgaccaattttgattttccccagaaagggatgtagagggaaatgaacttgtgagtatagtttcttatggcagaggagtgctgagtgattgtgcctcttcctgggttgcctcctccagcgtggaaagcttgggaacacttcggcgggcagcctgggaagctggcggccggcttttacattctgcttcaggctgcagtctgtttctaagcagaggcttttttaaagctttgtcagataggttaaaaggtgtcccacccccggtgtataaaaaagagagagcgagattaagcttactaagcctgccatgttccctgtaaaatatcaagtcaaaatgattttgaaatccaaagttaccaggcttagggggtgtgaccttgagtggaagcagcctgggaactgggaaggagagatctgtgcaaaagacaattggccacaggctggtggcctcgggaaagctgccgaagccaaagtgaattgtctcatttctctgccttgcagccaacagagcacaaccccaaataaatactcagcctgacatctaggccggtggattcaccatggagctccaggcagccaacctttctcagagtgcctgcttaaagcaaagcctgggttcagctccagcagctgatgggggtgaataagacagggtctctgccctcaggaagcttaaactcagaagaataccactaaaaattaaaatcctcattgaacccctacaaaagcatccaaatcctttgcatgtattatgaatgtgtttaatcctaaataataataatactaactagtacatattaagtgcctctctgtgccaagtactttttaagtgctttatgtgaattaactgttacaatggtaggtatgtttattatctctaattttaagaaaagggtacgtggagccaaaagatgtcaagtaaccttcccaggggcacaaggctgggaggcaggggagctgggattcccaagcaggaagtttggttccagagcccatgctctaggccagtggttctgtaattttagcattagaatcacctgtgggcttgtgaaacacagattgcaggcccttcctgaatgggcttgaatagttgcagtcctaacaaattctcaggtgatgtggatgcccacagctctatgccaagtgggaagagcacagtggaaaccagtcactataaaacaaggaaaagtggaacatcctgttactgatgtaagcagagtgctttgagaatgtcagtagtagctaataataatattatttattattattataattattattgtcattataactgtcatttattgagtgtttgtactggacacttttgtaaccatgtaaccattataactgttactgtgggtaatctcatttaatccacacaacaaccatatgaggtgttaactgtactgtacagctcaggaaactgaggcacagagagtttacaaacttgcctaaatgacaggccaaggattcaaactaccccagcctaattctggagcctaagcttttaaccatgaagaagatagtgaaaagaagggaatcaaacacccatccatagagcaggtagggtacaagctgggtcctgaaggaggaagatgcccaaaaaaggcttcccaaatggaatggatatgtgcaaaggcccaggggcatgaaggtgcaaagtgtgatagagagtgaataacatggagactcgtgtgtaaactgcatggcaagaagtgatgaaccgtaaggatgggaaagcaggttggttgaacagccttgaaaatgaggagtcaacagtattcaagactggacttggggatttttgaacctgtcagggacacactcagcctcaaaactcattttttgagacttccaaacagaatgacagtcatactttgttaaagatgcaatggggtcatctcttctctcctttacatagtttgagagtctcaaaatacgttcagagaagagctggatgtctaaggttactaaccctgtgacagtgaatcacaccctgccaggggaagggtattttgtacacagccacatcaaaaaaccagtgggatcatgtgtgcccagctgtgagtgtatccgtgtataaatccactcactacacttagaaaatgcctgccgtgcgtggcactggtgcaatggtatcgttggagctgccaacttgttttatttctgatagtgcttggcagcccctgaaggagggaaagtatgaatttttatctcccatttactagactttcattgtattgtgcttacagacacagtgtcagcacataaaatgttaaacatcactggtctgaaagaggctcccattgtcttacctctggtgctgggggaatcttgctagctttgctgtagtggttctgtcagtgtaatatgacatgaagcatttctcagtaatgacagacattgaatatgagtgacaggaaccctgaccacaaggaatgggttcaattaccagaaatgggggtggggggggcgcggttacctgagataaaaccaaagggcccaattgtgcttggttttgaccccttgactcccagatccagagcaaagacaaatggctgattaaccagcccctaaccctctttttcagtgataaacttgtttggatttctctgtccgaaaaaaaatctatgggtggcatggtttctaaaggaaatatgatcagaaacaggaggactggtgctcgtcatttttgtctcttgcaagcacaaaactgaaaactgtcattctatcttggactggatctaggacggtgtccagaaatcaatacaagataaatgattgctctcttcaccccacctttcttctgctgcagtgcctacattgctccagttcacctgtagccaacctgacgccagtgtaaatgagagatcctgccatcagaggctctccttttttttttttcccctctcctgcaggctgttctgctctgcatcgagtgcagctttgtgcttgtttatagtccactgcttacagcccccagatagagttatagcgagcagaccaattaaactgtcgcaggctgccctcacttgactagctctgcagagtcatttagccagcagacattcctgactattaaagctagtagcagcatgtctccagtgctggagataaaatgaatgaaatttgttattgtgggctgacacttgatcctagctgttgaactaatgctgttgcacctgaagtttttctttatggtaattgctgtctatgttattatttcatatactaaattggagaaaattgcaacaagtattaaattctttgagctaattcacgagagttctattgtgcattcttccaaggtagatcccaacttctgttgaagcctgggaagacagatgtagctagccagatgcactggcttgtgtttcatcattatcagagacatttcaatttcagatctggccaggcatttatcagctttacctgaaatctcttttaaaatacactttcgcttctaattcagtcagcatatgttgggatctaccctggggaattcagttatgatgaccaacattgacagtgatttgcgctagtctggctgattcagtgacagatacttggtggtatcagtaagtctctggcacagtatacgcttaggtaagtgggcagtgtgaaataagacttcccaccgggcacctttggaatccacagctctaactgggagtccttgaacacctcaggtagtaccacttcaatgagaacccatcagaacaggtacatgcaaggtacaccgcctcccaaagcatccgaatcactagtcctcactgccctgcccatctcctaatttctgttaactccttttaccagatctctttccagaattagggagattattttagacttttcaatataaaccatattcagagtttagtgaaatctctgaggcctctgtttctgtggtagattgcatagaagatcatttcttttacagcattcatttgtatgcttagcttgtggtcagagctcgtggtgaaggctccagacaggacccagaataagaattcaggcctggtttgtggtagaagtactatgcttgctttcatgttaatgctttgggaagacactgaccccaatcataacgttactttaatttctacctgaagaccacacctgacagacatagcagggctctgtcaattacagggacatacatctctagaaccccaagactttgtcacctccctactaggaaacagtaggctggttgtactccatattttgattagaggcaaatgtgagaggcctgaacgtcgaagtactagaagagagacatggggttttgttattatgtttcatcattctgcccccaaatttagggacagtccacagataatgatgcgtcctgcataagtgctttctctcttgacatagacaactgtaatttgaatgataatggctagcattagtgtctgtggtggaggatttagattgcaagttgaagtccatatagtttgtgaggtcccaaatatactgaatgtatgttggtctgcattatttctgatattcataacctttgtttaataaagaagctcttttaacaactcaaatctgctaaaattgaattactgtaatttgcagcaaagttcagcatgagaaatgtatattttctttccccactgagaaaatgaaagaagcattagtctttcgtttatatatgagatgggtagattatgtatagagtatcaagtttagaagatttattttcccacgctcaaatccaataggaaaaactggcattttcatcaaaactaaactaagactaatctttattctattttctgaaattgccaaatgtacaagttttaggtattttaaaacagtatagtcacaggcaaacattaacttgttcccagcggtccttcagatgcacattcattcttgtctttggtatttgaggatcctaatgataccataataacacaagtaaaagttgctgtataatagctgcatgtgtgcatttcagacccagaactaattctccatgtttctgtctctgtgtctctcaagcaggagtggtaagctcttctctccaaatcttacctggacttacttttctgtatatttgtgttattgttggggcctagattgacctcttttgtgtggacagcacagagaacatagggaagacctcagcatgcaagctgattgacatcatttggatctgtgtctctgaccaaatctcatgtcaaattgtaatccccagtgttggaggaggagcctggtgggaggtgtttggatcgtgggacagagttctcatgaatggtttagcaccgtccacccttggtactgtgtagtgagtgagcccttgtgagatctggttgttaaaaagtgtgtaccacctctgccccgacccttgctcctgatctggccacgtgacgtgcctgcttcccctttgccttccaccattgtaagtttcctgaggcctccccagaagctgagtggatgccagcatcatgcatcctgtacagcctgcagaaccatgagccaattaaacctcttttctttataaattatccagtctcactctgtctcccaggctggagtgcagtagcacgatcttagctcactgcagcctccgcctcccaggttcaagtgattctcctgcctcagcctcccaagtagctgggattacaggcacccgccacaatgcctggctaatttttatatttttagtagagacagggtttcaccatgttgaccaggctggtctgaagctcctgacctcaggtcatcctcctgccttggcctcccaaagtgctgggattacaggtgtgagccaccgcgcccggcctaccaatgtatttcttaaaatttaaactttaaaactgttttcctaagtgtggataatttagaatgggttgagctgatatggtccttcccatgtgaattataggcctttgttcaggtcagggatcagcaaactttttctttaaaaggccagatagtaaatatctcagattttgtgagccatacagtttctgtgacaactgttctcctctgttgttgtagttcaaaaacagccctggacaatatgtaaatgagtaagtgtggctgtgttccagtaaaactttatttactaaaagaggtggcaggatttgactgtcaggccatagtttaccaacccctagttgaggccaggaggaagggttatgtttaagggaaccagaacacaaccaatatgttgtattcttttttcatttgttgttcatgtaaattgctggtgagagagatgttctctcagcagaacttgaaaccattttcattggctggggtttaatatttttttaaatctcttgtttaagcacatactaaaagtgtccatgttctttccattaaatgtgttggttgccttcccagacttcaaattgcagtgaatttatccccaaaagatgtttggtatcaattctcaagatgcaatttgaatgtagtctgcttctataatggaaacagtattccaaatcttcattatttaagtttcatagaaaataatgaatcattgaattggttattactcaacattgttaaggcatatactgaattctttgttttcttgtcttatagccttatatcagctcaaaggataaaatagtatgaagatttcattttatggatacatatgagacattagattattattttctagctaaatcgtggtaaacacaaattatattataatgaagcttttttcccaataagcattttataagaggaaaacctgaaaacaaacaacaatcagcaaaaagtttatgagtcattcaccctaacaattgtaatagtttccttgttactccattcctgtagtgatgaaccccccgccctttttttgttttgagatggagtctccctctgttgcccaggctggagtgcagtggcgtgatctcggctcactgcaacctccgcctcctgggttcaagcgattctcctgcctcagcctcccaagtagctgggactacaggcatgcgtcaccacgcctggcttgtttttttgtatttttagtagagacggggtttcaccatattggccaggttggtcttgaactcctgaccttgtgatccgcccaccttggcctcccaaagtgctaggatgacccccttttataaaacgtcccatcatgttagctccatatagtagggattagtgacatcaaattctttttgggaatttatagtggcactaggggtagcagtatcatttaactgtgtggcatgtttgggtaggtagcttttctgtttaaaagtaatcacccttccccacccaagggcaactgtactggggatggaggagaggtgtcagcagaaattgcattctcaacatctcaacttccttgctccctgcctaagtgcctcctgaaccatcagcttactataactaaagtttcttgtgttctcttgatttatctcatgctgtacctgtgaaatatttagttaccctcattctctcttttctctctgttttctagagcaacgacatagggcagtggaaaaagaatgagttttggagtcaaaacccctgttatcttggaaaagccatttaacttccttgaccttcagtttcatcttgtgtaaaatcagaataataatgccaaccttatagagtaattttgaaactttttttttttttttttgagttagagtcttcctctgtcacccaggctggagtgcagtggcacgatctcggctcactgcaacctctgcctcccggattcaagagattctcctgcctcagcctcctaagtagctgggattacaggcatacgccaccacgcctaactaatttttgtgtttttagtagagatggggtttcaccatgttggccaggctgatctcgaactcctggcctcaagtgatccgcccaccttgtcctcccaaagtgctgggattacaggtgtgagccaccatggcagctgtaattttgaaacttaatgaggatgtatatttaagtgctttgcaaattgtgtttataatgtatttgttatttttactgtttaattgtctgcccctaccctgttctggagaatcttgtaccatcattaaaataagtaaatccatagtgctattaatcttggaacattctatgtggaattgcccatatgaaaagcagtttgattatgacagaatgccaggcagcagtgttcccattgtgttgaataaatggcatccccacaatcacaatctcaaataccaaaatcaacaaggaaaattccaagcagctgcctttataacttctgatttgtgggccacatttgaaaccacagtttgatttctcagtctacaacattttaattcatagagcaggtctttctctattagcacattctcaagatcttttgttgatcttggtttcagttgctctggagaacaactgccttccaaagctcccttttaaagtaaattttctttttaatagctaattctatttagaggtggaccaagccaagaatagcctccaagttcagtgaccatctttgcagtcatatacaagtgatgcaatcacaaaaagaaagaaacttaattttatgccgctagatatgaaagacaggtagctatgaatgcatggctccaggaccttctgccatgtcaaatgagctaaacccttccccgaaagccagccaggaaaacgtatgataccatttgcaatggtagaatgttgcatgctgttcttctgtaattataatggcctgatccgtgtggagtgggtgagtcctgcttaacaatcgttaatctactgagtcttcgtatcagcctcccatcttgaggagcagcagttcttggctggatgagtcggtctttgatttcattataataaggatagctttgttaaaattccgctgcgcagtggtgcctaaggattctgggaaaaggtttttctttttattttcccctttttttgcacggtggggatgaattgtttctctctcttccatcccctaggttactgtttgtgctctcccttgatctcctgcttgtccctttatttctccacgttgtgaaagtttctttctgtgtgaccaggagtctgtttagcagaccatattgtgagtgaagggccagcgtttgttgcctgattttggcaacgctgggtagtcagctgggatgtaattaagactctgagaacaggctgtcttctccacgggaagggcatgttagatggtgctgggatttggggctgtcagtttggccaaggatggagacagagagctagggacagagatatttcctttcatttataatccctttatgtacagtgtgtgcacttggcaaagtttacatataacctagtggctagagcttacaagccaacgcagtgaaattagcatatgttacatgtattttttagtaatattttaaagcaagtgcatatttccaaagtgaattatgcatggatgacagcaatagggttgtgttgcactgggtgtcaaatcccacaactttttgtcgagactgtgggttttacactaaaaaggcagaaagactaaacgaagtaaaacagttttaatttttaacagtttggttcggcccaaggagccgggctgtgacagatataactgacatttgaataattggattaatttagagaagggcaaatccggttttgacggttgtgcttgtgtgtacatctttttttattattatttgcaggaatggagttgtgtggtttaaatatacactttttgtgctgcctagcaaatcttgagaaaacatcacaaaatttatgaaattatcatttaattaatttgttttaatttatatgtatgtatatgtgtgtgttcacatattatgcagccttcatatgtatataaaagaaattcaccatatatacttgattcgggtctatcagtgatatacatatatacacattgcacatacaagcacattgtatgtgcacttaggaacttagtaaatccagcttgagataatgtgcatgacttcataggatgtatagaaaatgtgcagacaaggaagctcactgtgacattggcaagcccctttcctccccatatcaatgtgttgcaaaacatcacagtgcagaagcagaaaagcctaatttggtatctggggtatcagtagccaaattctacatggttgattcctcagtcctaagttccttcagattcatatggctttttaagtttcatatatgaagataatcttggcaacataaaaccaagtacagcaccatcatcgccaccctcctccagaaattctggtaatgaaatacaccatctaaaatcagcaggccaagtctaggactcgtggcaggcagtcttgaattgtggctgtgggctggctctaagagccttttccccagcaggacattaatagacattaacactctcggacaagaagtgttgatgtgtggtttataatgttagcacccagttaggcaggtataacacatgctgtaggaatcttgtaccaacacatgtgtgtgttgagtcagattaatgagaaccataaaaggagagacatttcacttgagctggggacctcatcctatccttttaccaagtaaaccagtgctcagctgggtggcagtgtcctggtgggatgttttcaatattagcataaggaggatatttgaaagttttgttttgctttgttgttatgtgatcatgaagcccaaactgttagtcagtacagcacattcaaactccttttcatctagtactgtttggctcagaggaaaggaaactttcacgatattcacaactacactatggggcaaaagttattattttcctctctcagatttacctgacccttcttcaagtgtttctgaatgattctgagacactttctggtttactttgtaaatggggcaatgaagcattcttatctcctgactggttctccttagagaattctcaaagccttttaaaattgtgtgtttttctggggcagccttgaaagtcccaggagtgaagttgccatctgtcctttatattaaaagaatcttctgtattgtatacctgatgtgcttgtcccagagatagatattgttaattaaaggacagcatttgtcctttatctgaaataactctcttgcctgaataacagtttcccaagccttaggaaacaggtaaggacattcggcccagagccctgatgtttactaaaggtccttggtccaggagctgtccctcagccttcactagatcagacatgtagactagaaaattacttgcttattttttggggggggcttgttttctattaattcatctaccaacattatggccttttgcatgcgtgtaagtaaatgaacataatatatactgtcattggtagtttgtgctttttttgtggcgactcacaaacagcgagttcccagacattctcaccacactgcatctttatgcaatagatgtgacaggacctatatcctccagtgtcacctctctactactgcacactctctgtttctataccttctgcccctgggaaaagaaaaatgcaaacatctgcctacagcaaacagagccagagttctgccaggtgatagctagaatatgtatagggagaaagaaagcctcgcccgtaacctgctctatctctgtctcaggaaacgcagaaaataatttgtctctgtaatatagaaaagcagttagggtaacgtggctgtgaactgctgcctaaaagtgtgctgtgtgctcgcctctgtagttgctaagcacggaggaggaggctagccagggccttgccacagactaacttcaagaaaagaggaaaagagtgcaccagcagactctggactgaggagcatgtccaacggaggaggcgaggtgtggccaatggttcttttgttgataagaaagaccctgaaattgcctgttgcatggtgaggagagtagtagattggaccgtaattttctggtgacctaacaaaccaaactaaagctcaagtttaataggcaatgattcccgtttaaaagggaattcaaattatttacagttctccatcatcatttgcctcccttaatcatatggactaggaattgggcaggtgacatacaagagggaagccgacttgggtgaaaaacaacaggggctgggcgcggtagctcaagcctgtaatcccagcactttgggaggccaaggcgggtggatcccctgaggtcaggagttcgagaccagcttggctgacatggagaatccccatctctactaaaaatacaaaaataagccggttgtggtggtgggcgcctataatcccaactactcgggaggctgaggcagggagaattgcttgaacctgtgaggcagaggtcatagtgagccgagattgcaccattgtactccagcctgggcaacagggcgagactccatctcaaaaaaaaaaaaaaaaagaaaagaaaaaagaaaaagacaacagggatggtggtgggtatggcaaacaggtgggcacttatgctgtctacaagggacagttgcttccaactccaaacagttattaccttacagaggtgtgggcccaggattgcaagactagatttttcggtgaaagccgccagtgtgacactttttgagttttcagtgttggcagataattcactgttttaaaacatgcagataaaactcaactgtagttggatgtactttacgggttgctagtttgcacacacttatatacataatgcagaacataagtgggaatattctaaataatagacagtgtggaaacttttcttaataatagtaagaaactgagccccaaacaactattaatatgtttagatgtttccctttgggtctttatttactgcatatacattttatatacatgttttaaaatagttgtaatcataggagcctgtgatttttcacttactgttagaagcagtttctttatatgatttataatggctactggatattccatgtagaggatgtattacaatatgcaaaatcatttccttattgttggacctttaagttgcttttgatttaacatagttataagtaatgctgcaattacatatttgcttataccgctttctcctttttttggattagatccttagaatctaaaaggaagattactaagtcaaaagatatgaacgtttttatggcttttggtacatattaccagattgctttccaaaagcgttgcaccaatttacactgcaatcagcaaagtatacatttatccttgaagcattattatatttttgaggtttttccttctaaactggtaggtgaaaattggacttcattgatgtttgagtttgcatttcttgaggttttcccgttaatctgtcgactaattgtatttgttcttacaacatctgtattttctaaggttaaattttgtggaggttttgtttgctttgtgtatatgtgtgtatttttaaagttctctttataacaattgataaataatttgggaacagcccccttggcaaggccttcctctaggggaccccctgtctcagcagtgctgcagctgctacttttaactgtgtgttaactcggagttgggccagggcctaagcaggatccccttcccgaagaggggctcttttgtgtctggtgaaccacaagctcagggctgtatctgccaatatgtttttggcagaagccatctaataaaatcccatccgcgctgttctatgaaatgcagtcacaaatttggatgatgattgcctgatgccatattttggtaacagctaatctccatgtcttagatggtttttattcattgcctccccccttccctccttcaccactctgcttggtgcatgttttaacgacaaatgatgtataatctgagtttcatgtagcatggtctaatggaaaggcactgagccagtcatatggagacaggggtcctattattggcactgccctttgcttaataatagcttaacaactacaacaaatatttatcctgtgctgaaatgctctttcagcattcttcatgtattcttgaatcttcctaacagtcctgttagacaatattattatcctcgtttaggtgaggaaactaaggctcggagtattggaaatttccagtacttgtattggaaagtatgatattggacaagtattttcaatacgtgtgttgaagatattggaaatacttgtccaatatcatccttcatctctctgaactaaaaatgagttttttatttctagtaatctgtctccccatctgcaaaatggagttgcttctcttcaactcagaatggtggcatggaactaaaatgatgccatgtagatattaagttgccttgagtattgaaatccaagacaataaattggtaataatatgtagttattaactagttcacctctgtgactctcagcttcttcattaattaaatgtagggactgaaccagattcatttcattggttactttcagctatcacattttcccatcagccacagactcaaatgttggtggataaagcctgcgtggttcccagaggctgtgcatactgcctacatttcaatcagctctacattttaggtacatccatccctctcagctagtgttcttaggaagaaaatgcaaacttttaggaaggagaaatctcactcttcagtgtttgtggagagtgcagggaaattctcttaatggaatagtagagataccattgtctgacagccactgtaaagccatatggagctgcttgcttttggctctggagatattgtgacctcttaaaatatatttttctaaaaaaggaacatgccttatttctgtttttctttatacttcatccccaggtaggaatttaaccaagatggttaacggagaaagtaaggcattgactcagctccatacaaaaatgcattctggcttgtttgcataaatatcacagaaaaataggggttcaggatcccatatggcacttagcctcctaagcaaagatcatcagccatagacaagaagcaggtggcctggcatcgagagcagaggttatttttgctgctgggctcccgccatttcagagtttaacagtggcaagtctactcagcaggaggctgaccccagatgctctccccttgtcggacatggagccgtcccatgtcccacctccactgctgggagtaaacctgatcaaatctaggccacagttagactcccagataagtctctgtttaagcttattcccatttgctacttaaataccacttccaaatctgattcatttggggtgaagtcacagacttaattgttcacccatcctgggtggctcttgaaagcctgtgataatgatatcttggcattttcttttaggtgaaccctagtgcaacaggttggaaagggctagttttgaggatagtgttagagaccagaggtgtggaaacctggattctgcctctggttctgcctctccctagagctcagtctcactgtgtgtaatatgaagagatttggaccgtgtctggggtttcaaattcagttgccaacagggaagtataaaaaatgaatgagaagggaaaagaaaggaagagggagacccagtggaaaggtgcatgagggaactttggggcgagtgtgaaaatgcatatcgtgattggttgatggttatatgggcatatacatttttcaaaacttgtagaacttatactaaagatctgtccactttaccgtatgtaaaataagtgtaaaatgagtgaaatggactaggtagtaaactgcagagcatatacctcatttaaaaggggcgaatgataagctctagccaatggcttctcttcagaatagaggcccagtgttgctacattttcaagtaaagccagaaattcacatatttatataaaatctcaggatatgtagatttatgggccctgcttggtcaaacaaaatgccagttttgtgatctctgaactttgggcttcttaatttgagtctgaggatcattttagcttcaacattggatgatgccgacttgcggtgagacctcagacaaaaagattaaacttgcctacacctcagtttttttcacctgtaagatgttgataattcatgactaatagtacaggggtctgatgaagagcatatgaggtaccttgtacaaagccactttgaaacatgaataaataacataaaaatgcaagtcactattaccttttttattattataaagaattatttccgtttttagaattgttattgttcagaattgaagcactaaacttagtaaagatggctaataaaaacatcaagattcaccatgagtaaatgacttgcctgcaaatgatcatgcaaacctttcactatccttagaggggaatgtttctgttgtgtgtgacaagaagaaaaggcatttcatttgtacagctactcatataaattgcaaaaaccatgggagctgaagtccaaggtacagcaatagcatataacgaaatgaacttgatgctgtattaaagattctttgtcacacgcactcactgcctaggagtcgtaatgctcccagccttgtcactgacattttgtgaacaagcagcctgtattggatggtgataaatggattatcttaaatgtcattctgcactgttttagagttgcaaagagagttttgatattgagtttttggttagtatattctgtatcaatcctttctgatgaaataatctcctcaagttacatccagaaatgtcaaagttgcttatttcttcaatcacccatagcaatgtttccattacaacgtatgcagagaagattgtgtaataatgtcaaactatttatagaaacatttcctaggaatctctactctccttgagttgtttgtgtatttaatactagagatttgtttttatatgtatatatatatttctatttctaaattgacttcagctgaggatgttgtactttagtttttatatagagcacattgaaaacttggtaatattagcattcgacaactaaaactaaagccacgctaacattttgtaaatagaaagagtcacgtattttggttttaaatattgtaagtttttttttttttggtgttgcagttgcagctgtgtcctaaaggttgtaaggttgttatattcataacaaatttaaacctatttatttagtctaaagtagtatggaatactttgcccaaagaagttttcatatttattttatgctaatttctccattattttatctttaatattttttgactttccaaatttaatacaattattgctattacacagaatttagtcatttgtataaagatttggtctggtggacttgtgtggaaagaagcacaaaatagattttgaaagcatatctcacattttacttggcaaagttattctaaatattggctttcttccctaaagataagatctttctagatacagatattgaaaatactcagttagcatataccgagtggctcccttcagactctctgtactctacgaatcttaccctcatcctgtcattctacagtcctcaaaaaaaaaagacatgtaatttatattttaaaaatccaaacaatataaataatattagattggaccatataaaattactattttttgtagatccaaacagtcacataggagcaattttatgtggctcacccaagcaatgaagatttatattgtatttactacatgccaaacatgtgctggatgtatatgaattcatatactgattatagcaaccctatgagtaggtgctattatttcccctaacctacagatgaaaactttgaggcacagattgattaagtaagtatcagaaccaggcagcctgccaccagagtctttgctgatcatcaggactctgtgctacctctccaaaatagcaaagttccctggctctcccaccccagtgtagtgcttttcactgtaaaaatttaatgatgtctttcatcttacatgtcttaatgtgatattcctttcagctattctaatcaaatatattattcttttctcttacagtttttgtgcattatatctttcttaagatcaactttctttaaaaactatgtttttaaagaaattcactttaatggaattctgatgctttcatagttttgttttcagtgtttacctatttaatccacctgaactttacttttgtgactggttgttgagtagggattaactttattattaggttttcaaatggacgggcaattggcacaacaccttttatggaataaaccattcttgcctccactgatttgaaaagacacttttatcatatactaaatttgcagaaatttatgtgtcaggtttttttttgcctaattaccaaaactttgtgtgtttttagatattatagggccttccctcctccattttctttttagaaaatttcgttaactgttttcatgccctttttgtcagatgaatcttagattccgatagtcagattccataaaaaattttaaatcctgttggcattttaatataaatgcattgaatttataggtatatatgttggagaattttttaaatgtcacctcatctattaacatgttttatttcttcatttatttatgtcatcttttgtgttcttaaatgagttttaaaattttcttcacattctcctttatttctagatatttgtgtttattgctgttgtaatggaattacagatatgtctggtagctgttgagtttttgcattcatatagttaccttactaaattttattagttctggtagtttttcatttgattcttctggaatttctaagtaaggaattaaataatccaaaataaaatgatgttgcctttctctctccaatgtacttttgttggtctctttttcctgtcttggctgatattttttggaataatgttaactagtagtagggataataggcaccctttgattttttttcctgttgttaattaggatatttcaaaagttttgcagttaacctggagatttgctgagatttctgatcaatatcctttattaagtaaaataattcttattctctttaattctctttaatggttgttgcatttaatcagatattgttttgaggggaggaggttatctactgagatgatgacatgggttttctcctttgttctttaaatgtggcctattacattattggatcttatattgttgaatcatctttccatttctgaaatagagcttactgtatcttgaggtaatatatgcaggaacttaatttggtgacattttatatataattttctataggtgatatttttctatagcagtattttctgatgctctctgaccctggttaacaggtctcagtagaactcattcattcctaacatttctgtgatgttactgttttgaagcttatccaaagcttgattggcttttgattattttagcattaaggcttttgcatgcaatttccctcaaatctttgaagtttatttctgtttatagctttccttaggaaaggcatgagtttactctttcaacttttttgctcttgcctcctatcttctttatggggagagagtatacatatttctttgaagcatgatgagtataaatatttctttgacatctttatgaaacctggaattgtctcttttcatttggaaagaaataaacttttcttgctcatcattctttatgcataaaactatagttttagttagtcctgatttatatgcagtgttcccctagaaagagatatttatttatttatttatagacagggtcttgctttggtgttcaggttggaatgcagtgctgcaatcatagctcactgcagcctcaaactcctgggctcagaggatcctcctacctgtctcccaggtagcaagtactacaggcatgcaccactatgactggctaatttttaaaaaaattttttttgtagagataggggtctcactgtattgcccaggctagatatttagtattttataatgagaaacagtgaggttagagaagacactattgtttcattttatgcatgtatgtcacccttggcaaatatcactaatctcgatgcacattttccttctaaacttgtatatagccttcttaacatggcacaccaaatagttactaccaattgattggtacttgcaatttaaatgagacctatttgcaccccctagtatggaaacagcagtctttggatgccaggagtcctaagctttcagtctctaatttgcagtgtgaaacatcaagctatttcaaaatttaatcttagttttcacagctatacaatgaagagattaaactggataatataatggattttctgattctgtttacatatgctccttcattatttcagggccaaacatcgttttaggttttgtaaattacgactaaactgtgtatttgtaactttattattactattttgttgttttcttgttcatttgtggttttgagattgtaaatacatctgccatttagctaattctcttttgtggccaagtactttttcttacttttaaaattaataaaggctcattgtagaaaatttgaaaattgtagaaaagcacaaaaggaaaataaaaattacccataatcaccgggtgcggtggctcacatctgtaatcccagcactttgggaggccaaggtgggtggatcagttgaggccaggagtttgagaccagcctggccaacatggtgaaaccccttctctactaaaaatacaaaaattagctaggcatggtggcacacgtgcctgtaatcccagcaactcgggaggctgaggcatgacaattgcatgaactcaggagacagaagttgcagtgagctgagatcatgccgctgcactccggcctgggaggtagagcgagactctgtctcaaaaaaaaaccaaaaaagtacccataatcctaccacccagaaggttaacatttggttatgattagaaatatttctgtttttaaaatcgttatactctttttcatagaatattattacatacatcactgaaaaataattttcctcaatatatacaatcatttatttttatcatatctctttagggtttcacttttaaatattatgacagacatccttttataagaatctttgaggctttcttgaacagattcctagatatggaattactaggtaaaggagagtgtacattgtaagttcctaacaaattacaggttcttgaaaaatatatctggaatggatgtttgaataaaatattgccaatttgatttctagaaagatggaccaatttacagattcatcaagagagaatgcctctcccatctcaagtttggcagcatggaatattacagtttgaaaacatcttttccaattttatggactaaaagtaacagaatttctttatcactactgtgattggatcttttttatgtttatggctgtgtgtgtgtgtgtgtgtgtgtgtgtgtgtgcgcgcgtgtgtgaatttcttgtcctctacattttccccttccttttgtggcgtacatgttaactgttaacagctgcagtgcctatgagctcattatcaaagtgttgctccataatttacaattatacctaactttgggggcaaaatcccaatttggaggtcaaaaagagaccaaagtctctgtacatctcacatgactttacttgcattaactttgccttcctaaattacagtctataattaagaagtgctagtctcctggccagctcttatggttatttttgaagctccttgggtgcttgcacccttccagagggctgttactttgccccctctctggaagctcatttgcttccacaggaagccttaagccaaagcacattggcttattcaatctggtgtctggatcttaaaacctggcttctcagtttatgatgctcaccagtaaaacactcatggctcttcttgccatgaagcgaaccaggcttgcttagcttagcttcatgtgtggccttcgtgaatcaaaataagaagaaggtagaactagtcccacccttaagtcaagaagaactggttagtcatgaagtgaagccacatgactttgctcttttctattatgtcttctaattgtttctgacaagaatccctggatttctctcacactcttctagcttgatgctattgggctccttttaccgaacaattgtgaaattagtaactaacctctgcttgctgatgagattgtttgacagccgtttgctacctggaaaccagaatggctggaaagagacctgtttatgcatttttcatgttaaatgctaggcaaagaggttataccctacatgtggactctaagctaaggaagctgacacgtggggagggaaaagggctgaaatccaatgcatacgcccctcttcaatcctgggagattgtatttgcccgtcagaggcacctttttctaatttgcccagaggtgctgaaaaggcggctgaggccctgctcaactgcctgaacaacttacagaagcacctctccttccaaccaggttaggatccaaaaagctgtatgtaaaacctcttgtttataaatccaaggtggcattaagcagccactgggagtatgatctgttagggacaggcttttgctccagtatttaggcttgttcttatcagtaaatctaaatagaaagttcctaagtaaagaagcttccgtatttaaatagctcaaaatacgacagccttatttttttaatagcggcattgtttctctttcccaaagcaaccataactgagacaggattagatgcaaaaaccacttgctgatacagtttagaattgcaaaattctaaattccaacagattcatattatacacaagtataaacagagtgtagccagttttcctcaaagagataacatgggttctccacagtatttttgacccaacaagccattattaaatttggagagaaatttttgcctgggaaccttggctcacacctgtaatccagcattttgggaggctgaggcaggaggatcacttgaggccaaaagttttgagaccagcctgggcagcatagcaatgctctgtccatacaacaagtttaaaaattagctgggtatggtggtgtgtgcctgtaggcccagctaatcagaaggctgaggcgggaggatcgcgtgaacccaggaggttgaagctgcaataagccatggttgtgccactgcattccagcctaggcaacagagcaagaccccatctctaaaacaaatgggagtagagttctaatggcatccaaaggtaaaggcccatattccctggtgttccccaaatcattgcaacaaaaaagcaaagccatttaccctctaagtaatgtcagtaaacaatgaaggaaaacctgaagccttcctgcttaagagccattctgaggcctggcatggtggctcacgcctgtaatctcaacactttgggaggccaagacgggcgaatcacctgaggtcaggagtttgagactagcctggccaacatggtgaaaccccatctctactaaacatgcgaaaattaggtccgggtgcggtggctcacacctgtaatcccagtactttgggaggccgaggcgggcagaccatctgaggtcagcagtttgagaccagcctggccaacatgatgaaaccctatctctactaaaaatacaaaaaattagccgagcgtggtggcaggcacctgcaatcccagctcgtcatgaggctgaggcagaagaatcgcttgaacctgggaggcggaggttgcagtgagccaagatcgcaccactgcactctagcctgggcaacaagagtgaagctctgtttccaaaaaaaaaaaaaaaaaattagctgggcatggtggcatatgcctgtaattccagctactcaggaggctgaggcggtagaatcatttgaacccaggaggtgaagtttgcagtgagccaagattgtgccactgcactccagcctgggcgacagagcgagactctgttaaaaaaaaaaacaaaaaacaagacattcttagcttcatttcaatatctccatcctaagccttagagaaaacttcagtcctcacctcaccacattctgttattagaaggcattaagaaggaggtgttctaagttcttctcaaccttattgaggatgaaggtgaagggttgtacccttacaatagggcatggtatacctccaatacacctcttttcttttgtctgcccatgtttgtgactatgatgtcctaaagcactttatgtgagacttagattttcttttttcatggtgtaagttaaatatgaagtaatcttgattaggccttttgttcacagaaccaatgaactgatgaaaaccttgatgatattcatgtgtctaatgttatcatcggaggggtttcagtgaaacagcttaactttaggttcagagaggtttcattctcacaccagatccagaagttactattataatacctgcttgcatgaacttgttcatggtactcactggtacaaatttatggcttcaagtgatagaatgctcagtaatattgccctcttggaagctgtgcccaagaaacttagtttcctaactgggctctgcagctgttgaaacttcatcacctttcacctgaatctctacaatgctttgcaaatgaggagctggtgagaaaaatatgcagctcgaagctggcaaagttttaagtgggtaaagcttgcagtgttaagatcatagccccaaattacttaagggcttctgctaacatgaaaataagactcttgactgctgagagattggatattcagatagatttttttatgaaggaaataaatatttcaacatgcaaacactacccaagcgggtagtgatgcttcaaaacagggtcagaggtcaggtttttttctgtttgtgttttttgggatggctccaagtttaaaggtattacacatcactacctaccccgagcctcacatggtaaagtaattactgctagctagcggaaaatatgtacattcatttttatttccaaagatcctgagatttctctctgcgctttttgtggtcctcattataaaaaatatatcatgaagaatgatggtttttctccatcctaacggtaaaagagtcaagctgaaaatgcatgtctgatactcaacttttttaacaaacttaattttggaggaataaataagcatagaatgtatttattctttagagaatagtagagttcatttttatagtttgcctttaaaacatgcaacagacccctagggtattggataatttttagaggagatgctgacctggtggtcagccattttgacggaactggggcccaggatatcttcaggcaagcataaagatgtgtggcatacattgttctgaaacttaaacactgactttctcagtggagtggaatttgggtgactgttggaattgctaaacaggacttagagtttcagaaacccttttctctctgccttcaagtagggaaaataattatttgctgagcaattaattcgaattcacaaacacacacacacacacacatcagatatggtaagctcagatctctgcagaagccggcaggtaatgtcaacgagtgaagcaggggttggtgtaatacattagggagttgtggggacaagaaagaactagaaagcacacccccggtctaagaggacaaccagcactctgctcccagccagctgctgccatgagagaatatgggcccactgttgtgtacggctcagggtttttgttttctgtttttccaaaagaagccagaaatccagatgtttgtatgaaaggtatttttataaaaattttgacaactaatataaaacactatttgaaaatgtatttgagggctagctttggcctacaagccactaggttgtaacttcagctttcaaaaattgcaaaaggtagagccagctgcttagtggccataccttctcattctccaagggaggtgtttggagcctggtgcattctaaacaatgactgttctgtggcttaaaaccctattgtgaagaacacagttactctgaaattgagggcagcttgtctcatttatatcatttctttttagtgacacagatccttcgttaaggccaacttttaagggagtcaagttgcagaaaagtttacagggcataaccaccctcaccttgcttttcttactgacttttaaccatcacaaagtaattactttccctcctctatccctcccttggaatgggtctttttttttttttttttttttttttttgactcactctctcgcccaggctggaatacaatgatgccatgatggctcactgcagactcgacctccccagctcaagtgatcctcccacctcagcctcctgagtagcagggtctacagcgcccaccacgatacctgactactttgtatttttttgcagagacagggtcttgccatgttgcctagcctggtctcaaactcctgggctcaagccatcctcctgccccaacctcccaaagtattgggattactggcgtgagctactgtgcccatccagaatgtgttactttttaaagtacattgtgaggcaggacagtattcacattgcctttcccagagcccctaaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgaggtttcaggacacggagtaaaatgatggaaatgtgtttgtttttcagggcagagaggagtgttggtaagtagagaaattacattgtgtcctcagctgccattgatgtccttccaaataggtgaagtttagtttaaaacctgccgttaatttctggcctctggcaagagtggtacaaggttacctgtttgttccagtatgtgtagggaggggctgggggttggggagagagaagggtggcaattagtcaatgacatttatgacccatttataaaatacaaatgaaataattggttacaaaatcatgacaagccttcacttgtcttttacaaacttgttctcaacacactgtgaaacttaatggacaccctttgtagaaagtgaggaacaacagccattctgaagagaccgattcaaagcgttcaacctgagactagctgtggtggcgaagattctctgagtatgtttctcattctcatctcagatacccgcattattatcgcagatccagaggcagggaatttgtagattcctcagccagggaattgccacagttttggtgtaggatgaccagacatgagaaagaaaaaaattttcccacaaatctttaaatgcatgggaccctttggggtctttgctgagattagagcactgtgtgtttataaataaaagaagaataaacaaaggcagcatgcactggcagtcccctccttcctgccctgttaaaatgctgtgtgaggtggcatcgagaaaatgaacgccaaggttgacaccaaatgtagggcccgagtgatttttctgtttttcaaatccgctgtcagttctccacctctgactcttagtctttttctccttccccacctctagagagaggacatttcctgagtaaaatgaaaatcaaagctaggagctaatcatatttttaaagtcagatatgttgggggtataactggaagctaatttttaaaagaatcctgccatatctttgataaggaagttctatggcttaaagagtgtaaccactagttttagcagagatgtttcctttagttttgaaacattcttcaacatttcaggttcatgatgaaaaatggctgactggatttaagtcctttattttctatactcctgagcaaaattctgaaaaactggctggtctagtttagagaagaacgctgatgtgggagtattttcaccatgcattcctgctctaaatcctttgcttctactgatagactattctactttcgaaataagttcacattgctctaacacttcataagttcaatctttttctcattctgtttaaaataaccaccatgaccaccaaacgcctgaaattcactgtagttaaaattatgactgaaatagacagggaaaacctgagagtgaacgttacccagcaaatctgggttaaacaggttcgagtttttccagagcacactgtttaggatttcagcttcctgttcaaccatctcggaaacagggtgtttctctgctcctttgtgaggactaaccatgtgtccccgccactttgcaccaaagctgaatatcatcccaaactctggatccttctgacgggcatttgtgtggtacacaggaaggggtgcattatgaatatgcaattactggcatgtaatgctgtcttctgctaaaaatacaaaaagggtactctgatctcagagttgggagctgatttctgatttcagcctagacaggtctgcttaaaactataatcaagctgattgtattgccctggaattctaatttccaatttagggttttgctatataatctctagtagagtgtgtctaatctttatgaaacccagagtctttgtataaactctatggattttcttccatgcgtctaggctgagctgagctgtgtctttaggctgagctgtagagacattaaattactgagtaaatgaaggtaacgttgttatgtcactctgtttctgaaagaccaactcaaattctgtctgctgtagctttgatccttttcatttaattctaagtacacttgttattatagtaactgttgtttgtatgttattttagctttttacttaagtagctatttagcaatttaaatgaaaatgtaattaggttacatctgttttacatgcatgtaataccacgcagatgtaaacttctattaaagccatattttctttttggcaagaaaaggcagaaacaaaatcgtgccagtcgctggaatacgtcttgctctaaaaaaattaaaaaaaaggatatacagagcactgtgccattatttatatggtggttagagtacatcacttctattttttgaaaattaaaaaaaatattaacaagtgaaaaacaagcattctattccatgttccctcttacagtttatctggatacggtgtttaaaatgacaatacagccaggcgcggtggctcacgcctgtaatcccagcactttgggaggccgagacaggtggatcacctgaggtcagaagttcaagatcagcctagccaatgtggaaaaaccccatctctactaaaactacaaaaaaattagctgggcatggtggcatgcgcctgtaatcccagctactcgggaggctgaggcaggaaaattgcttgaacccaggaggcggatgttacagtgaaccgagattgcgccactgcactcaagcctgggccacagagaaagactctgtctcaaaaaaaaaaaaaaagaaaagaaaagaaaaatgacagtatggcttccccccattctatgggtttgtgcacacagaaatacacccatcctcccatcataaacactggttcttccaactccacagatagtggaaagagtcaagaagcagccgagattctaacctagctctgctttatgactttggtaaagccattttactcttcagtattattattttttaaaaccaagagtaatatttgcccagtttgcctcatagacatgttgtgaggctcaagggagataatgaatatgtaggtactttgaaaagtataaaatgcaattgttagaaagtattattagtatattagtctgaaaacagcataagcagtaagccccccagatacccccacatttttgtgtgtacaatggggattgaacttagaaaattaattctcctgttttgggaaccattgcctcccttatagcctgttaataggatttataaaacatcatttcagacaaagtcatttatcttatttgctaatgagacacaaaatttggactgtctggaaccaggtaacattttaagagttgcccatttgtttcatacacgttcagcttttcagtgcagtcatttttaatggtggtttttatagcatcaataaaaatattttcatataattcttccttgtaaatatggttaaacttttagctttctactacttggtgacctgttaaataacttaatgtactttgaaattgattgttcagtgccaagacaataagaagccaggaggagccagctttattttttacgttggggccttaagttgggctatgaagaaaaaattctggcagggtttgccacatccaacttttaagggtttttttaatctgtaagagggaacatggactagaatgcttgtttctctttcctgtctgtcttaagtagtatcttagatggcaaggaaaggaaatattctacccatgtcataacatatctaccatttattgagcacctactatgtgccaagttgtattctaaatgcttcatgtattatctcatctgatccttaaggcagactcataggtaggtactactgttatctcctattttataggtgaagaaattgaagtctagagaggttaagaattttctcaaggtaagatagctagtaaatggtagagctaggggtttaaccttggccatctggcaaccaagacataggtttgaacccattatgcctcatcatacctcataatacctagtattataaggggttttgttgttttttctttgtattggttttgtcatctgaatcaaacgtctttgacctagaaagaatcttaaaatatgcttctgccgcctccctcttttatcccaattcagaaaaccattttttgggagacctaggtgccataaaaatgaaaagaaatgaggcatggtgctcatggtactcacagttcagttagtgaggggggttggtaagtaaaggggtatggctaagtagcccgccaaggaggatgacatgtgcactaagctgatacttggctgatgtgctctgagaggccagagcaggcagcagtcaaggtcaagcaaagcttcatttgacctgggcgtgaaagaatgtgcaggactgtggtaagcaaaggagacaggtggcatttcaagcttcaggaatagaatgaacagggagttggaggaaagaaaacacaaaatggcctgttacaatagttaaggcaagagatggggaaaccttcaacctggtcaccagcagacgacataaagcaggaaataaaatgacattgcaaaggcaaggtgatgggatttggcaattgattagcagttgggagggagagcactggaggcaggtactggggtctcgaacccagtaggatagtaggaatgttaatcataaaaggcaactccgatttgggaacactcattgtagttggggaggtagaatagggtagacggcaagaacttggactctatattcagatggtcctgggtggcaatctgtgctctcccacttactggtagagttactttcagcaagtcacttgtttagactctagtctcctcatctataaggcgggaataatattaacacagctgacacttgagcaacacaggtttacactgtgcaggtccacttatacgtggatctttcaaaataaaagctgcaccaagtatgcctgcctctcctgcctccccttccacctcttctgcctctgccacctccaagacagcaagacccacccctccactccctcctcctcctcctcctcctcttcagcctactcaaagtggagacaatgaggatgaagacctttaagatgatccacttccacttaatgaatagtaaatacattttctcttcttcgtgattttcttaacattttcttttctctagcttactttattgtaagaatacagtatagaatgtgtgtgtacatataaaaaatatatgctaattgactgtttatgtgaatcagtaaggctgccggtcaacagcaagctattaatagttaaatttgggaggagtcaaaatttatacataaattttagcctgcagggggtcgagtgccccaatccctacactgttcaaaggtcacgtatagtgacctcatagtgttattggagctcaggtagtacctgtagcatgcatagcacagtgccttatagcatacattcaataaataccacttagtagcctcttggctactactcactcatttgggtgagtaggattttatccccattttatagatgaggatgctaaaatttgagtaggtagagtagctttccagagtcctaaagccagtaaagcctggcaggggtgagtagagacccaggctcctgccttgtggtgtagtttctgacttcaattgtaggtcacttgctgccctcacaccagacagcggcaggccaagtcttctggtgctgttactttgaccttcctcccataaaggctggatgtagcagaggcaggcactgtctcttctcttaccttctgtggccatttactgagcatgtatggtgtgtctcacatgcttttacatgctttgcatacatttctttttccttttctttttattttattttattttattttatttttgagacagagtcttgctttgttgcccaggctggagtgcagttgtatgatctcggctcattgcaacatccacctccagggttcaagcaattctcctgcctccgcctccaaagtagctgacatttcaggtgcccgccaccacgcctggctaatttatgtatttttagtagagacagggtttcaccatgttggccaggctggtcccgaactccggacctcatgtgatccacccgcctcggcctcccaaagtgctgggattacagtgctttgcatacatttctaatgactgagtataggttttcattttctccctttgctttcttcctataaatcagacagtcatttttttctagagtccttttcagcaccccagagggagttgtatccttttgtgtgtgccctgtggaattttcatggcaacataagttgtatttcttcatgactcactgccataggaagaccacccaaaacataccctcttctgtaacccaaatctcagcgtgtgtccttattttccttgttttcagcatgtccaagtgaagccattaagtaggtaatatactgttagacacagatcgtggtgcttgggaaaacaacacccaagcctcgtgattaataagcactgttaattgttaagctgctcttgctggtgtctgacctcacggggtttgtgctgtgacagctctttcatgttgatgaggtaaatgagtctctgccatgatggccgggagaagccaggacagagtatcagatcgtgtttcaccaggaaaacaaggttgatttactgtgttacacgagggtgaagtggacccagcaccactgcaccccgtgctttgattcccttgtatgctaaatatgcaagcacaaaacagctttaacacaattttttacctagaaaggagcctggggctgcatccaagtacatttaacatgtgaaaattgagctgctttgaacttgtatgtttttgataactgcttggtatgcttcctggaggatcacctgtaggcttttctttccaaatcctaatccctttgattgagtgccaggacagatagctctcattgaataactccagtctcataattcttccttcattcagagttgaaagggaacagctccagattcaataggcacatcctcagatttagctgaagtcattcaaacactttaaaactgaaattgttttgttctgaagtagggttcagttgggctactgaatgtttacacaagccagttgctgccaggaactgtaggatggggaagaaaaccacacttctccccgcctccacccagcccccttgccttgcttctctctgcctctgtaaccaagaaggattacaaggacgactttgagcgttagaagtttcaaagcaacctggcaggattgtttgtaaacgtgggcataagaacgtgcttgactcttcttgttttctgtcctccatgagaccaggctgaacactcctcccctctcctcccaacccccttttggaggaaggaaaacaaccatgttctttttatctttacaaatgtgcctggtggggactaatctaaaccagttcaagatgcttttgcttaagcctgtttagaggaacggaaggtgctgcagaaatggaaatagagtggtatatgggcctctttgccaccccgctcctgagctcgctgcctcttttttgtttttgtgggtttcttggcacctacctagatttctgctgagatctctgtttcaggtcttttcagagatcatgtttcctaaaagatggttcctttctgctggacatcctgtctctgtcctatttggccagatagtacttcagttgggaaaagccatctttctcttcgtgcctggtgccctatttcagaaggaagcctgaaaagtcatttccatattctgtgtgtgattgcgtcctgcctagcttatcacagtggttgttccctctcggatgaacaattcctaccctcctctttgcccagcagatgaaggcaaggattgtaacccattattagagtattgaggacctgagttccccactcatgttgaacttgaggcaagactgggcggtttattcccctctggctactctcccacttgtaaaatgaggcgacatctctaatcattgacaccaaacaagaacatagcctaataataaaatgaatggtgttatatggtcatgaagaaggttcaagactggaatctactccataaggaaggacacaaaaagattcaacagtgatttagacaaatctcatctgaacacattttacagatgcctgttgaactaaaagttctgtctaggactgtagtaagatttgacccggcttagcctgggaattttgacccactgatggtagaagtttattaacagccctattcatttagatccttccctgtttctacttttctcgttctctccccggagggtttttatgacgttgtaatcatttataattttaaaatgtcttcaatcgtgcttaaaaacagcacttgattttaatgggtactgcttaaccatagaaagattgtgtctgtattactgtcggttcttacaacaatactttggaacgaaagtagaaagtttatgacacattttattatattcctaaatgtgaaagaggattctaatttaaaaataagtggccatactttttaattcttatttagcctctgtagctgttttaatatcccttttatggttgactggtcgatgttttaaaacaagttcttcagggactctgcccattagtctttggcaataaaatctgaactttactaaaataaaacatgaagccatggagtaattaagaggggaactttcagagatgaccgtgaatatgaaatacagtgatttgtattattaatggatttggggaaaaccagcccacctcttttaagctcaactatgtgtatttggggggttttatatttttaatttatttctttgtttctctcaaggcagtaggggttccatcgcaagctcttaagatctaccaatcctccttttgtagcctgctgcttctgaatatgagcctttcttttttcattttatttggaaaatggggtgatgtcacttaggaaagcatttttcccaaaagtggtttcaggaaccagaatctggtgaagtgttatttaaaagcgataacatagtaaagctctgctttgtgcttcaaataattgtaggatttacgggatatatccctaacctgttcagttttatggaaggacaaaatacagggattcattttatcatagtttcttaaaaactttgaaacccagttgacagtcatttctctagcattataataagctctttgtgtttataaacctagttcatagtaatttttggagtgctgcaatttggtagttatttaatttgcaaatgggattggcctctctaacctctaaaggaactagttccttttaatgctttaaaactttcattgactctcaattgccaactgcaggaaaaagttcaggttttaaaagtccttacatgcgtttcagcctcctctccctgtttcctttatgaacagccccctcccactccctttctttcaatggtaggtctgctgcagaacattctgcatctcttaaactttatatgcactgtatttttcagtctccattcctctgctcatattgtgttctctccatggattctttctttttattatttaattttttttaagggatagggtctcactctgttgccccaggctggagtacagtggcaccatcatagctcgctcgtagctcactgtggcctccaactcctgagctctagtgatcctcccacctcagcctcctaagtagctgggatacaggaacgcaccaccatgacaggccaatttttaaattattttttgtagagacagggtttcactgtattgcccaggctggtctcaaattcctagcctcaggcaatccttctgcctcagcctcccaaagcgctgggatgacaggtgtgagccaccaggcctggcctcagggatttcttctttaccatgtcatagtctccaaaattgtgcccttcctttctgtcaactcaagtgtttcctcctttttttttttctgagacaaggtctcgctctgttgtccggactgcagtacagtggtgcaatctctgctcacagcaatttccgtctcccaggttcaaacaattctcgtgcctcagcctcccgagtagctgggtttacaggtggacactaccactcccagctaatttttgtattttttggtagagacgggtttcaccatgttggccaggctggtctcaaactcctgacctcaagtgatccgcccgtctcggcctcctcttaagaggtattttttactctgtatccagagcttcctcatatacccatgcagcatgtggaaaacagcctgtactgctgtatgcagtggccctgttggaatccttctgcttcccagcgaattgcccacaccccagaccatggcactgtctccagatcttcagcattgcagttatcatgttaaacttagctatttgtgtatatgattgtctcgttcaccaaacagtgagcccgttgagggcgaagttgtcttaaatggctttgtgtccccaactgccaccagggagatgcatagtaactagccaatgaatgaatgttttcttcccttaaaaaataccaacagatgcctaacataagcaattaagtgagggaaagcttttttgccattttaaaagtcattcgtcagcccacacgataccactgaggaagcctcatgtgagagctaatgaacattaaacccagacaccatcgggagctcaccagaaacccatggctggctagtgagagacccggggctagaaacttgatattttggtttcacagccaggtaccctggcagccacaccagtgttatgctggcaggcatgctttgtctgctatctgtggcgtgaactttactaaaatgaaacatgatgccatggagcaaattaagaggaaagctttcagagatgaccatgtatatgaaacacagttcctactccgcctccttcaccccaatgagagaatccaaattttatttaactggtgcatagaggtctcttgatttgggggaagatgggtccctctgccagcctgagatggtaaatcacgcttgggttaagccagtcatcgaattcctgttcccctttgctggatgctcattttcccgggttcccttgcaagtcaggggctgtgtgacaagttctgacctgtgagacacaaggccaagtccactaggagaattctgggaaggattttcttcctggtaaaaagacagagcctcatgtttgccaaaagagcctgattctctgccctttcagaggcttcctgcctttgcacacagtgacaagacatgatgctggggctttagcagccaccacgaggtgacaggtaggaggacaaaagtgattacattgatgttggtgaagcaggatagaaagagcctgggtccacaatgaccaaccttgaaacctcccatttccagacttctggttcaataagaagcaccccgatggtttcatcttttgacggttggttttttgctgcttgaaacaggacacatcctaactgattcagttacttttagaaggaaaaataaaagtggagacagcatcctaagaggaaaggtggtgactggataaactatatggaagtcctgacaacatcatatttaagaaatttggtggctggcctctattcttctgttaggtgtaaggaagacccactgagtaacactggagcattcatcattcaagaaacattatattttaatcttggatattcctagcactatgcaggattctgaggatgcagaaataaaaggcagtttctatccttaaggaacttggagcctagtaagggagactagtgagtaaacaattacctgagagtatgaggatcactctcttttgataggggtattgtattagctcttatgctgctgatatgcctgagactgggtaatttataaaggaaagaggtttaattgactcacagttccacagggctgaggaggcctcaggaaactgacagtcatggcagaaggagaagcaaacacatccttcttcacatggtggcagcaaggagaagtgtcgagcaaaagggggaaaagccccttataaaaccattggatctcaggccgggcacgggggctcacacctgtaatcccagcactttgggaggccgaggcaggcagatcacctgaggtcaggagttcaagaccagcctggccaacatggtgaaaccccgtctgtactaaaaatacaaaaaaaatttagcctggcgtggtggcgggtgcctgtaatctcagctgttcagaaggctgaggcaagagaatcacttgaacccaggagacagaggttgcagtgagccgagattgtgccattgcactccaggcaatggagtggagcaagactctatctaaagaaaaaaaagaaagaaagaaggaaagaaagagagagagagagagagagaaaagagagagggagagaaagaaggaaggaaggagaaagaaagaaggaaggaaggagagagagagaaagaaagaaagaaagagaaaccatcagatctcgtgagaactcaatcactatcagcatgggggtaaccgcccccatgattcaattatctaccactgagtccctcccacaacacatggggatttggggaactacaattcaagatgagatttgggtggggacacagccaaaccgtatcaggtgtgtttggggtactatcggagatcagatcaggaccacaaaacctggataggctggggaacaggagaaatcaggaaatgtttcctggcagaaataatggctaagtcaaatcttgaagaagggataggattttgccagaccaagaaagacaaggaaagaaggggcggggcggggtgggagtgggggggtggtgcagtatacaaaacagaggggacgtgttataaggcagagaggtatgagagaaatagaacattcagaaactgtccttcttaatatttttgccatatttgatttggatctttttttttttaggaaaaagctgctgatggctacaaatgtgtctgttatgttattctctatacttgttatttcaaaaatattttataaaaatttgtgagtgaataaatgagaggggagaaaggaaggcaatgagtatgaatcatcattctgattttaagcataataaaagcaggaggtgacttccacagtcaaatacatttgggaaataatagaaaattaaatagtgttcattattgtgagaattcccagaacccttaatattcccatgttgattgttactgtccaagatggggccactgtctagcgcacttcctaggatagatttgtccataggcccctcttttatgtaaccatctgccgaactgaggccttggaaaggcttgatgtagaccgctctttcagaaaacttgaccgagaagggaagtacgcttctagggtagcatcagagcagaacatggggaaagggagacatttcacaagaagggagagtcaagatcatgtgtatttatttgccaagggcaaaaagcagtagtgaggaaaagcaaacaaaaaccagttgaagacacagcaacagaggagaatgattgacaaagtaagcaaggtgcttgaggttacaaaagggatcagctattaaaggacttctgctagtgtctacttgtcatcttcaagatggcacaatttttacagtaccatgtatctgtgttgcaggagaaggtaggcctctcaatcagagacttagcctataaaccagcatctacatagtgaatctaggtatccctcagtgttcttctatttataaggaacagaaaacccaacttaaattgacttacgtaaaaagagtttgttggttggtgtaattgaaaagtacatggttaactagcttcaggcatagcttgatccaggtattaactatgtcaccaagatccatctcactgctcataagccctctcagttggctctattcttatgttcctcatggctcctggaaactttagcctctttccttctggttgcaggatggttgtagctccatagacatcacatctgccctcacactgcaactcctatgaagaggaaacaccttatttctcaggagccccaccctcttactattagtctgattgaattatatgtccatccttgaaccaattcttatgaccaggaataaggcatagtccccatgtatgtaacttctttctcctgagttgtacaaattatcaaaggaaaaccaagaggattatatctcaagagtggattatgttaagaaagtaaccctttccctccaaaaaaggaaacttccataacagaacccttagatttttacccagtgtgattttaaactctaaatgctggaatgtttagggtcccaggtctgacagcatgaattagatccctccatgtggagcacccaagtaagtgaagggtgttgacagccatcatggggaatgctgatgcttactgaagaagccatgcaataaatcctctttagaaataaacaaaaagcagcttttgagaacccggcttttacccaagaccaaaacctgtcagccacaggcagaagtcattaggcaggatttatatgtgctggtatccaacactgagtcaaaaggagatccgtagaggggatttctctcttccggaaacccagcagaggaacggggaagactttccgggtaaagtttcagagaacctaatgcataaatccccttaacaaacactgggatttgggtttgtaactcatctctcccagcttaggtcctgtggagacaagctgtcatagggctgacacaaccaaatcaagaaaggaaagagtagaatttatagtgaaaatcaggaagctacttaaaatggtgggtttctcagaatgtggtactgcacattttttgcttggtagtccctgaacagttattaaagaccccatggaagcagatggatgctggccagtaggcattgtccccttttatatttataacttcactgaccttcattttacctctaatagagattgtaccattaattggctggattctcccaagctctgtggcaagtaagaatggaaaagtggattttctccgtactccattgcagaggatatcattaatttgctaggtttcgttcccacagggaaatgttaaaaaccagtacagttggttcttcgccactctggattgacagacattctttgtgtaggtgcctctggctttgagaaacgaggccagagtctatatgcagacagtgagcagtgatcttccgtttcctacttgttgcagtagacataaaatcagggcaaatggtgagttccagaggaaaggatccagcatgcagcctgctgaataagagaacaggaatgatctcgaatgatgataaatgtttatactctattagagctttggccatgggtttggccaccattcaattgcctctacagctgattttttatgtggcttttcttttctttctcctgtttggttgcaaacttattttgactgaggatttacttgtcacctcatgttgacatttcaagttattgcattgagaaaaacataggagaaagcaaacaagcaagtatattccaacggtcaacaggcacagaagtcatactcacatttcaaagaaaaacaggagagttgaaatagagaatggagaacagatgtatttatgaggggggaaatcttcttggcatttgagctcaagtcagattctggattctggatagttttctcagctaatggtgattcctaggactgctaagcgggggacattctggtctaaccgaagttgccatgtaattctgtggaatcatactaacattttgatttctctgattataagtgactgcagcaacaaagagagtaactctgttgtaagaactgtttccacagtgtctctagggacagttttgctttagtctgtaaattctccaaaggcaagctgagactatgtaaattaaagaaatagagccagtgacaaccaaccctgtggttttatttgattttccaaaacacatgtccatcggtatgtctcagacaacacgatatgattaaagcacggtaataatcacccatatattgcattttaattggtataatgtatgatgaatagtgaagttggaaccatggggcatactttcacatttaaggtatttctttgatttatcagaatttctaagaacataaaatagaagtcagaaagtctgttttctgagctgggacctgccattcatcagctgtgtgatcttgggtatgttactttatttctctgggccccattttccccagctataaaatgaggggtttaaactagatgagctctaaagagcttttcacttcggagtttggctattccaagaccttttctagtcttgtgaatttaattactgaattctgggatcttaagtctctttatcagttgagtctcctcctttgtggtcttacagcaaagatgactgttggccaaactttggatttctgagactgatttcagtgaattgcattatacatatttttaactagcttatattaaatgagagaaagtgcaaggaaggaattgcaaccacaatttaaatagttttttccgtgccattctattccgtgagcacctgccttggagtaggtgtgaaacgggagtcaggaagtctgtgcatgcctctcagagggtggtatcttcgtcttctgagtatgattccgtaccatgaatatgttggttgtggatttttcttttctgtacaacatgaggcccctaaacataaggaaactacttcctttggtgcttaacctaagaagcatctattctaatgatggaggaaaacctagctgtattacacatactgaaagtgatatagtgggttacaaagtgacaggtaaatatttgtgttccatttaagtggtttgtgagtataattttgatttttcctaactgttgctttctctaatgattttagaaccggataacccctcccctttcccctactctccaagcataggatagagctcatctataaaattcattggattttgtgtttttgctcttctagttggtctctgaaatggtcagaatggagttggaaatgggacagcctattagtccaatctacttctaaggctcctgaacagcctcacaagactccatgcatcccagcatcccttgggacctgggtgattagtttgtgatcaacagattgtactctcagaaaacgtgcaagccaccagcctctcgttcaaactgtttataggccccagaaggggcttcctttgggccagatgattagtcacattttgtttcaaacacccgaggaaaggtacagcagctttctacttgaatgcatgcttttaccacctaaaggcaattggttgggagaagatttgggagaagacattgacagtgtccagcagtccttttatctgttataaagctaaatgcatgtttatcaagttttcagcaaagatatatgttccactttagcctccttattcttattttccacttagaggtagagactgggtctcaccatgttgcccaggctggtcttcaactcctgggctcaggctcaagtgatcctccgacctcggcctcctgaagtgctgggattacaggcatgagccactgtgtctggccacaatacacacttgactgtcatttataaactcaaatgactcagctatcaagatgccaaattggattttagagagcctcctcctaggcacctgatactttcatgcttggcttattgtacgaggtaactccactttctgttcatctcaaaagtgttgggaagtgtttgcaggttaccttcctagcacctgcccaaccttctagagaagtggagaaacctgtgaggaaagcagcacaggcgttgccacttagggacagtttcatggaaagagatctctacttcttgatgtcacattaccctttagaattccagaatcacttcagatcttcaaagcttttaataagcagcgatggccttttacaattattttttaaagcagcaatacttaaaattttattaagtgctgtcgtagaaacttgtgtctacaaaagacagataaaaacaagtgttgatgaggatagagaaaaattggagccctcatacattactagtgaggatgtaaaatagtgcagccactctggaaaatagtgtagaagaccctttttaaaagttaaatatagaattaccctaaaaagcacaggcttttgttgactttccctgggggtcaggtgggctcaccttggtgcatcctcccctggggggctctggtgtgggaagccagctttcctaccattctgcatgcagccttgtactgggtccttggggaaagagaaagactgtgaaatagatgtttcccttttcccagaaataccaacccaagatccccagcagtgaccccttatggaattctgggaagaactaaagagataacagtattctttcctgccttttatcaactctggatggcaggagggactctggggcttgggactggctgccctcaggagttcatggcctagtactgatgccaaggggcagaaatttgtgagaaagaaggcctcctccaggagctgttggtatgagcccctaatgggatcatgatatcctacatatgcaactatgggaagaagaaaggatctagccaacatctgttattatattttaaaaagtaatttaatttgtttacattacttgtcattattgtcacccacttatatttgattattctttaagcacatatagaaagatgaggtttatgttgatttttctggtattacatttccctaggctacatctccatatagagctttccttttttaaaatctgttctttattttttatagagacagggtcttgctatgttgcccaagccagtctcaaacttctggcctcaagtgatcctccagcctcagcctccaaaagctctggaattacaggcaagagccactgtgcccaacctccccatatagaattttctatagcaatcttgtcctaggaaatatcatagaaatagtttaggttttaaaaagaagggctgtatgtcatctaaactcttatttaacctatggttgacagccttgctattaaaaaaagatcttaagttgttttacattttatagtctttttaaaaaaagatgatgagacatctctttagtggttgccatgtttaatattgttactttctaagaacaaatataatttttgtgagaacattatattactctgaaacagagaacagtactctctgtccttttagtccctcaatttttgataaggtaaaataagattatcttatatgactagtgtatactaccttatatttgtatgacactccatgtttttcaatgactttcttccagagtttttgttgaaacacaaaaggatttgtacccaaactgactttactttcaattctggataatagataattattattgcattacaacttttaaaaataattaagaaatcagcttagaaaatgcttgatgatttttacttagcatggtacgtctttagggaaaagaccgtattatgaatttagcaagcaagttgagcatggtgacatccgcctgtaatcccagctacttgagaggcggaggggggaggatcacttgggcctgggagttccagactacagtgagttatgaagggacccactgcactgcagcctgggcaacagagcaagaccctgcaaataaataaataaataaataaataaataaatgtcgtggtttttttttaatttagcaagtaaagtagcagaatatcctatgttggattagtcagtggaaaaaaatatctttcaaatcgcatttgatgtttgctcaccattattatgaactaagctactccatggaactagagcatagctgtcaagtaattatgaagcgcccatgctagggaccgcatgccatttaatgagtttacatcagtaaaaagagaggacagattcaaaaatgggacatgtcacacatacatgtgagaattttcccataggccaaagggcctctttcttggttttgatatcaggcaccaactctaataggatgaagctatctgtgtagcttgatgaagtagaaattcattggagtggccgggcacagtggctcacacctgtaatcccagtactttgggaggctgaggcgagcggatcatgaggtgaggagatcaagaccatcctggctagtacagtgaaaccccatctctactaaaaatacaaaaaattagccgggcatggtggcaggtgcctgtagtcgcagctacttgggaggctgaggcaggagaatggtgtgaacctgggaggcagagctcacagtgagccgagatcgcgccacggcactccagcctgggccacagagcgaggctccgtctaaaaaaaaaaaaaaaaaaaaagaaacaaattcattggagtaccttagcattatgggatatctctaggcagcgccaggtttcttgtcttcatagctaagatagatgttaaaggaaggggaacctttttctatcccatttttctagtggcctttataggacttggcttaatatttttattttattttatattattaaattaatatatttttattttataaaataaaaatattaagccaagtcctatgaaggccagcagattttattttatatatataaattttttaaaatatgaaataaatatataatacatatataaatatatttttaaaatatgtaatatacatatatgtatgtgtacacacagtgtgtgtacacttgttatattattacttatcctagtatattaatggctatataacatagctgtgtcccaaatacatgtaatacatattacttttcatctcatttaaacctcacgagagttctttggtgaagatatgattaccattttacagatgagaaaacctgagaagaatagaagttaagtagcatgccaagcttacccaactagctctcattcattcattcatgattcatgaagtatttatcaaacaactactatatactgtcattaaagatacaaaaaggatcaaacataatccttgccttcaaagaagccacagtctaaggttaacaagtggactggagcggaatttggttttatcatttcaaaggcaaaggaacccagattggagagttttctggcaactgccttaggactttttggccaagattaatgtaatatataaaggtaagcatcaatgtgttggtgggaagaagtatcctagaaatgttttttgttttttactgtatctaggactcttatgaactactaattcattattaagttatttgatgacacagattattgttcaagaatttcctcccagagcaattgataaatatcaaataatttttatgatgagcagttccagaaagggttaaagttagcttctctgggacatatgatgggaaagtagctgaacatgatttcaaagggattttttaggagaaaattccaattaacagagaagtaatttccctttctagcttactaagccctatttcagactaatgcagtttcaagatcatctcccttctccccttatttcaacagatattttgaatatgaaaatcttatgtcaaaacttagctgaagccttcatcaggcttttgaaaggctaagtaagaattctgtttctaggaataaaaagatttggatcagaaagattctttgctggctagagttccttttcggatggtagttcaagcagtctttaatcatatttttgttgattatttattagtttccctgggaaatcaaagactcagtaacgtaaaatgtgttttccttaagatattttatgaatcagaacccacagtaaagaaataatgggaaatacatttcctttgctgatatggactaattgagaattaaaatccctttctctagtcattatcccacatggaaatgctgaatgacccaactggcccaattgcaccaaccacagtttctgcctagacaaaactcttatgccactagtagataaagagagagctttctcagtaaatcaaaactgcagagaactagaactaatttaagtgaaaggataggctccaagcccgctgtttgggtaaacccacactgaaccaagtgagcgattgatgaaacttaatatatgtgtattccagtcatcagcctggagtatgtgtaatgcaagcccatggtgtttgtcactgtgagaaatggaaaggcagaccttcattctcaactgtgtggggctgctagcctgtggcagctttggtcaacatcgggcttgcttttgggtgagccagactttggctggtttcctgatggaggttaggggaattgtgaaatgtgtctccttacacagatcgtcctgatcaaatgaaataaaaaggtattttaaaaataatttgcttagtgaaatacaaaggaaataggatgcatttcatactattaaggccgatatggttttgggggatacgaggtgtacatacgtgaaaaatttgaaaacaattcagagtgaaaaagaatggtcgtataacctaatgtaaatgacgagttaatgggtgcggcacaccagcatggcacatgtatacatatgtaacaaacctgcacattgtgtacatgtaccctaaaacttaaagtataatttaaaaaataaaagaaaaaacaaaaaagaatggtcgtgtagtagagacagtggtgaagagcaggactctggagccaggtgttctgagttcagagcccactctgccacttactagatctgagacctggaggaagttatttgccctttccctgtttggctcttttgtaaaatggaaatataagagtacccacctcctaaggtgggcttatgaattaatagatataaaggtatgtaaaattattgctatcattagttactgttattaatagatcagaagtcacaagctccaatgcctgcagtgcccatgcataccaaaacagggatcactggcaacagagacatggccccagtggcgtggagataaaagaaagtggtagggacagtggcagacagccatcaccctactccccattgattgtgaccctaagggaatgctggtcctgtgtcgccagagcttctggtattgccaaagaagcttgaaatctggacttggtcaaaaaatctctcaacttgtaaaggtggttgctttattttaaattactctacaagccaaataaaacactgtctccaggctattggccaccagtgaatgacctctttggactaacaattaaactcagctatggaaattcatctgattactttattgtcacactgtgaaacagggattcattgtcattccagaaacagccattgagtccctgcttgtgtccacccctgtgctggtgcaaaggatgtgcccaagaatcaggcagacaatccaaagaagccacctgctcctttacaagttgttgacaattaagaaacacctagcacttaatagattctccataaatgtaggttccaactccttccattacctttgatacgtctagacctgatccagtgagtatttgagggccaatctcagtttctaagtaggaatagtgatattgttgaaaactaatgaacccaccgacaacatcacagaaatactcctatacttcttcaatgtgagtttcctgctttttgtgtcatttatcatccccttttatttgatgtctctactcaggacttaggactcgggctgtgatattgtgtatgttacctcacaattttttttctgttttttttttctttaagtgtataagcttcgtttatacttccaaaggatcttcaatggaactctacttctgtgagctaaaccagtgtcatactgcaatgaaaactgcaggtgataaacattgtctaaataaaatttccaaaaagtatttgaccaagaaataccttccccctgcattccccacttaatgcatcttaatatgccaagttactgatattgtttgacctatttggggaaatgctggcttgccaaattattgcccttgttaggaactacagtttcttgtaatttcttacccactccggcatccacacaggtatcttccaaagctcagactttattttcaagaggtctatctgagaccagtctgggtaaccaagtgagaccctgtctccacaaataataataataataataataataataataataataataataataataataataaattagctggatgtggtggcatgtgcctgtagtcccagctacttgggaggctgaggtaggaggtttgtttggtctcaggagttcgaggttgcagtgagctatgatcatgcctttgcactccagcctgagtgacagaaaaagaccctgtcccccccccaaaaaaaaagtctagcaacttgagtgtggcagtggccaacttgatggtaactaacaatgggattgcaaactctttgaggaaaggaactgtcatcctgaactcggcatagcaccaagcactgggttgttacatggtgggtgttaagcaaatgccatggaatgcaacagacccctttttctgctgctgtaaactgtggtgtttgaacctagtagtgaatggcccaaggaaaaaaatactgcaggaaatatagtaatagatgaatttggataaagggtatatgagtgttttggagtattattcttacaacttctctgcaagtttaaaatgataatctaaattttaaaaacttattttccgttcatcaaactactcttaaaatgtgtaaaactatacctgaatttaaaagcaacaaaactcatattgcaagtcttggcaaactgagagataggagcagaaaacaatggtggatgcctataaacggatcaagaaaagggagtgagaatttactggaaagaaggacaaatgagcatcgaattcagcaggtttgggtttttccagagatcagtgcctgatactggttcccagatgatatctcccaagagcccggttcccagggtgtgttccagcctctgtccgccaggcttcccaccaagtcttgtgccaatagtagttgccagcacattctgcctcacaagttgctggctccaccactactaccctatcccacctacgtccaagatacgcatctggcttttctgctttgaattcagcaagtcatctcctttcctgtcatgtaactccctctgtgactcggcctacccagccacactcctcagtgctttgtggcaaaactcaacctgaccccccttcagagaaagagaaataagtgtcggggttgaaggttcagctgtaaagtgatgtttcccatactcataaacttacatagcaatgaggaactggagtctatttttgactgttgtagtgacctttgtgcataccctaaaagacagaggaacattgagctaatgtagccatcccatgaagcctcagtagctctaataggtccttttagttgttgctagggtgccagttcttgcactttaatacaattcttggctgggcaccatggctcacgactgtaatcccagcactttgggaggccaaggcaggaggatcactggaggccaggagttcaagaccaccctgggcaacatagcaagacctcatctctgcaaggtaaaaaaattaactgagtgtggtggttcatgcctataatcccagctactcaggcgatgggaggatcccttaagcccaggagttggagactgcagttagccaagattgcgccactaccctccagcctgggtgacagagcaagactctgcctcaaaaaccgaccagccaaacaaacaaacaaaaaatgcaatttctcccatcctaactcttcatattagtaaatcttcaataaaatgtatatgggaaatcaatatggcaccctcaaacctagttgtaatagtcaggagaagaccattctagcctttaaaatcagtcctgttaaaaaaaaaatcagtcctattgacatcaacgtttttacctccagttcctctccacccttctctacctcctgatttcatgtaggcgagcaatttaggacaatgagagtcacaggattttaaataacttaattcctaggtgtgtttggtacggaaacaaagataaccctgttcaacagtgaatttgtgcccctgggtgaacggccaggtgttctttcaactgaactgtgagactaatttcttcctggcctctggaaaccagctgaagcagtgggccagctggtctatcttcaatcttgcataccaacatctttctctgattcacagatttcctttatccccagcacttcctctggtatgtgcatccccgaaagtaagtgatatctattattggatttgggcgttttaaaatcattagccttctggaggggaggggagaggaaggaggctggatggttacattagaatatttccagagggaacctcactttaatctcatccacctctgacttctgcaccccagataacccccatatttgggagggatgacatcacagtaactgacaatggaattatcaccattgctctttttaatatttaaatgatacacagactcagagaaaacaaaatgagtttacatatagtcataatatccataactagagatataaaacaaaaagctatggagattcttatctagtgaagaaatctcttttagaaagtttctgatgactttcagttgcaaagcatagctctttcacaatatatcaacccactttcaatgatttgagatttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtatttattaagataaaaaacaaaagaaacgatataaaaataaagagaaaaaggaagaaaatttgttattattatacctgtcatagtgacctgtgatccgtgatctttcatattactattgtaattgttttggggcacaatgaccctcatccatataagatggtgaacataataaatgttgtgtgtgttctgagtgatccaccaacctgccattccttcatctctctccctctcctcaggcttccctattccttgagacacaacagtattgaaattaattaataaagttatagcgtcctccaagtgttcaagtgaaaggaagagttgcacatctctcactgtaattcaaaagctagaaatgattaagcttagtgaggaaggcatatcaaaagcaaagacagtctgaaaaccaagacttttgtgccaaatagccaagttgtgaatgcagagagaaagatcctgcaccaaattaaaatgtgactccagtgaacacatgaatgataagaaagggaaaaacagccttgctgatacggagagagtttgagtggtctggatagaagatcaaaccagccacaacattccctaatgtttgtaagccaaagcctaatccagagcaaagccctaaatcttcaattctatgaaggctgagagaagtgagaaactgcagaagaaaagttgaaaggtagcagaggatggttcatgagatttaagaaaagaaactgtctccataacataagtgcaagatgaagcagcaagtgctgatacagaggctgcagcaagctatccagaagatctagctaaggtcattgatgaaatggttgcaccaaacagcagattttcaatgtagacaaccttctattggaagaagatgccatgtagcatttttatagctagaggagaagtcaatgcctgacctcaaagcttcacaggacaggcttactctctttttaggggctaatatagctggtaactttaagtcgaagctattgctcatttaccgttctgaaaatcctagggcacttaagaattatgctaaatctattctgcctgtgctctataaatggaacaacaaagcctgaatgatagcacatctgtttatagtatggtttactgaatattttaagcccattgttgagacctccttctcagaaaaaaaaaaaaagattcctttcaaaatatcagtgctcattgacaatgcatgtggtcacccaagagctctgatggagataaatgagattaatgttgttttcatgcctgctaacacaacacccattctacagcccatgggtcaaggagtaatttctgctgttaagccctattatttaagaaacacattttgtaaagctatagctggcattcctctgataaatctgggaaggataattgaaaaccttctgggaaggattcaccattctagacactgttaagaaaattcatgattcatgggaggaagtcaaaatatcagcattaacaggagtttgggagaagttgattccaaccctcacggatgactttgaggggcttaagacttcagtggaggaagttactgcagatgcggtggaaatagcaaaagaactagactcgtaaatggagcctgaagatgtgattgaattgcataatctcatgatcaaacttaacagataagtagttgcttcttatggatcagcaaagtgtttttttttttttttgagatagaatctactcttggtgaagatactgtgaacaatgttggaataataacaaaggatgttgaatcttacataaaccgagttgatgaagcagtagcaaggtttgagaggattgactccaattttgcaagaagtaaaattgtgagtaaaatgctatcaaacagcattgcatgctacagagaaatctgtcatgaaaggaagagtcaactgttgcagccaccttcattgtcttattttaagaaattgccacaaccagcccagccttcaacaaccaccaccccaatccatcagcagccatcactgttaaggcaaaacaattgtgacttgctaaaggctcagataattgttagcattttttagcaatcgagtatttttaagtatgtacatcgttttttacactatattgtagtctgctatgcatgcaatagcattatgtctaaaaaacataatttttatatgcactgggaagccaaaaaattcacgtgagctactttattgctatatttattgtggtggtctggaactgaacctgcaatattgtcaatgtgtgcctgtataagattctccatgcactaaaaaggacatttgaaagtcatgagtaagttgtagaggaactctggtgacttgaagcttgtttacttttagcagtgtgtacctgttgacacttctagtataatttatattctttctctcatgagtattttacaggaaatgcgttttcctttgctagtgatatatgcactttggttttcaggaagctgtggtgctttggttgaagctctctgtctgttttagagaaaagacttacaatgacctcctgatatagtttggatatttgtctgctccaaatctcatattgaaatttgatccccaattttagaggtaggatatagtgagaggtgtgtgggttatggaggcagatccctcatggacaacttggttctgtcctctgggtaatgagtgacttctcactctattagtttttgtgagagctgacttttgaaaagagcctggcaccttcctcccctctctctctcttgcttcctttctctctctccgtgtgatgcctgcttctctttgccttccaccatgagtggaagcttcctgaggccctcagcagaagctgatgctggtgtcctgtttcttgtacagcttgtagaactgtgagccaaataaacttctttttttataaattacccagcctcgggtgttccttcatagcaaggcagacagtctaggacaccccccaaatgtgagctgcaccataaggcaaactgggaaacctcctttagttttgcatatgtgagaattttgattgactgaaccaaggaatcaccctcctaactccactgcagaaggccattctcatgtcatttgcacacgtttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagccccaagcaatcctcctgcctcagcctctcaagtagctaggactataggtacacaccactgcacctggctaattaaattttttttttctttttagagacatggtctcactctaggtcttgcctaggctgttctcaaactcctggcctcaaaagatcctcctgcctcagcttcctaaagtgctgggattgcaggcatgagccaccatgcccagttgcatgttttaatggagagagatgtcctgggcatttgaactgcagattcccttaaactggacattgtcagctatttatgtattacaaaaacaattgtgtttcatgtaaagtattaaacatcaacattacgtcaccacaagggtgattacagcaaccttcactcctaagtgtgcgtcacctacacaaacagagttgtttgtctgcagcattgttttcatttggtaacaattgtaagagttgaagtagcaccttaaggagtaattttcagaggtgaagcaatcagttttcaaaagtgaactccttatagttaataactaaccaataaaaaaataaagctatctccatggcacaaatgcccatggcacaaatgcccatggcaaaaggaaataagacgagtcgttttaaaaggtagctttgaaaaacaaaaaaggatttaaaattcaaagactttgggaaaattcaacttaaccaataacatgagtaacgactattactatttcctgagtccttaccatatgccaaataccgttgtacattgtacctgcttcacataaattatttcatctcattctcacaacattctgtgaagcgcgggtactttattatctatccctgtttgccagataaggaagctgagacttcatacagtgacttacaagttcggacagcctccagcaaacacaggaaacaggattcgaacccatgcagtctgcctcagagccaaagcccttggccatttttctatcctgccttccacagatcatttctgcctacagcagaggtcagaaactgacaaccggctggccttacctagccttaggtaacagtaatggctattgaacacttactatgtgtcaggattattttacacacattcatgtgttccttcatttaatcttcaaagcaactccatgaggtaggtggcagttattatccccattttacagatgagaaaactgagaccaagaggaagtaacacttcccaaatgttagcagaactaacatccaaatccagactgtctcattccagaatcccctcctcttcaccattatgctaaaaatacagttgtctgccaacatgacaaacctggatgtttccccagaaaatgaaggcttctgacttgtcatgaaaaaaaaaaaaaaaaaaaaaaactggaagacttgtcctcttggaccgagcaacagtcacttgtaacaatgggcagctgcccattttagatgaggtatctcctacctagttgctaccacccctcatttaggctgctttgctctttgattgccggtctgaactttggggacattctattttgcagtctcagtctaaggtatccttaatactggatctgcctcacttaacaagctaaatgtctgtgtgttttatgttttttattgtagcacaagttgtttaatgttctctaaaaagcattccccacaaatagcagtaaatgcctctttcctattttcttccctgtcccttgccccgaaagtaaggcagctctgcagaactagtatttgtgcccaacgaagtgggaagatatgaggctgatagccttttctctctcttcttggttggtggcactctggtagtgcttggttagcgataatggagcatctcatggctttgttatgtgtcatagtaggctattgtgtgacatagagacacctggcttttgtacacgccagagcaaaattcaactacaacatccagaattgaagagaaggatattggcaggtacatgcctccttctcaaaccagagatttatatatttaaaaagggcttttctaagaactcaatcttgattatttgttccatgttgggccaaaccagtgcattattgggaagataatgagtggcattcacccaagggtaatcctttcagggattttgatgatgcagtaaatcatgagtgtaaagcctgagtggtttatgccattaaaacctcaagatagaattagacttgtaatcaccacttgcccatgttttgtcatttatgataattatagtagtaataatccatgtattgttgagaagtagcagtcagaagcatccatcaattttttatcgacaccaaatcaagttgatacttcatctttgctgcagaaatgtagattgaaccaattagtctaaagaaattgggcagtcattaacaatgaagcaagcagttaatctacagaacatttctggcccctctgatgccaacaattcctcttaattatgtggaatatcatgagcttctttgggactctgtcaacagtgccattgttggcttacattagaaggagcatctatgtccctgcttttatttaaaagaatgcagtgccttccagcccccaccttgcactcttaggcgcttctaggcaaatgtattctgaagcagaacacttgaatcaaagcacttcgcattttctttcttatttagaaataagaattttccccaatgggcttctttcggtgatggcacgttagctcaccatcccatatgtgttaactatttttgttcaccttacccaaatcatggaataatcatctccttttaaaaaaggaaagaaaagaaaagtcagagtttaaaagaaaaatccaactatttgtgaagaaatcctggtgctaatgagctttctgcatctgcctcaagtcttttccccaggctagcccagtctccctctctagacattttcaatcagcctcgcccgcaaattgtactaagcagctgaataatgcagggtagaaatttcaaatataaatattatttcctatttaggaaatttggaaaagaaagcaggaaaaaaataactcaccccctggtcccccaccatgacactacctctgtgaacattttggtagatattctttgggctctgacacgtacacacatgttgacttttatcatcatcatcatcatcatcattattctagtactctctttttcactttgctaaagtttgaatcatcttttgtaatggatgcgtaatactctaccaaatatagagtatgtatttgtccatgttttgaattatttccctaggagagcttacccaaggtaaaatacttggtcaaaatttataagcctcttcatagctcttggtacatactgacaaactctctccaaaaggatggtaccaatttttaaaatctcaccagtaatatatgcagatactggtttgatgttattgagatttaaattcagttgtgttggcatggttatagcttagatagatagatgatagatagatagatagatagatagatacatacatacatacatacatacatacatacatacatacattcattcatgtgtttgtgtgtgtgtatgtgtgtgttactcctccttaatggacaaatggtgatatggattggctgtgtccccacccaaatctcatcttgaattatagttcccataatccccacgtgtgatgggagagacccagtgggaggtaattgaatcatgggggtggttcccccatgctagtctcgtgatagtgagtaaattctcatgagatctgatggttttataaggggcttccccctttactgggttctcattcttctgcttcctgctgtcatgtgaagaagaatgtgtttgcttccccttctgccatgattgtaagtttcctgaggcctcccaagtcctgtggaactgagtcaattaaacctctttcctttataatttacccagttttggccgttctctatagcactgtgagaatggactaatacaatgggcacagtatcaaattgtaccctgactcaaattactgtaaacaatgccagttgttatctcacatcacaggaagttcggaaataggacagctgtaggtgtgatatgatcataggcccaatgatgcgattggagacttgagttcttttcttcagtttctgccatcatcaccaccctcatgctggcctcctttgggcttcaaatgcctacagtagctccaggcaccacatccagatgtagaaacaacagagatagaaggaaatcaattcttcttgtgtctccttcttaagagtgaggagatccttcctagaagctcccaactgaaacccctaaaccaagactggcaagggaaatggaagcaccattatcgactgattaactaagatttactcccaatctggcaatggagtcaacttcctttgagtgctgaatacctgaataaaatagattctgttaacaaggaagaaggtgggaatggttgttgaggcaccaacagtgcctcccataggcatcatgatttttttatgcctctgccatactcatagaaccatatacatttctttagtaacagttgatgcatttaatgggcatatgcaaaagttgttggcatatctaccaagtactgggctttgtccaatgtggaaggtcctcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggataccattgttaggacttccactgagatgaaagtttacagcctgatgaaacaagtctcactttccactttgaattactcaggctctgtgcatctctttccactgcacagcgtagcattttgaacacttcactactcattagcacctccagtgagagatcagaaaagaaggtggctgggaggggaggattgaagaatgcagattagtcaaattgttttttgttttatctagttagagaaacagctgaaattactgcctcaaaaaaatttggaaaattatctggcttatagtttatttctatagttattttcccactaattgtaaaaattaggagtattacattttagagtaaaataataaataaacaataacaaaaaatggctacaacagaagaaaacatgttcctggattgaagaaaccaacctagaaattatactgtatgcctcagaaatttaatactattttgtctttcctgtatgcagttggattatagagtacagatattgtctctttattaatgcatgatttataaatattatttgacactagggatatcaaagtgattgtggatcaaagctgcccatcccttcaccctggtagatgagaacacaaaatatatccatttcctatacaccatgaagacattgcttccagtaggttttcttgctggagacaaaaagaaaaacagaagcacctactgtacttgtgcactttctgttttacagtttcataaggatttttacaacataagtacatgctctatgatattacatacctttccaccacttatataatcaagtgcaattatactgactgcttgaatagatgatgggaaaaatgacttgaatcaaaaattacacaacagaacgctgtttcagaaaggcttttggagtgtacgtgccacagaccccaaaaagagatggatcaagatgattataatagccttgaattttcctaggttggttgagtgtggtggctcatgcctgtaatcccagcactttgaaaggctgaggcaggcggattacttgaggtcaggagttcgagtccagcctggccaacatggcgaaacttcatctctactaacaatacaaaaattagctgggcatggtggcacatgcctgtaatcccagctacttgggaggctgagcaggagaatcccttgaatctgggagacagaggttgcagtgagtcaagatggcaccactgtactccagcttgggcaacagagtgagactttgtctcaaaaaaagaaaaaaaaagaattttcctaggttatggcaccaagaataacttgtaccattttggaagattcatcttttttcccacataacacaatgtagcatgtagtatatgtgacacataccatagctacctgtgcaggagcttggtgagttctggttttgtctttcttcccctcaatttctatcccttcttttctttgtgcttcttccactctcctctttctattcttctaccatcctcatcttttcatttagaggcttggagaagagcttaaaacaataggtgatggggagaaatgtagtttcttcatgcaacataatttccccctgcagtaatccatggatcaacacatttgagggcagctggtttagaagaggcccttacaattgtcttaacttactcctcagagggtaggctgggtgtatagcctacatggctatacatggccatgtaggccatgtaggccattagattacatggcctttacaaggaatttttgggtggttttattgtttgtttgtttgtttgtttgtttttgagacagagtctccctctgtcacccaggcaggagtgcagtgtcgcaatctcggctcactgcaacctccgcctcctgggttcaagcaattctcctgcctcagcctcctgagtagctgggactacaggagcacactatcacacccagccaatttttgtatttttagtggagacaggatttccccatgttggtcaggctggtctcgaactcctgacctcatgatccgcctgccttggcctcccaaagtgccaagattacaggtgtgagccaccgcgcctggcttgggtggtgtgattcttatgtaggagaaaaaagaggaacataaatgcagaacacaattatgcaaaattaggagcctttaaaatgaaatatgatattgtaggtagtttcttcaaaacaacatactagttttttatacttgtttattcatcactgaaaacaaaacatatggaaaaggcaatttttctcccagccaaccccttttcctcggatattttttcaagaaaaattttacagcagatgttttcaaatagatttctatttatttgtgggctaccattatatcagtaggatttctctagaacctttccatcacttcacctgagttttctttatcggaagaaaaaaacaaaaaaacaaaaagaaatgtctgatcacctgccctaagtctacagttgagagcagttttggggactagtaagtcatgttctcttaaggacagcgtctcctaggtgagcggctcgtagtccatatggagcaaattagacagtgaaagaatggtgctgctactgtttctgattggttacggtagtattaaaaaagaacaacaaccgacttgcccagctctgaagaagaaagatggataaaatgctctttgaacacactagtcttttttttttaatgtctgtacagaagggttgcatttatatttggctttccagacctgtctcttgaccttctaattactttatttgaaacagcagtgagggtataataaacctggaggttgtctctcctttgctttatcataaattaaagctgctggtttgttgaggtgaaagtggaggctgaatgttcattactgctcaagtgacggcttgtcaatagcagtgctttttagtttgttctagtcagcacttgctgtgcattttgttggaccactgggaaataaatacaacaagattatacatttggaataccacaagagttcacaaaaaaaaccacaaatgataaattatacacttggtagaaagtgacatgctatcttgtgctattaacaaccaaagataattgcaacgaattgtaattgcagtttgcaacttacagtacagtgtgtccaacatcaatcttaatagtgaacaaagcaatttatattaaaacttaattcacttggtaactttccgctgtatacacgggagctaacagatgtagcttttcagaaagttcaaaggcatttgaaacgtggagagaaatgctaatgcagtaagccttggagaaatattgcattactacttgtaatgaaaacaaatgtatgtcattatctcctagtttgtgtttatttaataaaatatgcagtttgcacattggtgaattcagtgtttctgaatggatatggaataatgttctgttcagaatcaaaggccaaacaggactagcaattacgcatcttctgtaaatagtctgctgtagcatgcaccttgatgcttgagtgggttttgtatgaggtgtaacagcaaaccggggtaactttattcatgactttccttagattggatgtctttgaagcaagaaagggagatctcctggaattacttaagagaacaagcatatttgttttgtgagcttgactgatggccggtagagcagttgagtgaaatctctaaactgattagggctttcgttcaaataatcttctaccgttttcattaatttattccttaatgctattttgctgctcttctaccaaggataataatctcacactcgctgacctccatgagtggatgacctggagctcataactaatcttatttactcttctgaccagcccaacttcatttaccttgactggataaagagccttccgttgctaagcctccgttccttcgtagcattctcgttaatctacagtgaagggggaacgatgggctttcccaatcaagatcccaaagcatgctggggcactgggaacttcgtgcgatttctcttcctttcttgaaaacatgtttccactttattgttccccctttttgatttgaaaataatagagaaaaatgggggagtgggacttcaccatggtcccactctcctaatacagctatttttaccttgaaagttaatttccagccattgaccataggaatgtgtgggttaatttaggtattgttgttgagtacatgaaattttgtatcatgcttttttatttaatgctacattgtttcctgtgttgcttcataattttataattatgcattttaaagactgataatgcgttgtttatatactattttgggtttaattgttccccagtattgaagttaggttacttctacttagttatgctattaggaataatgctgcaataaaaatctctgttttcttcaattagatggtttctcttgaatataatattacaaatggaattattaagtaaaaggtataagtgtttgtatggcttttactatacattaccaaaaaaatgtctaggctgtttttctgtttgtttgttttttgttttttgagacagtctcactctgtcaccaggctggagtgcagaggcactatctcggctcactgcaacctctgcctcccaggttcaagagattctcctgcctcaacctcccaagtagctgggattacaggtgcacaccaccacgcccagctaatttttttttttgtatttttagtagagacggggtctcaccatattggccaggctggtctcgaactcctgaccttgtgatctgcctgcctcagcctcccaaagtgctgggattacaggtgtgagtcaccgcgcccggccttggctggttttatgttagtttgtattgccaccagcgatagagaagtatataattttatcacagtagctttgagaattatcctgactcttccacttacaaactacatggcattgggcaaattacttaaccattctccctcggttttcccatctgaataaagggaataatagcaatgcttaactcataggttattataggtattatattagtttatatatttaaatatcagggagtagtgtctgccacaaaggaaacactccataaaggtaagctgttattattcccaaaatttaatttttcacccagtttaatattaccttctatttaagctgcagtttttagagtaaatgttttaatagtccattgaagctaactagtcaatagattttataatcagtaacttctgtatttaatgaaaaatttaaatcacttaggcaataagccattaagaagaacttctcagtaagaaatgttcagtctgtaaggtagaggcttttagaaattccatctcttaatttataataaaacagcttttattccagaatcatctaaatgggtcttgaatccttaatgaaagtctgaaggagtttagtctggatctcatacctgctcctccattaggggaggccagagccccttgatgacagtcccactaagactgcacactataaggggaagaaatttcccagacgaaattggagcactgttaatactagaagatagagaaatggaggctggacagctaaaaatcacaaaggtacaccaaacttcttaaagaccttattactacagtattctcaacactagtgattgggaaaacaactaaatgattgtagacaccttgaagtatttgggtcacccagtaaccactgcctatgacatttatcctagagataaatgttacttatttttggccaggtgtggtggctcacacctataatcccagcactttgggaggccaagggaggagggtcacttgaggtcaggagttcaagaccagcctggccaacatggtgaaatcttgtctctactgaaaacacaaaaattagctaggcttggtgacgcgtgcttgtaatctcagctacttgggaggctgaggtgggaggattacttcaactgggaggcaggggttgcagtgagtgaccgtgccactgcattccaacctgggtgatagaatgagactccatctcaaaaaaaaaggtggctgggcgcggtggctcgcgcctgtaatcccagcactttgggaggccaagacaggcggatcacctgaggtcagaagtttgacaccagcctggccaccatggtgaaaccctgtctctactaaaaatacaaaaattatccgggcatgggggcgggtgcctgtaatcccacctactctggaggctgaggcaggagaattgcttgaacccgggagatggtggttgcagtgagctgagatcacgccactgcactcaacctgggcaacagagcaaggctctggctcaaagaaaaaaaaattacttatttttattagtcagcacaacattgagaactcatataattaggcattttgctggagaaatggctcatgtttggctgcaaatatcaaagaccagaaaaacggtaacttaaacaatatcaggatttattttccttcatctgaaagaagttcacaaagaacagggttattctggtggctccacaacatcaccaatgttcatggcccctttggtcttgaggttctgctatactttgacttggcttctggcttcaggtttccctcacggtcacaaaagaactgctgtggctcctaatggctcacctacattacaggtaggaagaaggaagaaagggagggaagggtataatgtgcctggcagctgagccaaaccccaacccctttttaaggaacttccccagaagccttgcccaacaatctctacctagactccattacctaaaacctaatcacttagtttcatctataggtaagggaaaactgagaagtgcttttcagctgggtacattgctgctctcaacaaaatcaggcctgtgtgagagagtagaaagggaagaatggatgttaggaaggcaacctgcagtttctggcacaactcccttgtgtgaaggagacagtcttcagctctgtgaactctcctggcagcccttgatgttggccagtattatagacgagaagccaggagagtcataatgaagcacttcctggggcagagaaaaaagtaagtggagtgaatgatgaaaactttaggtcattaaataaagttccaacattttcttcttgcccaaaacattcacaacaaactctgtggagtaggaattgaaggaaaatgtgccatgccatttttctttagcctttttgcaatgcaacgcacaatcaatacaaatctttgcagtaatcatatattgattttcctagaatataactccatttaaagcacttttatccccaagagtagaaacattggaggctatcaaaggaggaagtagatttccttgaccccatctgcagtgcacaattgattaacaggatagttatgagagtgtgagagagagacagagagagagaagagagaagtcaccgaaaggttaataccagctaaagagaaacatgattataggacattaggctttttgtaaaatcataaggtcaggataagataatgataccatctaaaattacacaagattttgagtacttagtatcctctgactgccccagcaacccaacccaaaccccaacaagcatagctgaatttttggggttggcaaagccatgaatggaatgataggtttaggttcaggccccatgagctggcttgataagggaatgagtaatactgattcgatttatcctgagtcatagctgtgtactaaactaaaactttagcatacatcacatcgaatgtttctttgcttcagacaaagcgaaaagaaaaaaggacattaggaaccctcatttttattccttttcttaggaaagttaaacacttcctttcttctactttccctcttccctatcactttactccctaaagatttaaaaaaaaaaatctgctttctgaaaatcccatgagtttaggtctgctgggtatttctatgcacagatgtcttcatcccagagacaagaagagtaattggatggtaagttgcaaaaagcatgcaagttctgctctgcctctggcctgagtaactgggatgtagccaaaatggagaatggtaccccctgaagcaatcgtgagttaatgtctcttacatactccttgctgaaaaggcagagagtgtactcttgtttatagtgtattgttctcactgtatttctctccctaagtccctcttgtttttttgtatcaagactgagttctcacaaacaagctctttattaaattaaatggttcatgtagcctcattatccttctcaatgtgcaatacttgatagtttattttactagcaacttctggagtttgtgtttttttttgttttggggggctttttttaaattttggcttcgggcaaagcaactagtacacattgttagataaagtatcttatctgtcagcagcacccttgtgaattaatcataattcaataggattactaatcaagatttgagatgaatgttttgatagagctatcagatttgtctaatctgtcattagttgacagtcgctgcaggcagagtgaaaacttggcaatagtagacctgtttctgatccctttggcttggcccaccagttgggtagcttcactgattatagcagtggacccaggcattgcaactaattaagttctgtttctcactctccaggatcctccctcctcctctcaccgttttcagaatatgttgggtggagttcagctctcatgaacctgcccatgtaatgaacagatttggtaacaaggtgttccttttggtcattttcacttgataacaaagatgtgccaagccaagtgacaaatctcaagggtgatatggtgtcacttgcaaaaagtggtcaaagaaaaaagagaaacttaatctgttgttaaacgatactaccgattacaactctttccatgtcactaaaatctgtgtcccattttaccaagttgtacattcttggaagtaatttatagcatatcttgcacatttattcagtttgattagataaatgaaagctagtgatgtagattggtattttattgtatacactatatacagtatttaaaattatattaaattttgaaataataataaattatactctgcatattatgtagtactcattaatacaaagatgggatcattttatagaggagtcctttaccaatttttcttcctctctctacattgttattagtataaagatatttcttcattatagaaaacttggaaaattctagaaaagtctaaaaaattttaatttatcataatcttgtcatctcagaatgatcaatattaacattgtatcatcctattaaaattaaataacagcacaaataccttaattagtaattgcttgacagtattgtcaataaaatatgattctacctggcatggtgtcctggaatctgtaggcaacacaaaggaatccagaaagatcgtactttctctcaaggcttcactttctacatgaaaaccatatgggaaaactcatttaggctgttagtgtatcccatatgttagaagtgacaactttttaatttcacaagcatgtcacaggcctcactaaatgaatgctagccacactgagagatttgtagcttggatgatttagacaagggatagttgagagttacctaattagactccaggtgtaattatgtaaggcgttccaggcagcagtgtgctgtgtgttaattaactttcatgctgaacatgcagtagcccctgaacaaagaacagttcatggaggaagaaaagcttccttactttgccctagctttagttattctcctactaaagttaacctctcacactcccccttttttctagttgagagatgggccataaacacaagccactttgcaaagtgttcattagtccctgtaactctcttcctaccgtcttccatttccttaaaacattctttggaaagatcttttaaaaaataagaggtgtatgtatttatttatgtacaactctgttactggttttaaaaatccaagtgacttctaatcctgatttttttgctgcccattaaactccacaagtatctttctgtggtgacggggagaatgatatttactgaactacaagattagctaatatcccatcaataactgagtgccacagacttcctcagttcatcccattcctgtctctaggtagcaacagtgagaaaagcacttattaaagaatattttttcttctactaaattagtccatgacttcatttgtgctggtctctgtttgtcaactgctgccaaaaatttttaactcatgcagtaaagtaagcttcgtaaatctatataattcaactcaacacttgcatgagaaaatatttcaggtaaccagttaagccctgtgtatggatggtaactgattgattgtccagtcctctcccagttctcaagtgagaaaatcccatttcgaggttctctcttcctcctaatcctgtcaccttgacatctgcaggctttagttttctactaataacgtctagaatgacacacaggaccaccttgttcatatggaagataaataatagttctagaattctgtctacaatagcatgaaattaacgtagattaaggatttgcctgaaacgttaagaacagataggattcaacatttttttcttctagtacctcttaccaattatgagaaagaaactacttactaaaacagtcttgatttttattgtctgttggaagaaaggtaaaataaggacttcgttgtataaaaagcattatctggcagcccttatagctatatgggaaatgcctcaaagagatgcatcctagtgaagatgaggaacatttggacaatttgagtgttctctttcagttggataattttcagttggatatctagcaaaacttagtcctcatttttttttgtttgtttttcctctgatatgcaatgtagactacatcaggcctttatagtcaaaaccagaccaaccagttttgaccaagcacttcctctcttcaaggctatgtttagtgcatcaggaatcgaaagacatctaagacataaaccctatccccagagagtatactatctgttagggaagattagacattaaaaacatgaaaagtaaaactctaataaaggatttaaagaacagttcaagataacagtaggaaagatatgccacatgacaatacatgattgtcaaatgcatttacagattccctttagaacaaaaactgttcttgaatccttctaatagaaggggttcgtagagaccattatgaagccttaaaatattaagaaactgaagtattattccataagaatgcctttcaatttagaaatttcaatgcaaaggagaaatctggtttatgtaactggtaaagtcattattttaggttatcactgaattgaaagtgtaaaatgtgaaaattcttatataaccagtagatctctgagaaagtgccagtggacaaccccacagagccaggagaggtaatcaaatcatttcttttagcaagttccaaatatgatgaggttgttttaagctacatacataagatcttagggaaaaaatggattttttagttgtctaaatgacactgcaatttgttacagcccaacggatacttcttgcttgctgcacagaaaagccaatgcactgaaacagtggtgttgcggcagaaaaacagtttaataatctcaggaccagctaagtgaggagatgggagatatttctcatatttgccttcccaagaatttggaagctagggttattaaggaaatttggtgggcttggggctagggaatggatactgctgattgggtggagatgaaatagcacgggcgtcaaaactgtctttgtgcctgagtcagtttctgggtggggcttacagagctggtgagtcagttccttggtgtgggtcacagatctgggtggcatcgttggctcatcagaatgcaaagtctgaaaaatacctcaaacaccagtcttaggttttatgatactgatgttttctatgaagcaatgggagaagttacaaatctgtgaccatgagctatgtgactcctaagctgtaagcaattatagaaaagcaaagcaaagcaaagcaagttatgaaacaataactggttatgatttaactatgcccataccttagcaaaccttaagtccttatcacaattctaaccttgtgggcttttactaatttttttaaggtggttttataagacatgggcagacagatggaaagaggtcattccagttaggtagaattccatatgagagtgggaataaggtagtgtacagtaggtttagtgtgttaagctatctggctgaaacagaaaattcaggaaacttagaccaatatatgggaggcatcaaaagatggctccattctgggaagccttcaaaggtttccgaggctaacagtgacatgatgctggtgatattacaggcagattagtctagtgggcagtgtctacaatggatttgagttgttcttgcttgaggcaaagggatgtacctagagaaaagcattgttcctgaaatgaggtgatgtaagcatgcatctgacagagcagttataatagaaaagacgtgaatttcagaggacttctaagttgacagaactttgtaatcaattggtttggaggatgaagaagaggaacgagccaagagtgattctctgatatcaaacccagaaacaagtggacatttggaggctccaaaaccaatttgagtatgggaagaggttttaaagatacagccatgtaaattagctattgggaagacctaaagtgcacaacattcttctggctgtgaaaattatgaaattattccccaaaggactacttagatcattatgtctgctcagtcatctgaaatatattgatatccaaagtacacatccagtaattaaaaggaaaaagaatccaaacagtttgttgattttgatattttgttatgggttagtaattgccttgactatcttcttgcagagcttgtagttaaaggcttgcttatttcttcatcaagtaacagctgaatttcttctttcttcctattgatatagtttagatacttgtccccctaaatctcatgctgaagtatggtccccattgttggaggtagggtttggtgggaggtgtttgggtcctggggatggatccctcatggcttggtgctgtccatgatctcatggacagtgagtggggtctcacaaaatctggttgtttaaaagtgtggcatctccctcccctccactcgatctctcttgtgcctgctctggccatgtgacataaccgctcctgcttcaccttctgccatgagcaaaagctctctgaggcctccccagaagccaagcatattccagtatcaagcctcctgtccagcctgcagaaccatgagtcaattaaacctcttttctttataaattacccagtctcaagtattcctttatagcaatgcaagaatgttctcacacacctatttaggttaaaaggttttcttatcatcttggttttcagaaatggacaaattgccaagggcctgtcaattctggactgacattttttcacctgcttgaagagatactgttttctcttaagaactagtgattttcttcagttgtgtgactgacttacataatactagcagaattggccacttagtgtccaacagagaaatgaagttgagactgtggggctgggaagtctctggggcaatagcttcaggtttgaaaagtgaggagaaatgaagcaaaaaaataaaaacactgtaccttttgtcaaaccctttgcttagatcaaggaatctagatttggccaaaaggttgaatttaatgcatacagttgtgtggtataaatttgtctttgtaaaggtcagacttgtccagacacagtggttcatgcctgtaatctcagcactttgggaggctgacacaggaggacccttgaggccagaagttcaagaccagcctgggcaatataacgagaccctgcctctacaaaaaagagacaacttaacagggtgtggtggttcatgcctgtaataccagctatatgggaggctgaggtaggagtattgcttaagcccaaaagttcaaggctgcagggaactatgatcatgccatgtactccaggctgggccaccgagcaagacccagtctcttaaaataaataaataaagctcagattcatcccattccagggaatagggaaagttccacattgatcagaactgagtcctgtaagctccaaacaatatgactcgcctttaaagtccttctgacgatacctttccaagtgtctgacttatgatgtgttccttgttgtatagacttgtacgtacctgggctatgtaagtatcacttctgagggtacaggtaggagggttgctgcgagggcccactgtcacttcgggaaagtgtagcagtacttgccaaatttaaaagccattgaaacaactgaaaataaaaattaaaggtggttatttcccccattactgaaaggtatatgtgaaatcttgcatttacttttttttaaatagactttaaacattgattttcctttctctgggaaggcagatgtttgtgtaaccaggaaagaaagctgctctcaacagcagttttctaataaaaggcctacttgcttttccattttaaaaccagtgtttaagagctttatgattctaaaatgaaaagaattcccttgctatacaaggaaaaggaagagtgatggaatatttttgcaagaaaaacgtaccttaatttgccaccttacaagtagcctgttggcatgagtacattggaatgaggaagcttttattaggaaataatcatttccagttctgttatagtcattatcccaaaagtttcccaaattctgtgtacagtagtgtgtcctggaacctgtttagtcacacgtggggaatgaactgagcttttgagaccaataggatggtgtgaacataagaccaggtaatagagctgttctcctagtagttttagggtcttaaaaggggtcattaatgctttcaagtcacaaaacaatctttaaagttctggaactatactttcctacaatcatatttcacatttgcacataagttagcttgaatgaatgtttaataaaaagctggctacattcacaatgttgcgcaaaaataaaataaaaaattaaagctggtctctgtaactacttatatgaggttctcagcccccactgacagtgtgtgttttagggaaggaagcacattgagtcactagcaaaacataattgggaaagtgcatcccttccaaactaatgatgtatggtcactactctaaataaataggggttgggattatccattttgataacctgttttgtgtgctgtaactgttcagtttagaaaatacagagttgattccaaatttttcctgctggtttgaaagaattcatacatctttcaaagtgtgactgatattcagcaaggaagtgccttactagttgaacaggatctgatttgtcattcttgtttttgctgtaaagcaaaatctacttttagttaaatcagtaatttacaggtatataaactaaagcatcaagaaaacagcaaagaagttttttccaagatcattcacatccagaaatgaaatgaaacccctacgaggctccttcttcattttgatggggccattgtggttctggcccctcagtttggttgagggcaacatgcggagtatctcagctgaacacagatccttcatttgatgtcctgtctaaacgtgacttcacaaagatcttttagtcagacactggatagcagaactcctcccctgggagaaaaggtctttaaggtattttgaggggaggagaagggttaagaggtctaatccataactctaaatccccatgcttggaggaactcattgacattgtcggttttaagggctcctttggagccattatggtgtgtcacgctgagacccactggagaacacttaattgtagatcattgtcccagtgtgtttcaaggccttttcagggttttgacaaagcagcctcctccgccacttacgggaaaccttgggaaagtttcgatactgacaaacccaagaatattcttcaggtttgtgcttttaaattaaataactagaattatcagaggtttttctgtcttcctttcacccgcttcctcttgaaatgaaacctcaactggacatagaccccctggctgctggatatgtgttggctacatttctttccttttctaatttctttggttttgaggtcgggattttgtttttgttggtggcagaggtggtataatgagcaaacacagttatcacatgcagagcctgtaagctttgatttcaaaatgtaatcgaaatcacatcatttcatgtggaaccaatttctccttgcctccttcccctgaggagtgaaggaaatatctctggtatatcgttaaatacctgatagattagaccttcagataggttggtggattaaggcaaagcacaaaaaaagctcatgttttcaactgtctatcctattttaaggttcctattggccctcagtattctgaatttaccacattagtcctaatctaatatttagccccataatgttttaaacattttgaccagactcagttcccagcttccatgttgcctatctctgttaacatctctgcatgcatacgagggtgttcattacggctggattgagggaaaaccaccaaaaaaccaattcccatttcttgggcctgggaatccggggccctaacagtgagctcagaatgaattgagagaatccctctgggtcataaagatagactgcagggtcaaaactcaaaaccttgaggttctttttgcttaaaattccaaactcaatcaaaaatgagttcatttctaaaaatgctgcaatgccttctcatggtttttccacactgtaaaacagaagttaaactctagggtcagaaatagttaacaaagagagcctttgtgctaagcaggagtctgtggattgagttctggctcagccagtatatttctgtgtcatttggctttttataagctcattgcctcagtttctcttccataaatggaggcaataatattattgcatttctatcttctaaaattaccaagaggtatagatgtgtagtaatacagaggacacttatgaagactgttaactgtgagtcctttttgctatgtgagatataccagtaaaataagggacatgattgttttggtaggcctctgtacggatacaggatagctcattgaacccgatctcaggaattatagattagaaagttgtcagtctttgatttctgcatctccccgtgtgtccacttgctcccctctttcagcaaaccaactgccactgtatctttgggccacgtgaccaaaaagatggttaccaatgggttttgagttttcatgtctcaggtccaacaacctgggtagagacagaatctctttaggatctcaattccagattcccagggagagaattctgattgtttcacccacttctggaactaacagctgtggctagggagttcaggccaccccgagcgagcatggctgcctggaacctgctacttaaatcatatgcatattggggaggtcagttcccaaaaatggagaatgtggcacacatccaatgtatttccactggaccactcctttaaagagtaagttgaagtacccagagttctttgtattcctcagaagaaagttgctttaaggaataaacataaaactttaaagcaggaagggatttaaagttcacccaactctaccctccttgtcacgttgatgaaactaaggcaaatgaaagagattagttttccagaggtcctaaagctacttaatagcatccagtgctcatgcttttagttaagagcatctagtgtatcttttattcagttttcttctgccatctcacagttgtgcgtatttcagatgtcattttttcctattgcctagacgtgtttcaattataagagatttatatttatagtctctcatttaataggtggtttaaattttatagactcttctactttagaaaaacatagatagtatttacaaagacaacatagaaacatggagaaatgcatatgatataccattacatggaaaaagcaaatgaatgcttatatatagtcattatgttaaaaaatatgtaaaaattacgtatgcatatatcaactaggcttgttagaatagtagtattacgtgtaactttaaattttccttaacaccatcattaaattattttagcagttaattttagaaaacatatttaatacaaatacaccctacactacttctcatcttagagctacctgaacctgtatacctaatgttcttgtgcaggaaggtgaactttctctaatgtaagccatatatattttgggcacagctggaacctttattccggcagtgaacacattgaaaatggagtcctcatagctgtggctaaagctgcattaaattatgatcttagtagagacttggccccagacaggatgacccactagaggcaataatcagaggataagatgttttcaagcatgagtagagtcagactctaggagctgggaagaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctcactgtctacctctgatggccaaagctggggagaaaatcagtgtctcagataccatctgctatggtttggatgtgtgtcccctccaaattgcatgttgaaatgtgacccccattgttggagggaggcctagtggaggctgtttgggtcatctgggtggatccctcatgaatggcttcacactgtccttgcagtaatgagtgagttctcactctattagttcatgagagagcttgttgtttaaagagcctggcacctctcccctctctctcttgttccctctttcgccatgggacatgcctgtaccctcttcgccttctgccataagtaaaagcttcctgcggcctcatcagaagccaagtagatgctggtgccatgtttgtacagcctgtagaaccataagccaaattaacctcttttctttgtaaactatccagtctcaggtattcctttataacaacacaaaataaactaatacatcatctgactttgaatctgccctcatgtaaatacatctgttcacatgtaaagcaagacagggacacaagagcagccagcagggcttgtaggggcaggagcaacccgagaggtgggcggcctcctgttaacactgctttctttttctccttgaaaaaggcaaactgggttttcaaggagaatgagaatttcagggaagggatcagagagagtgggcactacatgtgccacatctgtcagatgtcttcaaaccattaactcccagaccccaggaagctgctgctctttctagcattttctagagcatctagcagagcactaagtggtagtggcttaatgatataatgttttgtgaactttgatgaggagggagattttctcaagagcaacttcagaggtgcctatacttctctgtttcagagtggatatagaggggtggaagaaggaggccaagatactttgctttctgcaagaagctatagagatcaagaaggaaacatagggatggaggtaggatttctacctatgaagagttatcaagcatttaagtcctatagggcccatgtggcccattcattcattgaccagtttattcatccactgatgtttttcattcaacagactactactaagcatcttcgactatgctaagtcctgagcagacagtgaagaactagaaagacatggccccgccctcatgaagattacaagttaggcctattctccacacttgttctaactcaatctgctacatataccttgagtacccagtatgcgttaggtactaaaaggagctacaaagatgaaccagacacagtcttcaagaacttcagggatcagggaaggtttatcctgattgtaatccctccagaggttttgatcatttctctaatcacttattaggcctcttgcttcctgtaggaatttgttctctatattagattgaaatctgcctgttctaatttcaacttcctttcttctggccctggctagtcctcagtgtacagaattgccattggtacctgctggtcaaggccaagtgttgtgagccaaggtttctaaccttggctgcagttacacttaactgctcctctccgaagctggatttagcagagatttgatggaagccctgcaaacctcgattcaaatcaaagttcaaacctagtgactggttgagtgaactgctttaataataacagtgcaaaaattgaatttaaaataatccttttagggatgcaagatgcagtggtttagccttttattaatattcttttctttccactaataaagattttaagtcaacatctccttaaatttgattaattccattaggatcactccaaaaaaaggtttatcagtggctttgaaatccaaatgggatgaagaaaaaatcatttatatggcaaaatctcagttacactaactagattaaagaccttctgctgaattaaagaaaaaatcaacacacagattatttgaaacaaatgtaaatatgcaacttttaagcacatagagaaatctaccctaaagttgatgttttttcaagttctcttggagcttacattccagtgggagaaacccgtgttaaacaaatacatagaagacaatttcagattgtgagctaggaaatcagggtagaggaatgggtaatattagagagatcagggaggcttctctgagaggtgacatttgagctgagatctgaaagaccaagccacagtcacatgaagacatggagttagcgttacatgcaaagcaaacggttaagtgcaaagtccctgaggctggaatgggcttaatgtcgtggagaaacaggaagagagtggaggagtgatgcgagatgagaatagtcagagaggaaggtagggccataggaagaagttttgatttttattccaagcacagagaatactttagaaagctaaacactgacttttaaaagccatcaacaaaggaaaaatatgcctaaggtgtgtgttttatatgggaccgaagaagaaaataccgaggcttctccccattttattcttccacattgagtgtacagctattagtaaaatgaaatattatttgcaaaaatgctttgaaaatgttaaagcactattctccttaaatttaagaatattgtcctggaaagatttaaaatgactaagggtactattactttatcacagaagaatcatgctgtgttagtccattctcacaatgctgtaaagatgctatctgagactgagtaatttacaaaggaaagaggtttaactgagtcacagttcctcatggtggggacgcctcaggaaacttacatcatggtggaaggcgaagggaaagcaagacggcaggagagggagcacagggggaaaccaccacttttaaaccatcagatctcgtgagaactccctcattatcacgagaacagcatgggggaaaccgcctccatgatccaatcacctcccaccactcccctcccttgacacctggggattacaattccagatgagatttgggtggagacacagagccaaaccatatcacatgttaaactttaagcaaactctccctagtagacccacctagcgattcaaagaaatacatggctatgaggattccgttgccattttccttatctcatataggtctaaggaaggaagatttccactgtttagaccggaagaccctgaggacagtatcctttctggctgccctgctgtcatatgagtccatagggggcaaaggtgaggctttcctgggcttgtgattcccaggatgtctccacttctagggccacattagctaaatggtaattatgaaaatatccagggcaagaagctaataaataagaactgacaggcattgcatagtaaagaattgttgtgcacgctggctcttctgcaagacacacgatggaggttgagagtgtctaacaatcctcctgaaacgtgctgcccgatgtgctgatgatacaaaaggaaacctgctcgaatagaagagcacgggagaagatttatgtcctgcggatggctgttcctattgtcgtggatccctgggatgtttctgagagctttcttgtgaccttcggtttctaaatgtagaacctggctgtgatctctgggaaagagaaaggaatatgtcctaggtttgtccaatggtatcaggaataaagaagctaagatttggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgccttacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccaggaagcttgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttacaaggaaaactaacaaccagaaaggacatctacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacagaacaaagctggatggagaatgattttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagacaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccagtctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaattgactaaattctgcaattaaaagacacagactggcaagttggataaagagtcaagacccatcagtgtgctgtattcaggaaacccatctcacgtgtagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaaatcagctctgcaccaagcagacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactatctctcagaccacagtgcaatcaaactagaactcaggattaagaatctcactcaaagccgctcaactacatggaaactgaacaacctgctcctgaatgactaccgggtacataacgaaatgaaggcagaaataaagatgttctttgaaaccaacgagaacaaagacaccacataacagaatctctgggacgcattcaaagcagtgtgtagagggaaatttatagcaccaaatgcctacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggaagtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaagcaggagaaggaaataaagggtattcagttaggaaaagaggaagtcaaattgtccgtgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaaccgacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacttaaaaccataaaaaccctagaagaaaacctaggcattaccattcaggacataggcgtaggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtggggctgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggagaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaattaaaaaaaaaaaaaaaagaatttccctaagtcaacaagacaaggtctaataaacttcaggtctaacaaagacttctgctgtttaatgtaaaaaaaaataaaaaataaaaaataaaaaaataaaaatacttgaaaaaaaaaaaaaaaaagaagctaagatttgagttgcttgggtggagtaggtacaagttggtgattaccattcaggttggctgccatctgggtaggtctcccttcatggaaggccccagcagggaagctgtaatcatgtgctcagtgaaggcaaaagtcgttttgatatctttttagtaaatcattccaccaacgctgtgcaagccataaatgtggcacagattaattgagcaaaaaaagtgacttgcatacagttggcacttctgttcttattaggatcagaaagaacaattgggtgaagatcacttcaggaaaaagaaaaaagcatatgttacttattgttttgggtgaatgtttttatggaaacagggatgccacgtcattaataactctggcatgccatcccaattctggtcggcctgatagattaaacatgagccctctctcattattccagcagccgtagagcattgactttgcctccagcctgataagtattccatgcacattcaagcctccgagttgacatcttcttctaaaattgtttggctgtaataaatataaaactttcaccactgatgtaaagcattgctggttggcatcatttcctacccccttttaattattcctgacactgtggagaaacatctaatataaatctgtaatgtgcactgatgacaaactacacggttgaaggaccatgtaatttctccacaattaattaaagtgcatggagattttttttttctctttcattctttctttctttttttccccccagcagccagatgccactgactagctcagataacactgctgtcaactgtaaaaaattaagatccaaaccgtaagaaaggtacttagataaagaaaccagatgccaggttatttgtgatactaccacatacgtcttgatggaagccaccattgttcaacatctgtagttccacagccttaattacgcacttaactcagcaagcctgtcagcagtttatttctacaagtaccgtcacttttgtaaatcttcccttaaaaattgaatgctgccaatcagcacagggaagagagacagagaccctggaagaccttgtgcaaaaagagatggctgcccgtttatgccggtagcacatgctggtgtttatgggcatgtgtgtgtggtcacccagagaggaaaaaatgctctgctaccatttcaggctgatctaccacctggaattgatcaaaagcaaattaattttcattttcaattaggaatacaattaaattcaaagtggtgagggggggaaatggccatgtttacatatagctcctgctggtgggagggcttgaggaaataccagatgaaatgaaatacttgtctttgtatctttgcatttaactcattcaagtgttaaggtggtggctggggctgctgctgctgggactgcagtttacctcccctggagctgcccctccttcccttcaggcagaatgtaggcaaagggaagagggagggcagtcagaaggtggccactctgagatgcccattcatgggctcttttcccaggatttggccgtggatccaagatatgggtgttttcatgtagagcctgaatgaggaagcagtagtttggctttgcattctgctggctctcagcgtcaaagcattacctggcaaacggatccacgtctggccatcatgagagatattgagtgattgtgtgaaaacaatctggctgttgaatgcctcatgtcacaggatcccggcccttttcacttgacttttctctacattcaactgctgccttttgttggagtaactgagtgggggcctgtggggcagacaggattcctcctggctgcctggggaacagttgacccagtgtgttcatcaccaagggtggtaatttggggagctttgaccctgattttaaggaaagtcaattatttgtcaattatgagtcccagaaatcctgatatgggactcagatgttaaaggcccggctctctggtttcgggagagatcacagtggatctgagaatatgaagcggtcatattctcccagagcagtgcatgttgcttgccataagccttctgtcatgctgatgagattcttctaactatccatcttggagatcagcttctttgaaaaagcagagtgggtgataaatatttggtcatatgaataacaatgaagtagcttcagataatagcttacatctttataaaatcctctgggtgatggatgaagaggaagagaaggttctgggtcatggaaacagctgctttgggtgaaagattatccaaagcagggtggtgaccaggaatccttgctgctccagtccatactttacctcctacccacacccccaaccacctttcttgtcctaaagcaagggtttacgtttcctccctgcatggtatttgtgctttaaaagaagattttattacttctgctacagtggaatttctctttttactagacagttggcatgaccgcagcctaaaaccgcaatggagttgttaacacactgggatcagtttttccccctttaaagctattcttttcttttctttatttttttaaagaggaaaaaaatgctccaacaaatcaacagaactattaactttctgatttatttgctagagagagcaaaaaaagtcaatgtgaactgacagaaacgccagaacagacagtatgaaaacattctatgtgaaagtttccaactgaaatcgcaccacaagcagttggttatctggagatagacatcttcaatttcctgattgcataatagaaatgggatttctttttcctctacaaaaagcgttatccataatgttgacataaagttttctgtgccttgagttccaaagagtactcttctcaagaacagcccagcatcttctcaactgctaacggttactgccatttctcctccttcaagggaaagggtaaatgttgctaacatgatgaaggccagaagaagaaatcttcaagagcctgggagattaactctgcccagctggccggtgtcatggcatctagtaaacaggccgatcctccactataaggagaaatagccttgagaaaaattaatctggttatgggttggcaacccaatagctgcctagccagtgcacgtttctccctttgcaagtatctcagggttagaagtgtctaaggatttgagactgtgattctgggaggttcaggacagttgtcctggctgggcctgagccaggctttgccgtggatctgcccacctcaagaactggcacaggtgataggtagtcttcaaatctacatggcatcccaatacagttggtgacaatgcactgtattttcctcccccctcagtttctgaggacccatttctgagatggaaagttcttggccctggcctgtagcttacatcactttggtatttttaaatgcccatgatctcaaaagcagtcctcatattaaaatcaccctttatatcaatacttcattttatgtaacatagtgttttaaaattatatttaaaaggcagcttcttttgtcttatgtgcccttggctaggaaacaaaggaagtctcttttaagaggtgttttacattttatgactactgagagagaacatagttctttaataggtagatatctaagagagtttcacattataggttttcagagattagaagttctggaacaaggttgtttgataacatctctgaagggcaaaggagcaaacggaaacctcagaggactggatgccaaaacagaacactctctagacttgtgggcaacaggagcttttctgagatcgtattattctcaccgataatagcatcctgccttgactgagggtgagggtgtgcaagatggatcattcgtgtcttatacttcatggttatgggcatgtaatatgttcttcattgagccaggcaattgacagagacgccagtgcatttaagacttgagtctactggaaatgagacttgctctcttgccagaaatggatgcttttctgtgtccaccactatcagacatcttgacttttttttaatcctgactcttaaaacaataatatcaaacaactcgagggggaaaaagttaaatatttccatatgaagagctgattaaatttgtatggttttcttttcagtaaaaattgatatgtgatgaaacacagtgcagctggatggctggtttgggttgatgctgtcacatcctctgatctcgctacccagctgtaagggccagcacccggtgagctgccatgctgctcagaatgcccattcccaggcactaaacaccaatcactgattacctggctgaagtctttcctcttaagtctcatcgttcttctgtgtgccttccttttcaagggcaggctgagtccatgtggagcattatggttgataggcatgtgatgcccatctaaaatacggataataagaggaaagggcttctcaattattggtgtggatatgagaacttgactttttttttttgagacagggtctcgctctgttgcccacgttggagtgcagtggcactacctctgtctcctgggttcaagagattctcctgcctcagcctcctgagtagctgggactacagatgcatgccaccacacccagctaatttttgtatttttttagtagagacagggtttcaccctgttggccaggctggtctcgaactcttgacctcaggagatccacccacctcagcctcccaaagtgctgggattacaggtgtgagccactgcacccggccaagaacgtgacttttgattttcccagtatttggagtgggtgggctgcttctgctgttgccattggtggccaaaggtaacaacagtatattttgctgtagcagattttacagagatgaaaccatcttgccacttctattcttaataactgtgtccatctttcctctctgcagagatgaaattgccaaagagtcagaagctcctccaggcttagccagctttcacctttgctcatcatacatctatggggctcctcttaactcacagatgggctagcgcctgttttcagcctttatcctgatccttcgtatctccatgcccgctccatgtctctctctccaatgtctcttatctctgtcttgcttaactgggaccagttcttccccctccctctttcagtttccaaagatcatctcctgccagatcttggcctaaagttaacttgattctctggcctcgcttacagaagccgaactgctctaaaccacctttggtggcagtgactccttcctgaatgaggtcaggcactcgaaaaattgataggcgacactcactctggggcttctcacatatattcctcagtcgggaatggtaaaggtccccccattcagggacttcaattttgtgacagagaaaaagacaaatttgactgtcaacatttgttgggctccaaggaagttacacgtgtaactgagctatttcagatctctatttgtcaagcccagtgttcactgtgggtttccttacatccctcccctgcccaaacccctgccttcgagaaacagtctacaaaaaaagcatttaccctctgaggattgctttgtaattaaaattttacaaatgccaaataaacaagggcatttttgaaatgtaaatttgtcatttttcgtaagcaacttaaatcaactccacctgccttgagactggtttctccttcagcacaaagccacgtgctcctaggttctcttttggctcctgcagctccgattccccgtgcacttagatcctggtgtcggttttttttttccttgaacactttctgcagtttagttatttgttgtaattatcaagttcatttttctctaatagatgtgattaagtatatttagcactgtgtaatgagttttctgcctggttgcatcttagctaataaggaattccttagcggcaactctgacagctgctacgagtcccaggtctgcgctgccacaagagactccttccatgaactgctagcattagagaaattaactccattacactaaccataaaattgaggctgaaatttgattactaatagatcctcaattcaactagaaactgtagaaacggggtggtgccagtggggaggaaggtgaacgcgtgtgaaatgccagcatccacattttcatcagtgtgtgtgttcaccacacttccaatttatttcctgggcaggaaggagagaatagagccaagctgatggaattaaaactgcgtgattcagccggtataagactggaaatctttgttactgccatgatggtaataccttgttattagtgcctctgtcttcgctgagctgagaaacctcccggtgtgtttttggccatcaaaactacttgccattgtcaccggtagtccagatttgtaaggctaaagtgctgaggacaattagtaattggtgactggctgctatgatgtatagttgcttagcaacggtgcctgaattaagtctctggaagtggcatacaggaagagacaagacaggaagatgaaataggtaccatttcaatgtgtaggtgagtcagtaatgaaaaaggagtgaaagatatttgtaatcatagagacggctgagtggaaaattggggctaaaggaaagaaaaggcggaacttagttcctctcttgcgaagtaaaataagagtaaatggcagttgaatcaccccattgatacaagagctcattctctttctttgacactatactgtgaacccaatgctagctgaactcagggtgcattatttacccaaaaggcagcatgaaaattcatggaaggaagagatggagaatgaagttgcactggcttgaagtctttagaacaagattaatttagcttccgttagttcataccagcgaactaggattaagtgggcgacagggcccaggtttgattcagccctgcttgcaatactgggtggaactggtgctctgatatactgatgttcagtcttgctctgtttggagtagagaagtatcttgaagaggccacgaacagcatattcatttcattagacttggctgttttgagactctgagcagactaagatatcaccctgaactacatgatttagtgagctggtttagcctctggaaggccagatgagcaaaagaaagtggaaaagcagtacaagaccttgatccagatactgagccttgttaagggactgccttatctatggcaacgagctatgtctagaggtctgcaaaggtgcaggggctgttttgcaattagtgttgaaacactgagataaagaaaggatatataggaattaaaaagagataacgtaaacactaacaaagagtcttaatcccctcggctgagtgttttgcatgtttacctctgatcagaattcttaataattttgagtgtgttccaactcaataaaaattccctaggaagaaacaagtcgattcttggattaaaaaacaaaacagaaacagaaaaatgtatgcccatgtctattattttaaaaataaaaattaaggaaattaaatgacacaggaaggttttgtttgggtttagtttggttcagcctactcatgggcacaattcagtcccccattatctactgattagcaggatatctttagggctcagaaagcaggttttctgtctctaccgatggcttgttttctggctgaagaatgaaggtgttttgatacaaagttattattgttcaattgagaaagtctttgccctcctggcctgaagttccccactggagagaggaagctgataacaatctctggttctttcctagtacctataaagggctcatcctcacttacaatagagcactgtattttcaggacaatgtataattatttgggaagaagccaaaatgatgactagtgcgtaacaatagcatgcatgatatcacaatctgtctaatggctgatggttccagtttaaatatcttaagctaagggtgctccgtgctctcacattcattcccacagtcccaccactgctgtcccttaggtaagtaacactcaaactctagttgtttaatactcaactttcctgtaactgtaaactctgtgagggcgggggtcatataccttgcttcccactgaccatttattcccagcacccagcacagggtttgtggcccagagggcacccaataaacgttggttgaattaaattgttagaatttccaagatggcccccagtgagccccacttcctgatattcacagccttgtgtaatgccctccctgtcagtgtgggctgacgcttctgatgaattgagtaagggggaataaactaggttacaaaaggcagtgtggccacttatgatctctttctgtctggactactcacgctgggagaagccagttctacattgtgagcaaccctatggagaagcccttaagttgctgaagcctccagccaacagccatgtcgctgattttggaaggcgattttggaagcttatctcccagaccaaatcaagcctcaggtgactgcagccccagctgaaacattgattgcattcttatgagaaaccctaaaaccagagccatcagctcccaaattcctgacccacagaaactgtgaaataataatgtttgttgttttaacctgttcatttttggaggtaatttgttacccggcattaggtaatgaatatactggccaattaccacatgtatcgattcatttatttattcattcagtaggcattgaatgacaactttgccagggactgtgctagatgctagggataccaagacaaataaagcaaggtccctgccttcaaagaactcacagtctaggagagtgagatggacacggagtcagagaacactgaaggttggtttatgagcagcaggcatacaaaggaggaagctggagtggaaggagccgtaaaattgacaaagtggtctctaatataaccctccccagacacacatacaaatacaacactttcttcctaactttcacttagcttagctgtagacagttccagcaaaccttgtttagcactgctccgtgctacattgactccttatggagctggctgaccactgtggaagagagagcactatcctacattctcagcccttggctgtgggcatcccatgatcaacgtgactcagtttgagtgactcttgccagtctgtcagttttctttcctcttccctggtctctctgtcattaacaccctattacctatggatgtcttcattagaagcaaatgttgttttttgttttttgttttgacacggtctcattctgtcgcccaggctggagtgcagtggcacgatctcggctcactgcaacctctgccacccaggttcaagttattctcccacctcagcatcccgagtagctgggactatgggcacgggccaccacgcctggctaattttttttttttctgtatttttggtagagatggggtttcaccatgttgcccagctgggcaaatggttattttttaaatgaccaaaaaaaatgagattattttaatgctttgtatgctcgcccgatatataaatgcaagtttcactgtggcttgagtctgaacatggttggtagatgtgagtcataccctgggcccagctgcgtccaccaacagaatacttctaaggagcaccaggaagataaagacatcagcccaaaacgctctaatatgttgctggtgagcagtaaatcacagtggtaagaacacatctccatggggaccctgctatcatggcccttctcatggctgattctttagaagactcattcccacggcctcttcctgtgggtgacacagtgccctggacatgggtggtactgtgtggttgacatagggcctgaaggtgggtgacagatgttatggaggagaatttattttattttattttttgaggggggagacagagtctcgctctgtcgtcaagactggagttcagtgacacaatctcagcccactgaaacctccgccgcctccagggttcaggtgattctcctgcctcagcctcccaagtagctgggactactggcacacaccaccacgtgtcagtagtcccagctaattttttgtatttttaatagagatggggttttgccatgttggccaggctagtctcgaactcctgacttcaggtgattcacccacctcagcctcccaaagtgctgggattacaggcgtgagccaccacgcctggccggaggagaaactccagcgcagtaaagaaacagccctgctggtactgggtcctttaccctccagagtggggctcaggaagaaggaacaggaccaggtaccaaaagccccagtaatcccgtcaagaggtgcccaggtttagagatgacttcaaggaggaggaaagcctacacactctttttccatctgctgcaggccacagtggcaaagcaataaaatgctgataccatcctcctgcaggtataactgatttaagtggggaaaggcagacaatctgtgagagacaccaaagattacttggcttttccccccacctcctgtgcatgaaccggagaatgatggaacaattggttgtgtttggggcctttatttgcttttttccctcctctctttaaaaaataaataaataaataaaaaatctgcctttgtctgctgctactgtgtctatttttgttgtggtggtggttgttttaaataggagaacttgtgaaatgagactgcataaaagatggacttgttttatatatgggatattgcctgtccttcagatctatgtgtctcgcttatggaatgaaccaaagtaggagagataaactaatattttgtatcagctcagccagacaatacagatgataaagatgtttcatcttcttatgcatgcagaaaatatgaaaaatcgtagtttacacacatttgctcaattcaagtgtaaaattgggcccctcgattgccctgggccacagtggctgtgttaaggaagctcgatttaccttgcagccgagtgaaaaatgatcagaatattagactcatctagcccacattaaggagccattgcatttcccgacaattgtatgctatctcaatatgaaaacagagcaatttcaactcatatcaggttatgatcggcaattacagttgcataattcacctagtcatctctttgcagggcctttattttccctcttggtgacattcctgagaaagtgcctgataaaaatgtcatatatcatcccagctttagaactcgtgagggggtaatctgctatgccttgctgagcccatattcatcactggatttttgacttggaggggtcatggcactcataatttcctgtttgatattgtcctcaccagctctgacaaggggctgtaaaagctcggttgtaggcagtggttaagcgctgctccagtggggcccatcaccagcaataagagtgcattactgtggctcatgctggagttggccgtttcgaagataattagatttgatgtcaacatttctttatcacctgcatccttttgtgcatctgtgtgtcaagttgttctttccggatttattagcaccctcagagctactctctatctgtcagcttgtgtgctgtttgtgttgacagttgtaaagttaattactagtactaatgagcatcgggcttttggtggacatggcgttttggacatttaaaactataattagtttttttttgttttttgttttttgttttctgtgtgtggtgcttcagtacaaaataaaacgtgttttaaaaaaatacgtcccttccattgcattttgacattctgtgtgcagtcaacttatcttttattcaaaggctccaaaaactcagttctgtttctttttaaaacagacttccttttcattgtaactccatgaataatttcttttgttccttacttctcttccaacttgataacgtgaccatttcatatgccttgagaattaaggatagtgatggtggaatgatcaaaaaatgtgctgggtaaatgttcatctctgcccaatcggtggactacaaattttccacttttaactctcctcttttcaaatcgtactctgggttcaaccgaaagactcagtgaatgaagaagattggataaaatgaaaagtgtaataaatcgttctctgagtggctggccccaaaataatagtgatagctcatattggtgtaatgttaactctctgccaagaatcatggtaatctctatatacagattacctcatttaatccttgcaacaaacctaagaggtcaatactattatctccattttacagacggggaaactaaggtttagaaaggtgaagggtctaacaactaggaagtagtgctgggatttgaatccaatcagtgtagctcagagcctgtgctcttaaacactattctatagacacaaagtatgctttcaaggaaaattagcagactcctggggcatgtattctagaacaacaaaaaacaatcacttactaaatcagatcggctcatttgtatttcactcccagccatactgggacgctagtttcagtgtaatggcaattatctatggcatgtactttatggaggtattttgtttggtctattgcggcagcaaagcaccactcccttgctgctattcatatttactttctattcatcattatctgccattttgctaaataactatccttcccagacataaatcatctataaaaaatactctggctcagagaaaatttcgccctggccctgcaatgatgagataaccattttcatctcttgttgaagcattgagatttattggctttcgatgggcaacagaccaggcatcactctctgctaaacagactcccacttgcatttattcttattgcatttagtgattcaaaatggagctctcggaatcccttgagggtccattcccagcctgggtggggtgttattactttatattagataagggaaggacacacaaagaaacatgcggtgattcggatgattttttatttccgtttagcagtgatgacagaatgtcatagtgaaatgacttcaaaagtcatttttccccactgccctggttctgcagccttgtcccttgagggctcttccattgtacagtgttattaattctgctaactttcagacttcattgctgacaacaggcctcttggctttcgcagcctattacattaaatttcccatcaaaccatgtcagcctctgaggtcacagatttcaagagaagctttagatattttgccatctgacttcatgggcaggtgttttctaaattgcttttaggtttgtttttccagtgtcagaaatcagattgaacctgtttaaaaaaactcagacagtgagtgctcatcaggataagaacaaagcggagtttgaggcacgcctgaactggcatgtgtgtttgtgtgtgtgtgtgtgtgtgtgtgtgtacagccgcacgcatgcacttgtgtttcagttgaccttccaaaggcagagcaaagccttccgactcaacttcatccccggccccacctggtgagtacagtgtcttgttgactatctatttttctaatacttaactgaagccccaaaatatagtgtgactgccctggtgaacagagatatgctctactgaccttgactttggagggctctgtgaaactgttgagtagcattagaaggtcactttgggcaggccagtgaaatgacagaggacctggtctagggctagaatgccttaacatggactcctcaagcaagttcctggcggcaataaaatttcagtgtgtcccttgatgcctttattttggtgtgctgttgtgggatcaaaataaaggaaaagcagaaaccttccttccaagtaacatggccacaggcatcacgttgctgtcaaaattacattctgaaggaagcctgcacaggaacgtgcaactggggctccatttaaaaacagaaaagaaatgagatgttatttttgaagcagtcaactcgtggaaatgattacaagtcatttggcaaacccaaagtccccttgaaattcttatttattattagttccggttaatatttctgctctgaaaatgacaacattcaaatcttggcttgccgtgatagttcagattgacaggcttggccgttaacacctttttggtcttctgaactgggtattgtagtgtgcttggcaggggggtgcggcaggaaagtgacagaccttggaagctgaagaggagggaggacccacacgctggcttcctcagtgatgggtatctaagcacttcagtgcctcacctaagagcaggtgacaagagcttggtggcttgcaggaagcactgcagttaactctagccccgccccctttttttctttataatttgtagagacctcggaagctgctgttatctgaacccatcattagccagctctacctgcaggaggagatgctgaaccaggctaggaccagagaaagatgagtgaggcgaggtagtgtcactctgtttcctcctgctagcagccataaggagagagaatcatttgtggcactctggggacagttttgtcaccctgacagtaatgctgttatgcgctggcttgacacacaggatgaatccataaagacagataagtaactgtgaaagtggctggggatcaggctgagtgccaccactcacctgcagtgacaaatagatagtcatgaaggattggaaatcctgcccaacacagagatctgtcagcagagagatggactgcaaccccagtgacacaggcagctggagcaaagtgtgtgtgtgcacacatgcgcccccgaggggtgtgcggggaggttaacttcagagccttgtttccgagagggtgtgtgtggtggtgcaggtgggatgagaagatttcgacacttttcctttatgaagtagaactgtggatgttgtgtctttttgttggtaagttcaggcacatttggtttagaaggctgtgcttactttccgttttccccggaatttttctgataccaataggggtccccatctgcaaatcaaatgaatccaagttatgagagcaaaatactactgctgaactgctgatgttggtggcaccaggcaagggacaagcggaagcaggggggcccttatttatcttttatgctggaaaggcttgttcttcctggctggaaatctgcttttcgtcaatgaaagaaattccaagggaattgtttgaaaaaacaagcacaaggctggaactgctgtttcccacttgggcttgagatccgaacagcgctacgttttacagttttgaaatctgttactgttattatgcagaatagatcatctttgttgtaattatccttgagatcacaaatgccgtatggtgttctattgtctttctgggaagttatgaaatagatttgaggcgaaaagtaaacataagcgataagagtcaaacctcattgggtcactgtcagccatttggacagaagccctaaatggcccagaggcacagccatttagaactcttttcttttttttttttttttcagtagaatattttgacccccagaggtatgcgtagctatatcggggatccaaaggtttcacacaggatgagtcctgtgtctacatgcagcgtagcaggagctgggaatggaagcaaaccaatattccagcatctgcttctagaacagtgatcaggatcgctatcgttaataagatgggtgtatgtgggacccaagactcatctgtcaagcccttcttctgactgcttttaaggtaatatttttaaaaaacaagaaattacaataagcttttttttttcaaatgagtcttcttgtcctattcctttattattttgccacctacctttgtcatcggtggaattgtacttcatctatttcagctttacttatcctgctagttttacttctaggagcttaacgtagggtactggtaattctagaactggttcctgaaaaatggtacatgtagctttaaactattatcaccactgttgctgctgctattactattactacttctacttgagtgctatatatttaaacatttattctttctatgtaggcaagcccttgcaaccagatatttctttccaaagccctggggtctatttgttagctttaagattctttattttagtttatcattttgtgagactaagaatattttaaagcagttcagctgtaatgaaaacattttctttttgaccctgggttctgagtttgacatgttttgaccctatcattctaaccatgatttaaattctgaatttccagaagccttattaaagatgtcaatttgtgcaccagaatggtaaatgttcctgtgaactttgactcctaaaggaaactctattttaaaagaataaaagattttcctgataaatatgttcctcattttgggctaatactttcagtctgaactggggaatggggcagggagagaccattgcctgaccctacttgctccctcattctgtaatccaaagctattttacaacccacagcattcgatttttattttgccaagaacacgttggtaatgggatgtaaatctcccggtgcacacctgattaaacaggcctgtatacgtgaattaaaaaagagggtgagccccttgccatcacggggtgacagggaagcacgccagataaccggagctcagttggctgaagggagctcggtggctgtttttattaacttgagagctaaggtcatgcggcttcttggggccttggtgaggaaatgtaagtgagaggtctttccctggctgcagatctcctcattctgatgtgcaaggatgctcctggaagtggtctggcccccacccgcctgactctggtcacaatggccactgtcaggcaccaaggcacgtaccactgaggctggggacagctgagtgttagcataacattttattttattttattttattttattttattttattttattttattttattttatttattaatgtactgatttttgacctggggtcttgctccatcatccagtctggagtgcagtggtgcaatcatagctcactgcagcctcaaactcctaggcttgagccttcttctgcctccgccttcccagtagctgggactagggactacaggcgcacaccatcacacttagctaatttttaaactttttttaggaatggggtcttactgtgttgcccaggctggtctcgaactcctggactcaagcgttccactcaccttggcctcccaaagagctgtgattgcaggtgtgcaccaccgcatccggcccacagttactcattctgctgacctctgttgctgctctcctgagtatattccggctttgtagtcaggacatcagatactagcatttgtcaataaaaagtgtcaaatgatgtgaacttcctcagtcttaccaccaaaccctacttttcagcgagagtgcttgcagagagaaatttcttctagagggtttggcttgccttgtcactttctggttctccctgtcttcaccagatcaaactattcgcagagaaaaccgggccacctcttggacctttctgggaatggaaaaattattttggtgataagatgtttccagcccactgttagggatcatggcactgtgcccatcaacacttggtattaccccagcctccttggagtcctcgtccccatctccctctgacctgagtaactttgaggaactttagtatatttggaacccgtatgccagcagcactgttggaagctatcaggaggacacctggtaactaactaacttactagctaacttactaacttatacagctcaactaacttatacagcagagctgtttagactagccacttttgcacacagtacttctcttgatcctcctaacccagtgagatgaatgaggtagatattattggtcccgccttgccttggggacactagcatctgaggagttaccactactagtgagtgttgggaccgggattccccatagcatttttgctgtcccaggagactttcatatgcattgttttcctgggtccttacggtagtccatgcagtaggtgagacaggtgatgaagttttggtctgcaaatggggatgctgaaactcagagaggctgactggctttcttggggacatggcagctgacaagtgacacaactggaaacgtatcccagcccttccaacttttagaccgacaccctttcattacacgaggactaactccacaattatgaaaatctcaaaaacaaagctactctgaagtctctatatagctttgcccttcatatgattccaaattcccatgccagtgaagctgcagttccggggaaaatcccgtgaaaggaaagtcttctttggctagctattcagaccaggccagggagggcttagcagtgtgccctacacccagcgcatgtgctcaccagcccattggtattgaaggtgctaacagtctggactcagatcctggcactgcccaccatttgctgactcatgtcccaggcatttgcaaagtgtatgggctgtcatacagaaatagagtggatgtttggaagaagagtatcaggtgtagctcaggaccagtaggaaaggtgtccctgccagtggggacagagagcaaaagcaacgggacaaacattgaaggcacaatactgcactgtagaggcctcccatctctgcagccccagcttggatcacaagggaagttactgcacagccaagtatgctgcatttgcaaaggtcaggctttaattacatgcacagttaaatggaaatactgtagagaggtcacactcatatttctttggctttcattaatgttattgctctgtcactttccctctccttaggtttgtaaatgaaagttcctttagtacatttaaaagcattatttatttttaattgtcttacctctggagggagaggttacttctttttggggtgtttttggttgttgttgttttttttttgttttctttttttgaatagacttaaaaaaaaaaactttgcctatgcatttctggttaatttatttcaaaccttttgctttttatagtcttatctactaatacttttgattaaaacacaagcaaaaaccagccaacatgaacaggttgaatgccacatctgtgcagaagatagcagctcacttatttatggctcagagaaatggagcctaaattaagctagctattgctggagagtggataagcggccattatgaattatccttaattatagcgatttcctaaactaataaacctgctaaatctttattgcaaaggttagtttacgcagtgcatataaaatccgcatgtgctccgcatcagccaccagctgtctgacagtgtgttgctattgcagtgagtgttcacataaattttatgttggttatattaacagtccgtccatatcactacccacagatgccagtagacataaaaattgctctctagtgagcctaaatatccctagaagctagttgtgtctaatgttccatgtagtatttgaacgtgaaagcaccagattggagggttatttacagatgaatatttcaatccacttagttcatataggcctacttagccttctttgctggtttatttgtatgctaaataattcaccaaaggttcttgtttactttctatagtagtttctatgaaatgcaaacaagggagccaagttgaggtgttcaaaaggctaagcagctctgtgtttaaatgcaggtcagagcagcaaatgcagtcttactgacgggctgtcactcagttttacacattcctctctcctctgtctttttttttttcttcctcctccagatataactggggcttgctgctttcataggaatttttggttggactatcttctaaatttgtctttttcaatacctgcctgtgtgctaccttcagcttgcacaattaaccacccaatgccagcagcaaagaacacatccctggctttgagaagcttccccacggtcctctgggctaacaagaacaggtcaatcctcagctcttgaaatgtccttgttgtcttcctttttttcctttctcattttcttatttttcttttctttttctttcatttctctcccatggttttttctagtgcatttccagatctcaagatttgaaaggacagcaaataggacttttttccttgagagccctgagctcgcccagcctctgtcaacctgaaagccagaagggcaaagtctagctctaaaaaatgcagccttgagaagcccttagaatatatgttcacccaggggtgagaaggatcattgttttctggcaaggtaacagttacctggccctattgttcacatgtccccatggctgaggttatgaatgaaaaatacctatctgcccccacattttgcaaaggtttacgatcctaaacatttgcccccaaagagatgggaaaatagcctcctccattttcagccaggcactgccaagatcatgggcgagttcaatagcagtgctaactttttatttaataatattgattttatcatttttactacttacaatggggattggtcggctgatagttatttgacctccctttgtgcatggctgtggagtgcttcgttaaggctattgacatatatctctcttccccactcttcttccagcagcccatctcggcaaataatattgagatgcggtaactgttccctgatattgatttcagattgtgttcatcacacccttctcggggccaggcagagagcagcagccccagttctgcaaatccttgatggctgcaggctgaagtatcgtttccatctttcaagcaagaatatcaaccatatatatttccaaaacattacccaagaaaacgaaagcattttttgatcatgattatttttttacacatacataattaaactgatcgctccagttttatgttgggctttttctgcacttttctttttaaggaatgctagaagatccatgggtccctgagctggtagaaggaactctgattacatttttaagcttcagggattcaggatttggcacactcggccagacccagggcctcgttgaccttcagttctcagccagctggggccgtctgcaccacctgggcctaaaaagttccatgtttggcccctgtggagtcagttgagatggcagggtatttaaaagaaccagaggtttaacattcagggagagcctacctaatctagtgattacaatcagacgtaggaaggacatgatgcagagtttaggtttgcatatttatttaaaacaccaaacaccaagcaaatactaataatattggaaattatacgttccatggggaaaaacaaaaaggcaatagagaatctataccaagagtgattatatctgagcagtagaattgcaggttatttatattttttctctttgggcatttctatgttttcttaattttcttttgtaattagaaaaaaagaagcctattcataagtattatttttttttaatggaaagattagttggattggagctccagaagatccctgtccaccaaagtgaatgcattagccagggttgaaattgactcactggccatgctaatctctgccccaagggaagtgggacagacatcactcctatcattgtgcacctgccagttttcattttgtaaatccagtgggggttgtgctagcccttgccgctgaagcagacatacaaaatggttaggaagaagggccatggagtcagataagcctgggtttgattattggttctttctcttgccagctatgactttgagcaggttacttaactttctctatgccttggttttttcatctggaaagtggatttttgacaacccatctcatttaacaggttatctcattaaatgagatagtgtatagtaagctcttaacctagtgcctggcatctagtaagcaatcaatacgtgttaattatcattactggcatcgggcatctgtagagcaatttcctcttcaaactagactcataatgagaattagcctaaacacagtctgcagaatggtcatttttttctccttaagcacaaatgagactcagttgagatctgccccagtgtctaatacatataagattttctaggacatcctgattttatatagcattctttgattaaaggcaattcattttaaaatgtatatctaaatggaaattttttgaagattttaaaataaataaatatatgtatgtatcaggagaaaaccttagaggtctttattcacgattctgaacatatgatcaccatactgatagctctttgacatagaaggtgctcctccccacaccttctatccaaagcaagtattattccagaaaaatactggaaacctatcaggaatctttagaatatcgtccatttttttagagtcagttttgctattctcatgcgtttcttacttatagggtcaaaaacactttctaataccacggatggcatggaattcttccctgcaggcagccatcttcaagactgaaagcagaatttaaaaagcagctaaattagagactttacacagttgctggatcctgcttaatgagagacagcgaacattttgcaggctactgaacttctgaaatgtgacaatccaagcaaatgaaatcatggtacctttcattgtagtttaattggactcaaactcggcaagaggggctgctgaaagctgtattcaaagagacagacaggaattgtacaacaactaattcagcccacacaacacatcttacaactgtccaagctccacacttgctctcaagactgactcttttggtcaagagagagatagacctgcagtgaacaaaagcacagattgtaaggcaggccaaatactggcattgggaatggcatagctgtcaccccaagttatgcatttgaaatagctcagtctcatggcagccagtacaggccaatttattttaaagaggaaaagagaagtgaaacaaacttaggccctctcttctgcctgttagggtgtcaagatatcagtgtcaaggagtccagttaacagaagggtgaggatgagttgagcataaacactaacaagagaagaacttagcacaggcctcctgttgagtggagctaaatggcagtcccagttgagtaacccaaaaagcagagaattaccgtagctgtcaggagtgggaccaaaatcctgtcaggcagcggtaaaggggatgggaacggtttgagggaaaggcgagttttgtgggggagtgaggtcaagaagtagactgttttagggcatgcatgtctgaacttaggaggcccttggactgtttaggagggtgtcttggcttccttgttttgttcttgtatcatttgagctctgtggcctgaaactgattatatcatctcagccccttctggtgtaaccatcccgcctgaccacttgagtccacgtttactgttattatggctgtaggtttagccagtaaggctaaaagagtggacaaattgggtgcctgcatgtaacaggccatcctggacattgatttttgaaggttcattagataaatgctgacatcacagattgatgtctctttaaaccagtacctagtgcaggaccgtctggggaatcaaaaatattgatgtaaacatgtttgagtagaaggcccactggagaattccactgcctaaatgggatccatcaatttaggctttctttaattattctaattctatgcatcacatcaataggggagtttgtctgcagaaccggtttttatagggggtgccgcccctacgttaggggcaaaggaaggccggacaaggtatccacatctatttttcattgttgttttgagttgctgtttagtaattaaaatttttgatcatagactaattttcccataccatgtggccgtgcgattgacaagggactgattaatgggctgaccccagggccaggaggctgctgggctcttctcttgtggaaggcatgccggcaaaataaagttgatggttttgtttgtgtttaacccttcaccttggcactatcaatagattgaagacatcatttgtatctgcaagtgtttctttaattaagacctcctaaaaatctttcctattgattcattccattatcctattgattaactgcagtggatcatgtacttggtcttcagtggaaggcaacagcctcagccgtctgtcatgactacagatgcagaccacaggcagccagcagccagcgcccagggctggcaggagtgtctcgcgttctaatgaggcatcagcggtggctcactgaacaccacagagaaagccagttgtctcctgctgaaggggtggccaagcataaagcattccttccagttatttatactgcagccacttagctaacagtatgtacggggctactggcagtcttgagctgggggaggggaaggattctgctgtgcatctgaatttgaaaatcttgagctttgaaataaaagcagactctgaaatctaggtgcaaggcatggttcaaaggctgactgttcgtgttcctttccccaggctgtagttttgtgccccgccccatcctcacactgtcccccatcctatcagcctcctcactaggatggctaactaggaagtaccacagggggcttccgttttggaaggagcttccctctgactcggtcagaaagaagggctggcccttgtttttaccatctgccactggacatacatctaaatcatcccctgctattaaaaaatgaagaaacctgtggctggactagttcttaaacttcatgttttgcaatattccttaacattgacagttacaaagaattattctggttggagtttaaagagagaaggaccttattaggctgtagttgggtattctgggatatgcgaaatcaagtgagttaaaacactaggcacatagtaggttctcaatcaataaaccaataattgttgatccaccaaaaattcacctttcttcctctcctacgtgtcctgttgcgtccctattcaagcattctctgcctccccatccatcaagtagactcaagaaaatggccttctcaagggatgggacacctttcttcccaaatggaatccaacaggaaagagaaaatatagaagtgagggtaccaggcaggaggcagattaagttcagagaatctgatgtctctcttctctgactctttagtaggcaaattaattaagttttacttttggagtgaaaaattctaagactttgaaacatctctcctcagcaagtttataatggtcttcatcttcaggatcaggcttggcgtgggttttcaggaacgtgtgtggccctgagttaaagtcagtggcttttttaaaatagtccccgagaaaggaaggcagaaagtcccacctcccccatgtgtattttgggattaggaaagctagtggttactgggaggagctctctctcttctctctctctctctcccctttttttttttgaggagggaggtagagactgtctcaatgtgttgttctcaaactcctagcctcaagctctcctcccacctcagcctcccaaagtgttgggattacaagcatgtgcattgcacccagcccaggaactcttctttctaatatgagtatttatagaatactcatgtacagaattttcattctatagatttaaagaataaaaatttatagaatactcatttatagactcccatctatagaatattaaaatcaaaattgagtgcaaattcagggccgatttgtgtttcttctatcagcagttgttaacaaccaattgtttgcaccaaacccaagggcttgatttcccttggcactaaatgttatgttttgggtgtcttatagtctgtcctgtgagttaacattgtacaataaactgttttatcaggacttgctgatcatcctgcctgctagttctaccctcgaaaactgttttttttaatgcttatttcaatacttctgtgaaatttgacgttatgaagatatccccaaactcttctccaaaaaaaaaagcagaaatttacttatatctaaggttacttttcctaagccaagtgattcagaaacttttaggaaataattttgaggctaaatatttctgggtttgcttttttaattaacatgttttaaattagcatgtaatctgtcttcattaaagacatgttttgaaaattcagagaagtataaaacagaaaggaaaagtctcctgtaagcctaccaccttgggtaccactaggaatatttgagcctgttgcctcccagtctgtttttaatgcatatatacttgtatatatactttttaaagcaatattaggatcataatattttataacttttgcctcttttcacttactatatcataagcaggttttcttatctttaaatattccttgggaacatgattattaagggaaactagaattcccttgtatggatatgccataatttatttaacttttctcctatcattagacatttaggttgtttcctatttttttccctatcatataaaatgctgggatgaatatccttgtctaaaaattttgtgtgaatctttatcacctaaggatagattcctagaaattgaattaccgagccaaggattcacacatttttaaggctctaccacatactgcaaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattcttttgataatgaatgaggtagcagtattttcttatatttaaaggctatttctatttcttcgtttgtgaaatacttgttcatgtcgtttgcccattttgggggaatgcttggctttttctaattgattcaaatatttttttctttttaattaagaattgtggccctttttcatagaagatcagattagattgttagagatcattagattggatttttcatgtagacatgaagttatacttggaatatctgttggtaatggcaatattattaacgtactttttacttttaaaaatggtttgttcgcctctgataaaaaagatatatgaaaaagaatctgacagtgtcaatccagctctcgttaactatcccaggacgctaccagcattttattacagttgtcaagaaaaaagaaaaccaacaattttattgttttgattattgagatccagccacagatcaactgagcaattaaaatctctaaataacgttctctgaattgtcaaacaaaggattagttcccggtggaaaggacttttctaaaagatgatagttttctctgtaatgtctgtgccagtaaatggttgcactaattggagtatacagaaatattttactagtttaacaatgcatgacatcctaataagattgtgatgacaagcttttctttttatgaaaggtgatgtcaccgcatgcttctaatatacatggactcatgtgtctttttgtgacatgctataaatgaaatttttcgatgaaattaatctgttttactaaatctttactgtatgtgaaattatttctttaagcagggcaacagagtcttgatgcttgtttttatttatagttcttagaataatatattttaaggaatcttagagttgagtagaaaggatcacaattaaatgcatattaaaatgcttgtcccaaatcccatgaatctgtcactagaatatgcgaggccggattccccatcttcccctagctcaggtggctagccgagtgcaggcttgggacggttaatgacaatcctccaagacaagcaggacttaacatcaatatccctcttcctgataatctgtatactctagaggtggtgagctctggcagggttttgatgattttatgatggcttgtgtatatttatagtgtgtttaaaatactctttttagttatcatttgagtgacacaacttaatctttcgatctttacctgcacctcctggtgatgtgtgtttgttaggtaactaaaaagaggaaattaagcaaagccagagctttatgccagcagtaggactgaggagtcaatagatgattaacctgcctttctcctcttcatgagaataaaggagtcactttttcagagcagcaccctagaaacatataatagctatgcagaaatgggcaacatttgagttccacaaagcaagtatacagggaaaagaatagcaggaaatcatttgaatgctgttctttaaacacactgatctatacccccgttgaaactgtctgtgacagtcagtgtcttttgcgttttatatacacatatgtgtttgtatgtatatgcatatatatgtgtatacatatatgccatatatgtatatattatgtacatataaattatgtgggtgtaagcagcatacgtgattggatgctgatattttgttagattttagggacttaaataaacaggatataatcataatcttagtctatcaaagccacaccttaaatgcatccctgtatcatttcatttgaaaaggcatgaaaggccagggtaattagtccttactgcagatgagtaaaggcatctgtgttaataatggatgcttaggattttgaattaaatattgaacctctggcttgcttttcccaaacgatgaggcataaccaccactctttttgaaagctcttattttttatattatgggtcaaaattttaagcaaaagctgaggaaaacaacttcagttaatcggcctatgtgattatttgacatatgtgattaactgactgaggtaaggagcgtcattattatatcataatcatcattatatataaaggaactccaggctaagactgccctcaaagaaatcttaaaaatcatggattgatttgcagatttagtgggatatgaaaagctgatgttgtgcctgaataagataagcattctttattagattgtagtggagaaagccctcacgtggccatgtgattttattgacagctcagaaccaaagaccataaattctgtcaggcaatatactgtcctaggaaatggacatcacagatgccaaagcggcctttgggggcccagtaaacgctgtgtggagtcaagtgaagaattaagccccagaccaagcccagtacctgcatggttatattttttagctggtattggtgaggcttggctgtcgtttgtaacacatccgtgcccctggagcagcttttctctgacatcacctgtgagtcacagtaaaggcccagtagtcatcctgaagccgcctcccccaccaagctactaacatcaaaatgatgtttctcatatgattgccaccttaagacacgggcagcggtaggacaatgtgaagtttgtgcccaaagttcagccagacaggaaaggaagcttcctgagtcccctcagtcaggcaggcaagtgttcatgttcagagaaatcatcaaatgcagagaggaaagaatggtgagctgaaacaatcagatggcaggggggcaggtcagggtggggagctgagtcagaaggaagaggtaggcaaggcctggaggccagaatggcaggcagtcggatcaagaatccagattagtggatttgggaagagaagatcagagactcagaaggggtcaggaacccggaccagagtgacttaaccataaaaagtagaaatctggttaagaggtgggcccttaagagagtgacataccaaggatggggcagtgggggcagtccattttagctccccggccccacccccatccatgctggtgacaagggggtgcactgtctgtcgaaaaacttccaaacaataataaaactaagagtcagtctgctttttattatcccctttcaccatcagttgtgatcaatgtaaaaatccttcctaacaaaatcttccgttggtctaaattctaaacagtgttcaaagttacatctaaagtttacatatacaaatacacatatatgtatatgtaaacttatatacaaatacacatatatgtatatgtaaacttataaacttagtaaaggatatgttactaaaatgtgctaatttgaagtgtgtgtgtgtaaatatatatattatttagtaaaatagtatataattatatataatattctaaatatatattagtaaaataataaatataatatttataatatacataaattataaatatatatttgcacacacacacttcaaattagcacattttagtaacatatcccttactaaatactgtgttcttcatggatgcagagttctcagttacacagtcagctgctgacacacacacagtcagctacacatgctcgtttctggagtcaattcattaccatttggattgttttgagtgcacttcagatagagtttgtgtctccagtgactgtagtgccacatctttctgcatctgaacagtagattcaaaatcaatagtgattaagatgaagaaacaacatttggggtatttcagctctttcctaccatgtgagcacttgaagtttttctttttgtttaaactctaaaacagaaaggccaggtatggtggttcacgcctggtgggtcacttgaggccagaagtttgagaccagcctcagcaacatggcaaaaccctgtctctactaaaaatacaaaaaataaaatttaaaaatttaaaaaaatctaaaacagagaaacagtttataaactactcagtgtaatattttcatttggtaaatgaacatgttcttctctacataaaatatttagctgaatttcaataatgtttttaagttgaaatttatttttcaatagttaagaaaattgttttttaacaattaatttgattgttaaaactaaataataaattttagaaaacattattactgactattatgtgacagttattgggaataatttgttataaaagacagataggtaaaaaataatctgcttcaactgtcagatatgctaggtacgcccttagagatggggtagtatttatgaagatctagtgagttcagtgcctgctgacataatcagtggtaataaggtaatacaagcacaggatggccaaaccaagaatgaagcttgattctgagctttatgaactggcatcgtcctacgttttctgggtctgaactggcctcaaagtgaagccagggctgaagccacagaagaaaatacataagtaaattttactagagttagggaatagaaacaaacgacgaacagacttactgttgatggcagccactagaagaaaaacacatagatgctacccaagtaattgctgcgggattgggaaacgcatgagactatggtaaagcagctccaaggccctgaactaaaactgcaggaagtgcaatagagaggcaacccacggggtgaggggccacactaaatgggcaggctctattatagcccaatagaccgaataggacctggtgataaataggaacgaagcaggccgcacagagagagcctggacgagtttcaaactggaacgtgtatgtcctatctaaggaggcagtcgcgactcggctctggccagttaccgtcatggcagagtattggcccagataagcagatcttcccatttttcaagcagagtcaaaaatctggactttttattaagatctctatttatttttctcttctttttaggaactaattcacattttttaaatattgcaagagtcattactatttaggccaaaataaatacctgtagatttaatgtagcccctgagccaccattttgtctcctctgagccagagccttaacctgttccagttgaatctgttggtcgctctccataccagtcataagatagttttcatgctttaggctattaggtttaataatcataagaagagtaggccaggcatggtggctcacgtctgtaatcccagcactttgggaggctgaaacaggaggattgcttgaggccaggcattcaagaccagcctggttaacaaagcaagaccctgtctctaaaaaaagcaaagaaaagtagaagcattcctgaatattacagacagtaacagaatggctatcacaacagtcacagcttgcagacaccaagctcctcagaaaatattctactaataataatagttgtcattgggctagtcactgagtgccaggcattgtgctatacattttgcattcacgatctcgttgagtccttacagtagctctatgaaatggatacttgtgtctgcatttacagataaagaaacttagcaaagttttataattttcccacgttcagttgtacagtcaggacttcaatcaaagcctctcttgaactgagcctaaattgccgatggtgaggggactctgttagctaaactgaggaaccacaggcagggtggccttgaatttcaggctgaaggacccatcacccaagagtcttggcagcttcctcagcaaagatgaatgggcttgttaggtggtttttgttacctgatcagtaattgtttcaacactagagtttgtcgttactgttgtcctgttatgaagaattctctttaacaaaactcatgggaaaagggactgactcatgtgcagtttggcctgaagcatttgcgtcagtattctgctcctggaagagtatactttgacttatgcattgcttgcttaatagaccacaaaagtcaacatccctctggaagaacagctcgtgcttggaggcgtcacaagctccaaaagatcctgttaaggcaggatgtagtgtgaaacccacaagcgaagcaaaaccccgtgtcccctaattataatgttaatatttaagaaagcttcagaggctgcctctgtgctttatgcctaaaaaggagttgggattttttttcccccttttgcttttcagacctggaatcgcatcaatattttttttcaacaaaagaatgtgtctcttgtccccaggtatggcaagggtacaaagaagccaacttgtagaggggagagagaagaggtaactgacagagtcagagcacgttggaaagtgatacgagaacaggggcttatggttacagccctaccccctttccaaagaaggcgattagatattatttcagatagtttctcactgtgtcctaatttcattttccagcaaccctgtggcaggtccccagtttttcttggacttatgtgattagctaaactagccatgcaggtattggcattacactcacagatatgaaatccagcctgacacccaatcaggacacattcttgagtggctgtgtggccccagagtctcccactgtcttccacttatgcacagtgtatctaaatagacactggccatgttcagtccaccctaaacccttgtgtcaatagccaaagaggaatcagatttgaagccaaaataacaagcactatatataaattactaaacgcccccaaacactatggcattgtttggagatagggcatgtgtaggaatagtaggaggcacctaatcagaaattcaaaatgaacagcctcaccgaacagatgggcagagtctatggactttccttccttcaggagaggatgggccattatttaaatttatatacagtggaagccactagaaccccattctgatgattaaatctggatgatcataatatccagatgcattaaacaatgaccttctcaaatcataacggaacagagatgtcacgtggctctggccaaggacgtaagtgagttcgttcaacaggcattttagttctggtgccaggtcattggggacagagcagagatacagcctgattttcctcagcatctaccgccccgtcagacagggggcaataattcttctcccttagttaaactctgccccacaccctgtttatctgaaaaattactccagtcagattctcctacttaaatattcatgaagatgttatgaggactatatgatgtcaagtaaagggacatggcttttgtgaaattctatttaaactgttgaaatgagggtggtgtcactctctccaaactttccagttccctccaataaacctgtagaaagcagaccaccagatgtttcaaacagtttggatcccaattccacttgattcttgctccagaagctgagaacttaggagcaacttcctgtggaaaccaacattcccaccaataccaaagttttataatatgtagaaaacatgacctctaagaaatgcatgtcaagtgcagcctggggcttggggtgtccagtccagaaatctgcctttggttaaggtattagaagattagggagttactcaaattgtccttaacattgttttcatatgtgttatgggccacgcatgctccatgacttttataacttatgtactctcatagacctacaggagagtccttcttccacctcagggtttgctgatagcctagatggtagaattgcagtaaggttaaacagatgtagggcctcatattgcttctcatacaattttaagaatccttaaagtcagttttcatggtaagcaaactttaatttaaaaactttgagataggagggatcattcttcattcagttcatccaggttcaaggactccttttggttgcaactgacccgccatgctgcttcagaagaaaccctttaaaaacaaacttcctgagaagagaaaagggttacaatttaggagctttttaagaattacctttgggtttttccaagctctcctcttgagtagaaaacaggacatgtcacagatatatattttcttaattgtaaaaagtaaatactctaaaatgtatttttttcattgtgattatgttacagtggtttctatgtaccatagattagatttttattaagggttttattaaataactggtgtttcaccaacatctaattaaatcttctatctaaattgaacagaaaattatggggggaaaagaaagcatttgtagcagactttattacagataagactattatttgttcatcttaagaatttgagatcaaatttacaagcagcatcctcatcgaatttcttttctgggctgctgagccctggccccttgaaagcagcccattatctcctcacctccccccattttattatagtgtcctggttgttggcaacacgcccgctgtttaaggttactttcattaattaaccgaaagttaatttctttgcaagcaaaatctctgatctcattatgttgtctttaaagccgaaagcttcaggttttctggtctcctttgatgacacaataaaaagcatgctctttatcttaagggaaactgtctccagggtttcatttaatagtccttgaaatagttacagcacagccaggcagactacaataatatgccagttttagaaaaccttggctttgtcatggttagagagcccagtgactgatgtgagctacggtggatccatttccgaagaagttctgcactttgcctcgagtcccatttttacacacgacaccgccctccctaccgccattatggagcctatttgagaacagaccaacaccaacaccagcatccttccaaagtgcaccactgcccagccattttactctctgggattttggaaagtttgcgggggctggcattttgtctgtttgcctttactaagctatcttttgttcctctggtggaagcaaggcaacattgggtggtaccaagagtttggggtagtgcttttggagcctggcaggcctggatttgaatcccagcctttccatgtacaggttaagcatccctaatccaaaatctgaaatccgaaatgctccaaaatccaaaactttttgagcaccagcatgatgctgaaaggaaatgcccattggagcatttcagattttggattttgaattagtgatgctcagccagtgagtataatgcaaatattcccaaatctgaaaaagtctgaagtctgaaactcttcttgtcccaagcatttcagagaagggatattcaacctgtactggctctctgtccttgaacgtgttatttaacccttctgagcttcagtttcctcattagtaaactttaaatgattatgtaaagagaattaaatgagataaaacaaagtagcaggtacttgacaaatgttactccccttcctttgacagtcctgttctagtcttttccaaggacaaatgtgtttctagagatggagttcatcctgatatttgggggctggcctacgtacagattgctataccagaaggagcagtttgggggagacagtcagattccacagagcatgttttggtgtggattggatgagttaggttctgtattgccccacatgaccttttacagacatggggacttaaacagtgtattttctttgtctctctgcgttagcttcatcttcagtgatgaaatcttgttgcttcctgaagcattaaattcagtgagttgagagtggccaaaatgtcttttcagagccaccaggtgtaggtcacacagaggggacagaactcttcaggtggctcaagtctcaggagcaatctagatacagggagaagccatttgtatcccactgagtcctgtgatgctgcacacacacagctgagatttacagaggccgggcggggagggctgctgagagggggtaatggcatgacctgccatgctgcttcagatgcctgggagactgggtctgtgccatttgcatatgtcctctgtacccattcctgatgaaggatgcaattgactcaactcaagcaggtcaaaatcacttaggcagaaaatcccaggccttgggaagaaaagtcatgtgcctcttgggcccttggcagaagtcaaaggtccaaggtaatgtattggcaaagatcctgtctgctttggtgccttacttactgctccctaatgcttttaggtggaaatattgtcaacgctattgattagttgatctgataatccagcaggctccctgatgtgttaaatttcctacttttggaggactataagtatgggcagagtgtatacttctgtaggaaagaactctcagtggaccttgctaagacactgcttctacagcgagattgctacaggcatgacaattccaattattcttttggctgtgacatttaacccttcccaagacaaattttctatagttatccattttttccagccttcctttagattttggaaaaacactttgtcttctgcattgggcctgtagggtctcttgatttattagcatggtttacctgtacgtttttagatttttattttttagtttattatgagtacattccattatctagatctttccctccttcacatgccctccatggccaaaatcatatttgcctttctccttgtcttttaccatctttaaacattccatcagccatgtccctcatttttaaagtatatagcaacttcatgaaggatatataattcataatgtgtagatatcaaaagaaaaggtgaccttaggccaaggcagtggaattttctgtaagtaaggagcatagagatgatatataaacatagtgatgacaaataagcattgaagtttgtttgcagattgtttgtttagagcttggtctggaatagcaagaaacctacataccctccgactcgtctcgctgtagttgttggttattcaccgcaccctctctctggcttcagtctccaagcccttcagccttgttgaaagggtctagaggtacccttgcacatccaaaggccacttggacaaatgatgccttcagcttttggggtccacagtgccatttcttctacatcccagcttactatgcttgacttcagttatattccccagtaccaagaacgcaggaggactactttaatcccctttgcaaaataacaacaacaataaggcctccaggcagagcacattgagcctaattcagattttttttaaagtggaaaacaaatcataaatacctgagaaatcaggttcataatggaagccccacgaaaccccttaacctgggcaaaatcctataacacaattatataaaatttcacacctgactgaagctgttattggaacaaaaataaccatttttctgctcgtgctaaatgaaccacaagacccatgtatccagccacagaaaaacacaagattgcccattccatctgcatataatcagcatacttgctggcaagggcactgcaggatcaaaagagttaataattggatcctgcccacagcaaccacacaattaaggacaagattagcagagatgaggaatttatggtgaaaatgcaatgatagtctgaaaaacaaaatgatttcaccgagcagttgttctgttgccataatcctaatgatcaactctattacaccaataataggagaaaaactaattgcagtgaggacaggacaaatctttttaaatctgcattgtcttcccaactaagtcccaacccatttgtattaacctttgctgacagagtcacatgatggacataatttcttataatttaccagctatggatctaacctttcttcatcaaatattcataaaggcaggattctcaatgattttctgtctctcttcaatttagagcttgttgtcttctttcttacagtaatttggacacaattgaagtcaaatggaattaaagttaaatgcctttagcaactgaggtgcctaaaagcaaacacttaggggaggggtcgtgaactgaacggggagagcttgtattcccaagaccctccacgtcccaaaggagttcagtgggctgccggcccccataaggaaaaagcaaactcagccagagaatgagatgccattgctttctcttggacttgcttgggcctcttgtgctgggtgctctgtagctgagttaaaactgagagcccaaggccttcccctgtcttcaaggcttgccaggaacttaggctgccatgaccaggccctgtttgagcatgtgtgcccagcagggtgcaaggaacatgccaggggctagaatagtggacaagaaaagttggttggtacagttacttagaaaacaagcgtgaacacctaaaaccattcctgaaagcgtttttggtttctagaaaaacatctgtttccactttgcatctttgttgctttgacacttttcttaacagggatgtagataggaaaaagtcttctaaagcttagatgtttaaaataagtatagtaaatggtcctttactcttcccgtcgcaaggcttcagttttactgggatggcagaagtttggggaaggtgagatagacaatcaaaagaactccctttttctactccaatcctcagacagccctacctttactacaatggcaaggaatgttgtaaattctccctcaagatgcaaaggaggccaagcacagtggctcacacctgtaatcccggcattttgggaggccagagaggaaagatcactgaaccaacaagttcgagaccagcctggaaaacatagcaagaccccatctctacaaaaaatttaaaaattagctggatgtggtggcatgctcctgtagtcctagctactcaggaggctgaggcaggaggattgcttgagccctggagttcacagtgagctatgatcacgccactgcactccagcctgggaaaccgagtgagaccctatctctaaaaagacaaagaaatttacaaaaacaagatgcaaagaaattgtttcacctagttgacttcaaagtactgtattgaccaagccaagaatttacttcttgctaagttcccagaattttattagaaaggaaatgagaattgaaggcagttgtaatctttaacagctgattcatgtctgcagctaaggtatttagttctagtcaccaccatttttagcatctttatcaatttttaactgtacaagtaatgcacaatacattcactttgtaaaaattaaaactttatagataagggtaaagtcttttgaccactgcttccaaacatagaccttcttgcccttccaaatattcttctatgcatttacagacatacatgtatccaacgacaaacatatgttttccttatttgttttacataagtggttattatgccatacaaatcaatacccacattgcgtttttactcaataatatgccttatgtttagaaatctttccatgttagaacatatcaatctattctttcagagaagtccatatactgtaatttagtatcattccttcagtgatggattttgcttccaggttttcagattataagcaattctgcaaaatgtcattatctggttggaactaagttcatataattgtcttaatggcatgcttaactagcttttgcaagtacagttttcttcagtatgtttctactgacctgatcattcaaaacactcttttaatgttttctaccaagccacacctccttcttgatggtaaggacaaaaacaactatgagatatttcgtattttgaatgccccacaaataaacagatattccaaatacggcagtgaattaaatgttttcaatagggggaaaatgagaatctcctgtcagaaatgcccaaggaaaggttgttatgaaaggaaaacatcattatggcaagtttcttgttacacaaattcggttatacagatcagaccatgtcccttgaactaccactgcacactgggaaaattcattcattcatagtagcgtccttccacacagtattcagttttccatttaccttgtttgctaacacccacgttataaagagttgtcactgattacataaaggatggtttgccaatcaggatatgcatacatggcctcgataaccatccttcagtccaatataaatctcttacaaatccaataggagatggcaggaagttcttttgaagaatgagaaaatttttccaggaaggtttgagggcgaattccgtgagaagtttttcaccagggatctcaggtactgtcattcctctggacaggaattgagtaggtgctgagatactcaccagttaattgcctttgggttagtggaagaagtaagtcacctagccagatcttatgcatttgcacaagtagagaatggaaacttccaatctgagtgagtttaattaaagattctagaatatttttaaaacagttcacactaattacttttagtttagggaataactcaaagttgggttaattgtgttgtcagttagtgaaaaccaacaactgacttgagaatggcagagatagggaaacagtccttccagagtgtaagagatactggatatctcatattccttcagctccaatttgtgctgttaattggctcagtctttcattctatactgagcactcatatctgcatcttataaaaagggaagttgggagacacggttaagagttaatggaaaaaacagataaattggacttcatcagaattacaaactcttatgcatcaagaatgctaccaaggtgaaaaaaatagcgtatagaatggaagaaaatattgcaaatcatataatctgataaaagtttaatgtccagagtatgtaaagagtgcctaaaactcaataacaggaagacaatctaatttttaaaatgagcgaaggatttcattagacatttctccaaagaagatatataaatggcaaataaatacatgaaaagatccttaacatcattagtcaatagagaaatgcaaatcgaaacctcaaggagagattacttcacacctactgggatggcaattaaaaaaaaaaaaagaaaagaaaataacaaggcaagcatgtggagaaatggggctcctccattattggtgggagcgcaaaatggtgcagcacctttcaaaaacagtttgatgggtcctcaaaaaaattacacatagaattaccatgtgacccagcaattccactcctagatgtatacacaaaagaattgaaagcagggactcaaacagatactgtgcatcagtgttcattgtagcattattcacagtgttctaaaggtggaaacaacccacatatccatcaacagaggaatggataaacaaaatgtgttatatgcatacagtggaatattattcagccattctaaggaatgaaattgaaacacgggccacagtatgaatgaaccttgaaaatattatgctacgtgaaataagccaaacacaaaggacaaatattgtatgatttaacttacatagaatatctagaataggcagatccatggagacaaagtagatgataggttaccaggggctgggagaagggaaatggggagtttgttgcctaacacgtacagcatttctgtttggtgtaatggcaaagttttagaaatagatagtggtgatggttgcacaacattgtaagtgtaaatgtgataattccactgaaccgtatacttaaaaatgattcaaatggcatatttttgttatatatattttgtcataaaaaaagttaatggaaccatatacagaattaaagcatgtcatcgacagttacaaaggcatccaatgaaagatctcataatatggaaaacgctatttcagttatgcattgcaatgtaacaaatcaccccgaaatgtagtgagttaaaacaaccacagtttattattcctcatctaagactccggccttctggggttgactagggctcagctggacaggtggttcttctgctgggttcactgagggtcttacccgtgactatagtcagggagcagctgggaccaaaaagctggttctgctgtgactctgagatttctgggcctctctttctccttgtagtctcagggcctctttctctccaagtggcctttccatgtgggctctccagcagggcagccatgctccttacatggcggctcaagacacctaagaatacaaaagcagaaactgccaggcttttttaaggaaatggcccagagtcacctgtgccgtgatctgttgttgaaagcaagtcacagaaagggccagtccaggttgaatgcaggagtgagtgctggaggtgtggtccgttggaggccatgtttggaggctagttaccacaaacaccatggacatatgcatggaacaagtgagagcaaaatcctcatgaaacattataggaaaccaacagataatatctaaaattaatcgatcaagaaatggtatgccggtacagtggctcacacctgtaatcccaggactttgggaggccaagacagaaggattgcttgaggccaggattcaagaccagcctgagcaacacagtgggactctgtctctacaaaaataaaataagccggaaatggtggtgaacacctgtagtcctagcaactcaggaggctgagttgggaggatcacttgagcttaggagttcaaggctgcagtgagctgtgatcacaccactgtgcactccagcctggtgacagagagagaccctgtgtcttaaaaagcaaacaaagaaatcagggtacatgcatattagttagagatacagaaggtaactaccatatgaaacaaatctgcgggttggatggatggagtggaacagtcttgctttttcgttgtgaacccttctacgtcattggatgtaaacctgtgagtgggccatgtttccatcatattataggggagtgatttggagcatgggctctggaaccagactgcctgggttcacatcttggctacctcactcacaatctttgtgaccttgggcaaattacataaccactcagtgcctcactgtttgcatctgtaaggtagggataataatcatagcaacctgatggggttactgggattattacatgagtaaagcacttacagtgccatctggcacatagtagatgctcagaaaatgttggcaattaacaattacaacattagaaaaaagaaaaagggctgggcactatagcttatgcctgtaatcccagcactttgggaagccaaggtgggaggatcccttgaggccaggagtttgggaccagcctgggcagcatagtgagacactgtctctacaaaaagtaataaaaaaacaattatctgggcatgatggcacatgcctgttgtcccagctacttggggggctgagttgggatgatcacttgagcctgagaggtcaagtctgcagtgcaccatgattgtgccactggactccagcttgggcaacagagtaagaccctgtctcaaaacaaaacaaaacattaagaggaaaagggaaaatttgcaggcaggcccatagtgaactaaggatctcaagacctggattctagtctcctgactttgacacaaatgggttgagcagtctattaaacttgcctttaaactgaggggggtaggagagaagataagaacctcccaagaacagagtctctaccaaatctgaagtctaaaagagcaagtcatggctgtccaaaattaccttgctgaaaaatgagaattccttctctttgaggaaagatctctagattctttacagttgaacctgttccttcatcctcacactgtacccaccatggagaaataattcacagacccactcgctgcctccccaaaagacctttctcctgggaaagaactttataaatcactttaagttagcaaccgtaattcccagacgcttacatgagacccactgaaaaaggacgttaacttggaaccagttaaattgcttctagtctttatttgctggcctcctgtacatctctctcttgcagaaggctattcacgtgatcaaccctaggtgagactgtaaggaagtttacctctgcttctcacccagggactgcagaggtcatgggattctcccttcttcacaccaggaagcagcaaggaagcagcatgctctatccaagaggtggcttaaactattatcctccttagaggtagttgcattgtaaaaatacctttccctcctttccccatacatttgaacaaaataaattaatggtagacttcctggcattagttgaaagccagagcaagagtgttcctggagggacaggaacactgtcctgggacccatccattcatgccacacaggcaggccacttgctgatggcacttacgcatccaaccctggccccggaacttactggcggatgcctttgggcactaggacctttgcgagtcagtctcctgctagaaagaacagtttaaattaggaatagcaagttctccaagtctcacagtctcgcccgagctaacctatcagctagcgcggcagaaaacgcataatggagcctccgtaaagtattctgtgccaactcccaggtggtctcagctgcagaactgttcttccaaaaagtgtaaattctaacttagcagtctgctgagaagcccagctccctggcaggccgggcacggggcaggaggtcacagcagctaatcaagtccttgctgtgttctcctgactcaccgccgagctctggcccagtcccagctgaccccactcctgtaatgctcagtgaggagccgaacttctccattaatcggcctgtttgcaggagctggaaaggtgacttgtaacaggcctcttgttcccagactcctctataatgacattctgcacaagcagatgtcgtcctttgattccttatgaccttctgaattttggcaaatgagaaagcatctgggatccgcagtgagggcctaagggtgtcttttctacaaagagctactgtcgtcctccaccccaccctgcctttgcccccatctctaccaggcacgtggcaaggacatggccttgcttattttccctgttggaaaaagccttcttcccagagccagggggctttgagatgaggtggcccagactgtcccatgcttgagcatttaccagacgtgactttgggtccctgtggctgtctcagtttgacagatgagaaaatgctgttgctaagggcccttcccaaggtcaccccacaagcaaacattggtgctgggagaatgagatcacccccagacagtgaaggaatgacagacccacgctttcaaagccccgaaatgtgacactccaccagcccgttgaccagagactacaagacagtaagtaataaatagataatggcctgtctctcctcttgctttctccttaaagatgcccaggtgggaaacttgtggttgtgatgattaattaataagtccgcccagttaacctgaagtttgcaggccatactgcaagcctaaggcggtctctttggcaactcatccttcttttccgaggctccagtgggctttattcagtggcggcattgctagcagcaccgcaaaaacttcagtcggaggacttcagaatttggcctgctctctattgaactacgatgttttaaaactcctttctaaccaagtcatttcagaagcaaaccttgcactgactcagaaggcctgttcagtcttccgtggctctcagcatataggattaccctccttcctcagcctgaattcacggcaccaaaaagaaaaagaacagcataaattggatgtgtgttgagttctgaagatacacatcaggtggacttgggaatccagggaggctttggcgtgattccttcttttctattccagcgcaaaggcgaacaatacatcaaagccttgaaggataaggtttacagccttccctccctcccagccccagagctggagtggcctaggacgccaccgaagaggcgtaagatattttgcttcatcaaacgaatactgtgtgtaggtagagcatagaagtttagtctcatgagatgactccattcctaagggaatctagaggctttctgcggagcaccgtgacatagatcatatcatcctcctgcttaaaaccctccggcggttccccatctcacttagagtaaaatccagtctccacagtggcttccaagagctcagacttcactgaccccatcctctccatcccctctctttgcccccttcctccagccacagttgcccccttgctgtcccctgggcatgcctaactcttttttctttcttttttggcagagacagagtctcgctatgttaccaaaggtggtttcaaactcctaagctcaagcaatcctcccactgcagcctcccaagtagctgaaactgtagacttatgccactgtgcctggctaatttatttattttttgtagagacagagtctcactctgttgcccaggctggtctagaactcctgaccttaagggagccttctgccttggcctcccaaagtgttgggattacaggcgtgagccactgcgcccagccctaatgcctaactcattctcacttacaatacccttccccaggacaagcgtccatcacaaccaccccagcctagtctcttccctcagcctctctattcactcttttttttttttcatttctctgcttgatttgctccagaacacttatctctagcagaaattatcttgatatttatttgcttacattgtgtggcaggcagagaatgttagcttttcatcctgtctcactttttgcttcttccttgaagtcttggttttgacagggaaagggagcaacgtccagctaaaatctcacacttcccagtgactaagttctaatcagtgagatccagatggagggggttacttgtcctcctttcaaagaggaggtaaggggatattatagccctctgtcttttctgctgccccccgcctgggactcagatatggtggttggagtgtcctggccccaaaggtgacttcgcagatggcagccatgtgctaaggatgacagagcagaaaggtggatggaacagcctgggttgcagacgtccatggtctgcttctgtgtgatggtccttagacttctttaatgtgaaataaaaataagctcccatctactttgaccactgttatttccagtcccccttgctagcagctgaatacagtttataaccgatacatgtgtttattacctgactttcctgctagcatgtaagcgccacaaaacctgggacttggtgtagttctctactggatctctagatcctggcacctagtaaatatttgttgaatgaatggatactaaaagcacaaaagtcacagaagtccttctgcccatatcctggctttatcagtggacacttagcaagcatcttcttgatcactgacccagcggcatagatatttatgtgggacaaagcaatgttagtttccaaatgttagctgtagaaagagtgtcattcatttcctaggtgtacaaaatgcagacttgctttggatttaaggccaggacactatgacatctttggagttcaggggcttgttaacatgacaatcctgatgctgcagtggcctggacttcttccctttctacaaaacagctgcaccaacatataattgtgctcctgtcataaaacatccataggcaaatggagcagtttattatctgtaaccttggaatgaagcggcagcttaaagactccataggttctttggcgagagtgaaatagcgcccaggaagtactggagtcaatgacacatatcgctcagaggattagaacttgcctgcaaaaatagcttttgaatcagagtttaagagtgagtggcagtaatcccaattttaccaagttcagtttagttgaaaagtgttggactagtgagtgacctaagtttcagccccaattaatatgacttgttatttatgtggttgtgtgacctggaacaatgctttcacttaagggcactaatccctttcataagggtaccaccctcatgacctaattacctcccaaaggccgaccttcagatactgtcacattagaggctaggagtttaagatatgacttttaggaggacacagacatttagtccgtaacagatgattgtcactgcttcaagtggtgtcagctgtgttgtcctagggctggaggccccaagatggactcatctgttaaggccttggcactagctgtggcctcattttcaaactgggattacacctttctttgctgccctagtagtgaggatcacatgggataatgcatatggacgtaagccatactgtttatatatataactacagtttttttagagatgggaagacctttagggattgtctaactcaagccctcattgtacagatctaagtaatgatggccagaaagtcacagttttgcccaagatcctagggtaaagtagtggcagaactgggtctttaactctcagaccagtgctctccctactataccatctggcttgttaggttgttagcttgctctttttttgttttttttttgttgttgttgttgtgttgtttttggtgacagggtctggctctgttgcccaggctggagtgcagtggtgtgattactgctcactgcaacctcgaccttctgggctcaagtgatcctcctgcctcagcctcccaagtagctggtactacagggtactattacttttacatgcccagctattacttcttcttatcactgttattaacttgctgtgtagcagggaaatcagctccctgttaaggagatacaattcagatgcaagatgctttcaatcccttgtgcactccacagtatttattgctgctaccatgtgtcaaactctgctctaggctttgaggatatagcagtgagcaaaacagacagaaatccctgccttcagagagcttagctcatgtgcgtgtgcacacacagacacacacacgcacacacaaatggcatcaagtgctacagagaaaaataggacagtgaaggaagatggggagtgctagagttgggggacagggaggggagatgtttgctgtcctgagtaaggcggtcaaggaaggtctccctgattggattaaggagtgacctgaaggggtaaggggaggaagccatgtggatattttaggggaggagtgttcaagggagaaggagcagcaggttctaatatgctgagactgctcttggccccttcagggtgagcaaataagccggtctgactggagcacagtgaacaatgggatgagtgcaaggagagggcagagaatcggggtcaggaaagggtccatcatggagggccctgtggaccactgtaagaattttgactttgactcagcttttaaatcagtttaattcatcagaagactgatatgatctttataaattagcatttttcttttgacccaccattttctccctaatcctgaatttgaactgtgtcacacagttggtattagatgctactgagttccctaccctaagtgacctgttagtgaatgtttctaaagaagagaaatccagaaagacccaggaacctcatgttccaaataaggttaaaatgaacttgtgaggtgtttcttggcatccaaaaaccaattaagcaggttacacggaagtagttctaaaaacagcagttcagtggcaggagactgacaggtgagcagatggaggaatcatcaactcaaatttatttcatagcctacaactcaaatgagcattccaaagtcagaacagctggccttttattctgtaagccattgtcccttgctttgcttatctctcaggagtatgagtggattatactcactggcagtctgtctgtcggtctttgactttgcaggggaaaatcctttgtagaaaaacaggctgtttgtgtaaatcagatttttctgtaatgtctgccgcttcctgcagattgtgaagtttctagatatggcattggccttttagcttttattttcataactgtattcgttacttacatgactgctattatttactcagaatcaagttgattctgagtgaatggaattgaaccacatagtcaaaaagcacagtcttccaatttgcaagaagaaatgttttttagaatgttgtagtgcgtttaaaaatcacagccaccttggatttctaatcagaagttattctggaatctttctgaagtttgagactgtcccatgcaaacgttacttaaatttcaagcaacagggaagtcatgagatttggaaagggttatcttttctcaatcatggtcctttgtggagttctgtggtgacagaggacagcggagagaccgtattctgtggctgaaaggagggcttgatactacccggtggggattttgttccagtaattgcatcaaattggacctgctgccatgtcgtaggtatagcatgaatatcattcattaagtcatgcacctatatgccttccctcccaatggctgagtcactagcagaatatattttcttccaaagtgtttgttttcattgttgccctttaaaaataatgagttcattctattcccttgcaaggaaagttactctagactgctttgaaattgtatatcttttgttgagcacatttctgcagtggttccatagcattgtgtgctggggaacccaacccggcctctcttaaagcgtccaaccaagcggcctccgacttgatacatataatcgtccagctcatttgacctttatattgttacctttgggcaggtagaagtcatgcaagtttcgggtgaccctatcatgtgaccagagatcaaaggtcagcagctcctaaatgttcggctgtcaagatagcccattcatcactatcattatgtaactgacaagcccacaaatgaactgggggataaaattattctcagccctctacctcctgggtttacacctcagtggtgggccaagcagtctcacgtattaagtggttccaagggcctgccacagtccctgaagtagggggaggacttcaggagacctatttcatgtgccagaccctgggaagtcaccagctgcctgcctggggagccaagttgccgctctacaggactctacagcggcctgagtctggtttcctctgaaatggagctgaattgaatgttagttctttctggacccaaagacacgtatgtctcccccaccgcaacccacctttagcatctttgtggtcctttgtggcaggttaacacagtgcagtgttttcaccaactggcctgatcttaagagtcacctatgaaaatgaagattcccaggacattcacctggaaagtctgacttaggaccaggtgccattaggaaactcagtttctaacaagggcccaaatgattctcgtgatgtctgtattttggaagaatgcaaagagatttcgaatcagacaattttggcttcaaatcctgaccctatcccttgtttggctgtgaaatcatggatgggttagttaatcttctgggcctcattttcaattttgaggacaaacattttaatagaagatgtatagaatcctagcactcatctttattattgtggggtttttgtttgtttgtttgtttgagacagggtcttgctctgccacctaggctggagtgcagtggcacaatcacggctcactgtaccttcagcttcccaggctcaagtgatcctcccacctcagcctcccaactagctaggactgcagctgcccgccatcatggctgactagtctttttaaatttttcgtacagatggggtttcactatgttgcccaggctggtcttgaactcctgagcttactatctgcctgcctcagcttcccaaagtgctgggataacagacgtgagccactgtgccaagccttattggctcttttaaatgtttttattagtattcttattatccctttggtgtgagaggagatgtcatcgaaagagcattggcatgaggtacaatgtctttataatctctcccatgtcaacaaaagtctctgataaacctacaggggcggttttgagagggacaggagaaaggcagtgctgtgaggatcacacatgctcatcacatggcttgggaggtgccctggtggatcccgcacactgtagcagtaaaggggaaaaggcagggcactcctctggacccctgaagaaagcgtggagatgcctttgagctatttcatgaccataagtggccctgacttccaaaccagcaaggggctcttgcatcccttatctcctcatcttctgacctcctggaggtacgatctgagcacttttaccctcaccccatagagcctttaccataggccagaggaactgggtttttttctttctttttttttttccacttttattttaggtttaggggtatgtgtggaggtttgttacataggtaaacatgtgtcacggaagtttgaggtacagattatttcatcacccggttattaagcccagtacccaatagctatcttttctgctctccccctcctcgcacactccctgctcaagtagactccagtgtctcttgtttccttctttgtgttcataggttcttatcatttaactcccacttaaaagtgagaacatgcaggatttgttccagggttagtttgctaaggataatagcctccagctccatccacgttcccatagaagatacgatcttgttttttgttatggctgcattgtattccatggtgtatatgtggatcttgttgttttttatggctttattgtattccagggtgtgtatattttctttatttaatctttcattgataggcattcaggttgattccatgtctttgctattgtgaatagtgctgcggtgaacatttgcatgcatgtgtctttatggcagaatgatttatattcctctgagtgtatacccagtaatgggattgctgggctgaatattagttctgcttttagctctttcgggaattgctatactgctttccacaatggctggactaaatgacactgccaccaacagtgtataagtgttcccttttctccccaacctcgccagcatctgttatttttttacttttaataatagccattctgactggtgtgagatgatatctcattgtggttttgatttgcatttctctaataatcagggctattgagctttctttcatatgctagttggctgcatgtatgcttttttttgaaaagtgcctgttcgtgttctttgcccactttttaatggggttgtttttctctggtacatttgtttaagttctttatagatgctggatattagacctttgtcagatgcataatttgcaaacattttctcccattctgcaggtcatctgtttactctgttgatagtttcttttgctgtgcagaagctcttaagtttaattagatcctacttatcaacttttgcttttgaaaccctggaagacaaactaggcaatagcatcctggacataggaatggacagaaatttcatgaaaaagacaccaaaagcaatcataacaagagcaggggagctcttaaccatgatttacagtgagacactctggttccatagccaggatgatgggaaacctttaccaaaacaaatctcttcttggaatcccaagttggaactctgaatgttctatctcatgaaaaataacaatcagctgggcattgttttgcgtgcctgtaatcccagctatgtaagaggctgagaaaggaggatcacttgagtccaggaattctagaccagtctgggcaacctagagtgaccccatctcaaaacaaaacaaaaagccctgatgttcatggctatttcactttatagtattattaatattatatttcagacaaactgtaggtcatgtaggtgctgagggaaagaattgggaactgtgaaaaccattgtttatatagaagctgtcttttgagttccaaacaaatgtggagaacgtaagacattgacagcagctgggtaccgcctgcactgtctccttctccaaggcagcaggatggcatagacccacaggaaggactctctaattatgctaattggccaagatccaggcagcagagttatctatgctaaatggaagaaagatttcttgtctgtgcatggtggcttatgcttgtaatcttgaccctttgagaggccaaggcaggaggatcacttgagcccaggagtttgagaccaacctgtgcaacaaagggagatgctatctctacaaaaaacaaaaacaaaaatagccagatgtggtgatgcctgcctgtactcccacctacttgggaggctgaggatcactggagcccaggagttggaggcttcagtgagctatgactgtgccactgtgctccagcctgggtgatggagtgagaccctgtgtcgaaaaaagaaagaaagaaagagttcttgaaaaatggatggtatttatgtggctgaatggcgttatgttggtattcaaaagcacttcaggtatatttggcagtcaaagggtttttaaagcacctgaacagcctatcttatataggacttctcacctcttcccagaagcgtgaggcccaaaagtagatgtatatacaactggaagttaagccaaacccggcttctcaagtggtcatggttgaagaacactaactactaaaaaggtgtattgacccgggggaaaaaaagctgacccctagggagaagtctggcttttcctcactctctgatgtgtgttgactttactgatctggaaacattaacgtggggaacagaggcaagaggttaaaagcctttcaaagaaaaagtgaacgtgtcttttgtcaaaactcatttaggaattggtttggtttagtggttctacaataggtaaactgagttatttgacatgctgacttgataaagccacctttgtccgagtagaccgttatgatagctgtaagtatgactgggtgactatttacttgtaaagttgtccacagtgtcatgatagcagtgacaaaagtccaaaaagacacattacaaattcattgacttgttcttttcagaggatttagagtgtcaagggaaagattattataaactagactgcaaatttttttcaccactcgctataacagattatttggagcaaaatatggtgagactatgaaaaacagtgcaatggagtgtcctcttccatgaggttagattttaaatgtagcgcttaaggtaggcatcatggaggtgagaattatacatggaaatcccttcaatttgtacatcaggtactggcagggatttagataccatgttaatatgaaaaatacttatctttacaccctggaatcactctgtatggcaagacatttgccacacaaatacacattagagtgaaatgaaccctcaagatactgaattgaacagaggacattagggtcccatattggtctcacgctccctttaaagcaaaaggccattgagaggattgttgccctatgacatcattatttcctgctgatctggcaggtgggttttgcaggttcatgtggacttgatgtaacaccaatgttttctacctgaggcctctttttttttttttttttgggatggagtttcactctgtcacctaggctggagtgcagcggttcgatctcggctcgctgcaatctctgcctcccgggttcaagtgattctcctgcctcagccttctcagtagctgggattataggcgtgcaccaccacacctggataatttttatatttttagtagagacagggtttcaccacattggtcaggctggtctcgaactcctgacctcgtgatctgcccacctcagcctcccaaagtgctgggattacaggtgtgaaccaccttgcctggctcctgaggcctcttaagccttggtattggcttatgctattgcacattaggagaatgcattatcatgtagctgatgccctcaaacagactcctactcagcatttggccaagtgactgtcaactccttaaattcaacttccagaaaaaacactgacttaaagaagaggagacttttaaacactgggtattttctgatgaagctgtccatttaaactgctctagtctttagaagtgtgatgtctttcgtttttatttgcgagcgttacaagcccttctggccagcgttgcatgatcactagattgatcagcgaggttttaaaaataggacttgtatcacataagaagagggatactgaggcataattatacatttatatggtagtttacatattttagagtgcttttatatgtgttatttgattttatcttcacataacccggtaaagcagagaagcattaacttcattgtaatagttgaggaaactaagagattgagatatttttctcaaggtcacccagggaatatattaataattagagatagtttatgccctcagaagctgaacatgtatcttttatttctatagactgtagatacttatgctgtaagggcctcacagtcaaaagaatgaaaagaagaaaactaggttttgtcagtcatctgacataataatagtccttctagaaactggaggtaaaaacaacatttgcttctttcctctgaaatgatttggaatgtcctgcatatttaaatttgacaagaatagctgactagtcaatggacaggatccattttagtccaaatggaaatccatgaaaaagatggaacggagtgaaaagggcagccagccagatgtccaggggtctgacccgccctggctcacttgcacaccgttccatcaaaccttgagtaaggcagccctcactcaaactggggatccaaatacctacccctgccatctctcctagattattaggaaagtaagaagcagtgctgtggattgacattattcgggacatttaaacattgtacaaaatgtaattgttattttaattaggagttgttctcctctttcccactgaagaattccctcttaggagttcatttctgttatctcttcagtggcccatgcttggtaatatttctccatcaagttctagtctgtgtgtgtgtgtgtgtgtgtgtgtgtgtgtgtgtgtgtgtgtatgttacatttgcttattctgatgaatctttcagcagaaaccatttctcctgaaatctttatcatttcatcaagagtaatggaaatgttacctgtcctttatttgttgcaaaatttagggacaaggaagaagaccgtgtatgttttcttaaaatcaatggccagcacattactgtaaaacctattgattaaaaacacaaagtataatgttagtcatttagtctgtgaagtgatgcaataagggaagaaatttatcctttgacttttgcattaaccttttattgactgcttgcatacccataattaacacacactttagctaaagtggttaattttagcatggtgaccagtgttcactaatgtagctgcaatcccgatcttctaaatgtaagtgcagccctgggggaaatcagcgggcagtgacgcccttcatgagttacaccttggtcaggaggacctctagacaatctgctagcagccagccaatgtgacacctttcggctgcttcctgttacgtcactaggtcattcagggagaaccactcctaagtagctgagagttttaggaggtggtttatagagtgctttgagtcaaaataatgtgaatttaggaaggagagagagaaaaagtatatatataatatatatactttatatacacatataatatgtaatatagtatatattgtatataattatatgtatttattatataattattttatatattatataatattagatataattattctatatatttattatataattataataatagttatatcatataattatataataaatatataaatttataaattacatataatagttatatcattatatattatataataaatatataaaattatataattgttacaattgtatgtaatagttatataattatatattaaatatataaaatatataattgtataataataaatacatataattgtatattttaataaatatataattacatattatatatacttattatatataatttatgtatatcattatatataataattatatataataatataataaatatattattgtatataaatatataatacacgatatataatatattaaaagtatatgtacctactatattatgtatatactttatctctcttcctcctaaatttgtattataaattcacattacatattatatattatacataatatataataaagtatatagtataaaatacgtatatataaaatatttgtatttattatatttaaaatatttatatataaaataataggtatacatataaagcatatgtttacaatattttatgtgtatatacatattattttcctttgctctccttgaactgcttcatgaaaggggcagtattttctgaacagatccaagtttatttgctaacccaagaaacattttaaaaaatgggatttttccttaggataggattagagaggacaggattgaaaggggaaactgtaactttctaattgtttagctgggttcagtaggacttgggaatgacactgagaagggaatcttgttaactttctttagcaacattatccagccctagtcctgaaaattggcttattttcatgcaaaggccagtgtggatggaccagcattctcttgttttctgggcagaaatttgtcccaaatagaaatactatttgaaacaaaaccaaatgtcagtgttttcatgggttcatacccaggtattctctgcacacactacgctgtatcaaccacaacatctcagtttggagagactatctgcattcacttggctaaggcaatggatgttataaaaggcaggaaataactgacagcaaggaagcatggccggcatatcagctaggattctttacagaaaaacctaactcagacaataaagtctcatgaaactgaaacatctaagtgaagcatgactcagatactcaaacagcatcgtacaggacccaccccttgctggacggcagcaaaatgttgatggcagttccacatcacacatcctaattgttcataggccaggagaggagaaagtcttttcctttagctcccataccagtcctctgatttattctcttgattttgccccatattgggtcatgtgcctcctcttaaaccactccctgtggctaggacagcgtgatgtactgacgtagcttaagccaatcaaggctctcccctggctgtagaggtggagctagtcccacccacatcaagtcatgaagcatggggaagggacaggtaccccacaggaaaattagaatcctgttggtggaacggtgggagtaaatacaggacaacaaatttccatcacagtcagtattcctcacacatttcgtaagacaatttggggcccctttattttgcaagagactatgtagagtattgtgtgctaagaaacaatccaactttatttcctgtaaatacaaaatcagtctggaacaaccaccatttggaaggccagacgacaatgccttttatcaatcctaggtcttcaggaataactgctgatcccttctgaatctgaacattttagcctgacactggaaagttgtagcagcttgaatacataagcctcagggtcttggaatgtcaaaatgtgataggatccagccttaggtgcaatttgattcaagccagacagagctgctcctgtatccccagagcttcccctagaaggagtctgtctagaggctacgcacccagttagtatgaaggaaggagactgcccaagtataacaggcaactctctcattggcatttctcatctgccactggtacctggagtagaagtaacgatagtggtaatattattttataggtattgggcgcttgctatgtgccaggaaatgttctaaacactgcgtataattcatgtaatcttcacatcaaccccataagtaagatactattattaccgtcaccacttgacagataagaaactgaggctcagcgaggtaacaaaacctgcccaagacgtcatgcccctggagagcagcaattccggcaatcaagagaacacactctttaccaccatgctgcagtctccctgcttcccatctttggaaattaagatccaagaaggaagaatgagtgacctgagcaaaagaaatgaaaccctaaagggggacagatgtgccttccagtaattcccaaccttctctttatcagttccatagtctggcatgattctaaatcacaaaatatcatttgagttggggatgtctgtcctttttcatgggtgactacatcacctccaataacgagcgctctgctggcccctattactatcatttggaaattggcaaggaacactggacattaaagaaaaaactttaaagtaatcttgaaatttctgaatgaaggctctgaagaaacccaacaaagggttctactcctggcccagatggatgcagtgactatgtgcagcttgtctgtcagagcttgcatgcaaaggagccacttcccataccagccagtctttgtttttttcttcttcttcttcttttggaaagagtcttgctctgttgcccaggctggagtgcagtagcacaatcttggctcactgcaacctccgcctcctgggtccaagtgattctcgtgcctcagcctcccaagtagctgggatcacaggctggcactaccatgcccagctaacttttgtgttttttagtagagacagggtttcgccacattgcccaggctggtttctgactcttggcctcaagtgatctgcctgccttggcctaccagggtgcaagggattacaggtgtgagccaccacgcctggccccagccagtcctttgatgagaagaacaacagcagaaaactgtgaaacagcttcgcccaaaagaaaagccattgggattgggaagcttgtacaacacagcataagcaaacctctgcagcaggcttcgatatgtttcatactttctcaaagtacggaggcaaaacccatttgacaggtgaaaaagcatctctattgactttctacaaactttatgatattctaggtggatcgacacttatcatagccctttaatctgccagccaggataatgtgtgcacggacaatttatccactgtgagattgaaatgctcaatttggaataactttccctacccagtaaattgagcattactctaggattctgagacagagagaaagcacaattttaaaagctttgcagagttcctttgtaattagtcgcagctttccttgaatattaattttccctgcatccctttcaagtggttgagagactgtctctacaactacagagatgcaccctcagaacaacgacagcaagcggcatggtctcaaacacctatgattaagtagtctacagaacgcaccctctgttcttcagtgcagtgtgtagcttatcagtgcaaacagtttaatatttatgctaagaggattgtcaaaagcagcttctgttgctttaattcttgttttaaataaataatgagaacatttaaacacattactcttcttggggccccggggtcagctaatcttattatttatgaagtgatgtgctacataatagtacttagtgcatgttaacagacgctattatcagggccggatgcagagagctgaagatatattagaatgttatgtgtaatgtacgacggattgagtgcataggatgccggtgtagcaattaaccacactcgaaaataggtgtaaagttgaagtatgttttccccggggggatcccctcaccattaataattccccagagaagaagatgtctttcagttaggaaccctctctaccatcaggcttggaaatggggccaggatattccattctttgatctcttcatagtcagtcctacacagtcagaagacaaatagtgagcatgaccactttttaattgatttagacaaaaatggagagaaggcgggggtggagggaggcacatgtgcaatgctcccaagtgtcctcatagtgtttggttttgatccactcgttttcactgccacgtactccaggagagtcgagaaattgttcattccttaatgcaatctgtttccttctctctgatcctcattttgcagataaataaagctaaagccactgagttttcccaggtcactttttaaataagccagtctctctgagagatagatgcctgccaaggtgtaagaacgttgccccaatttttttcctgtgaggctataatttagcttcatatgataattaatttctctactattgatgaataatccattcaataaaaaccgtgatttaagtgttttccttagggactaactcttgctggcctcttaatttaattttgtgcaagtttttcccacctcttcatcagtggaaatgattattaacctctatttgcatatatccttataaatcggtctctccttggagtgcctttttctgagcacagcaagctgggacacttgtaaatctccaggatctccaaagtcaatcccggcctgtaatattgtttaatctattcttggacgttttaatgcagtaaattcaatttaatctttcccagtaatctagtaatacattgaaatcccacaaacatttaaatctgataatggcttaatcacacactttaaataacagttgagataatgaaaaaataattcaccattttaaaggcagagtaactgaatttccctgatgattggcttctacgaagccacctgagataatacaaatctgggagtcaaagcaaaggaagtcccaacaccatcagaaacagtcttccttcttataaacacctgcgttccacctgtagattcattcagtcgtcaccatgaccttcacccccgaggactgtctttggagcattggccagtgttgctccaagcttcctgtgggttggggtcttctgggggtttcctcccgtggattaatttcctatttttactcttccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgagagattttgctgtttttttccttttgcatggatgagccagcttcactgtcctgggtggggcccaggtggaattagttctcaaagtcctccaggtggagtcagggaatgtgcaacagggttggagaaatcactactttaagtgaatccgaaaggtgagatcacatttgctctaaagaaatggtgatcccagcactttgggaggctgaggcagcagatcactggaggtcaggagttcgagaccagcctggccaacacggtgaaaccccgtctctactgaaaacacaaaaattagctgggtgtggtggtgtgtgcctgtaatcccagctactcgggaggctgaggcaggcaaatcgcttggcccgggaggcggaggttgcagtgagccgagatcatgccactgcactccagcctgggccacggagcgagagaagaaagaaatggtgactttcattgatcatgtgtttgaggatttcatgtgctctccagggaggtttcaggtgggtagaaggaggtgggcaagacccaataaaaaagcagctggtgcgggcaatgacaatgaactcgtatcctgcagggtcaaaggaaggcttgcttctgctgtgaattggagaaggactttcctggaagcacaggcccagaaatcgcacccttctccccatgtgtgcggataagggaccacttccatcagcagcagccccctcctgctttcctgccagtcctccctgtggtcccaggtctcttgagaaaagtgatctaagagatccctttgcaatgaggtgctactgactgccctacctccctcccttcctcccatgaatgtttcttggtgctgaccacagcctcagcaatgaggcaagcctggggacccaagacagatctctgcctcccaggctagtggatgccctgggatatgtagtcaccaaaataggaacttaccccatagtggggaaatagacagtaagcagcaaatcaataacaagagtgttccagatggttgtaagtgccaggaagggaaccaactgggagagggacaagaggagatggtgactgaccaaggggaccttgatcaggctgtggggaagggaggtggttgggaagagcttcccaggaaaggggacggcgggcccaggcaggagagccttgggagggggtgcccaaggaaggaaaagggccctgagcctgaagccgagaagaccaggaggggagaaggggagatgtagggcagagcagacgggagccgctcgggttttattccacacaccccaggaagcatgagagggtttcaagcagcaagggcatggaagtaacttggtgagatatttttatgcattagatcatcgctctatctggattccagagggtctctgagagagcaaacagcttaatccaaaggagcggctttccaactgggaatgtccccctggctgggtgagatctcaagatggcctgcggcccctctagattgcctgcctacagagttcactctaaacagcccctcccctccacaccccagcagatccattcctgacgccctcactggcaggctccagccccacagagctttctagacataaaagagcagggtcatggcatcattggtgacacaattttagtaataagcttcaaaacccatcactccactgaatccagggatgccagaattgagagtccataggacccgtttaacggatcccacattcagtagacggttttttgtatgcttcgagggaaggaaggtattttcaaatgcaacttcttttttttttttcttgctctagttagggctgattttaccactgggcaaattgcatacatttggatccatgccacgctaaaaactgtttattttggagatctgtcagaggcaagcacatggaagacaaggggattctggtttgaaaaggcaattctcatccagacagattcagatggagaggagcggtgtggattaaaatgcgccgaagtggtaatgccgtttatcccgtttgcctttgttactctgtgattaaatggtatttttaattaagtttcattgggagccataggtatcgcggtggtgaaatcaatttgacaaccataaaggggagagacggcacaggcgtgttgtgatgattgcggctgtagggaaagccgggcagcttgcagaggatgggtgggaggaggggaagccggctaagaatgacttcctgcaagacagcaagggcacccctgggccactgctgtgtttgggaggcaggttttgggggttgtcagaaggcattcacctggttctctcgctcacctgagacacccgatagattcctggaaactccaggaaagtatctgaagatctggttctccattctctcttattaacaaggagaaccacaagtgccccccagatcccggctagaaggaccagacagctttccaccccggttcccaggcagccctgctcccatagtcctgtgtcccatcggccccatgctcccaggacagtcctaattcccacctctcagaaccttgtcagccaagttcttcctgctctctggcccaaatcctcctcctacattggaaactgagcctctctgcatcctctgctctttctatcccgctgtcattcatcagattttccaaatctttggattcctgagtggcagaagaggttttctgagtttaagttctgattctgtgtgtgattctcactctaccacctcttcaaacctttgttgtcttatctacaaaatagaatagtagtaatccatcacctaaggttgttgtgaaggttcaataagttaatgcgtatttaaaatgcctcccacagtacctgacatatactgggcttcagtgaggtactagctattattattaaccaagtttcctgtggtaacagttgtagctttgtgactgggccaaatcacttaacccctctgcgctccagtctttgtttctataatggggatgatgataatgcctagctcattggattgttctgtcccctacgatcagccatgttaagtgattcatatcatgtctggtacttaaaaatcacgccacgcatgtacattattatgatgaaaaatatgatccgtgatatcctgaccaaaatattaaagggactaaagatagctgtggcttgttcaagaagaatattgtgtcactatcccatatattatcccatttgctcttcacagcttccatttttcgctaggcggatggcatggaactttttataaatgagatattatgaaaaatgatgttttaggactctcatttctacagtgggagtaggtcacccattgcaattttggatttgcttaaaaaaattcttgccatcaccttctaatggatgatctgtgtacaacaattgtttattgactctgaatgtctaagtaccagggtcagtctatttcaaggggagggaagcattaattaacctccagcattagattcagtgattcttttccaatgatgcagttcatgactttgctcgcatttacttttcatcaatcctgaaagaattgaggtaaaatagttcctctgcacatgtgtgtcaagctaaatggataacagcagatacagatctgtttgcctgtctgcacttgcctttagacaaaattcatcaattttacaaaagccactgactaaacatggcaccaatacaaatgaagcacttctagcaggcggagattccctttgtttctgatctggtaaatgcggtagtttcctgctgagagatgggaagtgctggcctaggacagcaaggtgccctacaggtggggccaaaagggtcaagaccgttctacaggaagtttaggagaagttcaatggttccagatcctgtgtgcttcgggtaattctgaccctcttcattagtgataatggcatgaagctctttcacacagtcttttttttttttctttttttttttcagacagggtctcaccctgtcacgtaggctggagtgcagtggtgagatcacggctcactgcagcctcgacttcatgggctcaagcgattctcctgcctcagcctcctaagtagtcgggatcataggcacttgccaccacatccggctaatttttttgtagagacaggatttcaccacattacacaggctggtttcaaactccgaggctcaagtgatctgcctgcatcggcctcccaaagcgctgagattacaagcgtgagccactacgccttgccctccacacagccttgcttggtgttaaagattaaacaaagaccacaggtgatcactgtcttcgtggtgccagtttcaagggcacccttcttcccttcccagcctccgagagaaggagagagggtccacaagccagatccatccccatccacacaggtaaaaccacgactgtgcagctagcaggtggagataacatttggaaaaaggctttgtaaatgctaaagtcctactcaagtccaagggagagaaattattattattcgttttgtgaaaccaatttagtttggctgggtaatggaagaatttctacatacattcattacttctgatcaggcaagaccagtctgacacaggaacagtctatggctcactcttaaagccacagcaggctgccagggcttggagaaatagaaacctctcttgcacaagaatagtctcaatgaatcatgttaaggcctctttaggtttttcagactccatgcaccctgtggaaactgcctttcttgagtagaggtacgttcagcacttcataaaataatcttggagcctccagacacacggatggaggagcatgatttcatttgtttctttgcaaaactgctgtccccaactgaaaaacctgattatcctttcaaatagggaattcggctttccacgttggaaccagaacagttaaccttcaaacccccaaggcttgcaagagatgaatcagtttctcagacagccaaagccgtggcttataactcatccaacccagaaaactggaccgctggtcaccttccttccccctgcccccaactctgcagacagaggtttcccgttgattatgccttgattagagtcaggagagaagcaaaccaggtatataggattccattatccttccctcctctgctcccaaccagggtcacgctgagagggatctcggtgaacatgtgaacaatcaagccatgtttaccatggacgtttagttttcttttctcaaaatcaaaacagagtttagtaggcagcgtatttcatacatgccccttgatcaatggaatgatctgtcagaagccattaaagcccccattagcttgaatgcattcaaagctaaactattggatcatttaagggctgcagtgattgtttttaatataccgtacattgatttctccctgtgagcagcaacataagtttgaaactaactgtgtatgactaaggctccatttgctgtctccaaccctctgtgagaagcatggtttcacttcgaccagaaatgtctgtgtatagttttcaaagagatgcagaccctgttcgatttcccaagatttagactgggtcgggttgttatttcttttttccctgagctttctcccatttctttgtgcccattaagtgagctgtgcgtgcagaatgggagaggcatccctgccaaggacttcaagtgaaaggcggtgggagaaattgttctgaaagcatgaagcccagctgaggccaaaatcaaagtgaatttgacagccttgggccagcaaaactctgtacccagcagaaaacaatagatgtgtggctgtgtcaggggcatcctcactgggacatagcttggggagctgaaggtaccttggaagggccagatgaggaagctagccaaggccacaggccttcctttgactgccatattgccagctcttcatagtattgactcttcagtcttagccaacacacacttgttgattccttccggaatgtcagactctgctagcaacacaaggtccctgtcctcaaaatcctattcttaatcagcatttctaatttctgccctttgctcattttaatacagagcctgaggataggagagcagcgtggtgaaagaagcaatagttaccacatttgcaaaggcacataccccaaagagaagtttttaatatgtcacacccatattttatagatggggcaatggaagtccagatgggagaagttatttcaggtgaattatagaaactggatttcaagtttctgataagtattgaatttgggaaggctgtgaacattcttgagcccccctcccaagttcaccttcaacatcctaaagcaggttgaagaggaagatggttccaggtcacttacaagaacaggaacagcccctccctccaaatttgagcccagaaaggagaacctttgttactctagaaaacagtgtgtgtgctattgttttctccataggtcacaaacatccacaagatattggtgattttacatattattagagccactgaaatttatgatgcaggatattaacgtcaaagaggccaagatgcatcattcagaacactggcaggtcaagcagaaaccaccgtagtaaaattgaaagctggagtcagcaaagtatagcccacagccaaatctggcccatcccctgttcttataaagttttattggaacgcagccatgctcatcggtttatgtattatctatggctgtttccaactacagtggcagagctgaatagttgcaaaggaccatagggctatcaaagccccaaatagtcattgtctgacccttcatagaaaaattttgctgaactgtagtctagctccaaggattgttgtatcacctgtgatcgtgcctattaagcaattaacgtcatgtctagtacttagtaatgactcagcatgtatcaattacgatgataaatattatcatggcatccaaaccaaaatactcatgccaacatctctctgtacagaaacatggaaaaagagcgatgctattaaggaggaaaatggagccaggagcaaaacctaaggctatttctgaactaaagaggcctgaataaggtagtgaaaggaccagggaaagccttcccacggggatggagagccacctcctccccggctttctggttcagatgtcttgtctcaacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtgggggtgagtgtcatgctttctaaggcacagggctgactaaagggtgtcctatttataagtcagtaaaacacagcggcttcatactctgtgcttattacccagaagccccggctcttagagtttctattaagatgtacctcataaatatatacgcctcctatgtacccacaaaaattaaaaataaaaaaattgaaatcactcatttatgcttggtgttatgattgtaactaagaatcctggagtgagctggttacaaagtgagcccgactttccatggatgcaccatcctagagtgcaccgtgagcccggctttccgctgatgcacagtcccagggtgcgccgggagccccgccgtccatggaggcactgtcccagggtgtgccgtcgccctgagccccgccgtccatggaggcactgtcccagggtgtgccgtcgccctgagccccgccgtccatggaggcactgtcccagggtgtgccgtcgccctgagccccgccgtccatggaggcactgtcccacggtgcgctcctccttagaggtctctgcactctgcctttgctgcccacactctccaggagcaccttagttggatctttacttccttactgcctctcttgccacgcgaatccttgagtcacttataagacactccacgttgatcattttcatttgtcctgtttccagagtgtttatgaacacaattttacttgccaaatctggtttccatgttggactagaggaactagagggcaggacttgctggatcaaatttttacttccattttatgacatcccacaggactcataagacttcatgtcccccagattatttgatcttcaacagctgtcaatccagctaacttttatctgacacataataggtgctcaataaacatttgttagctgactatctgctaaagcaaaattgatctgatctcagcatcccctgctttaaaatctcctctagttcccccttctctttgggttctgaccacagcttgcaaggctgtttgaaatctacccccgcctcttacaatttcacctcccaaaacttgcttctaacctttgttccagctacacccaattttgtaccacatcctgagttgtttcttgtcactggtgctgtataaggtgagttgaccatgatcctagtggaaccttagcagcaggtaagaggagaaagctgataatgggcgaagctggggggaatttggtcagcgaagttagtgtctcaaagcaacacttaattggggaggtactgatatgatagacaggtgtctgagctggtgcttggggcagggcagccagtgggatctgcagaaggtcttggtgctgtcttgattaaaggggtacgaggaagcactccaaacaaggcactgcaaggccacaatgtggggacagggcccaggccagccccagagagcaaaatcacaaaagacaaactgctttggccaatggagttgagggaacgctggaagagcttggtggacatggacttggggcactggactgacgtcagatccccctgtgctactaagatagtggtgtcacttcataaacttttttttttttagacagaatctcactctgtcgcccaggctggagtgcagcgacaccatctcggctcactgcaaccttcgcctcctgagctcaagcagttctcctgcctcagcctcccgagtagctgggattacaggcgcccaccatgcccggctaattttttgtatttttaatagagacagggtttcaccatgttggccaggctggtcttgaactcccaacctcaagtgctccacccaccttggcctcccaaactgctgggattacaggcatgagccaccgcgcctggccccatcgtaaacatttaactcacgaattcagttatctgtgctcagcaaacatgcacaaaaaggcaaaaaagcataagggttccatccccaaactgcactcagggattgcacagcctagagtgtgggaagatgtgagaacagagaatctgttttctcatttgggaagctactacatggcttctaacccaagccagagacttcacgtcgtgctcaactgaagaacaaggatgttttcctgtgcctgatgaagaactatccagacaattcactgaagaggataaacaggtggcaaataagcacataaaaagattatcaacacccttagccattagggaaatgcaagttaaaaccacaatgagaaattaccacacacttctgagaatggctatcatttttctctattgagaatgcagagatgctggatcactcacacatcgcagggggagaatgtcaaatgatatcaccacttcgagaaaatcatctggcaatttcttctaaaactaaacatgcacttaccatttgacccagcaactgtactcttaggcatttgtcccaaataaatgaaacctgtatccatgcaagacctgtacatgaatgttcatagcagctttcataagagccccaaactgtaaacaacccaaatgtccttcagtgagtcattagttaaattttgatacatccatatcctgaaatactagtcggcaataaaaaaggataaactattagatggataatagagaaaaagatccagactcaaacaggtatatgctgtataattccatttacataaccttcttgaaataacaaaaacatggagctggagaacagaatcctgggtgccaaggcttagggaaaggagggagggagtgggcgtgg

SEQ ID NO: 509 - DNA, 48135 bp, Homo sapiens
tcggaggtggaggtaggtggattgtgtcagcccaggaattagggaccagccagggcaacatggcaaaaccccgtctctacaaaaaaatacagaaattagccaatcgtggtggtgcatcatgcctgtagtcccagctccatgggaagctgagatgggaggatcacttgagcctgggaagcagaggttgcagtgagctgagactgcaccactgcactccagcctggatgacagagtgagactctatctcaaaaaaaaaaaaaaaaaagcggtggtggggtgggggcttactatgggcaagccatggcttgctcttcaggaaaaaaatcattgaaaaaatagaagaaatagactaataattacacaattttaaaaagtggaagaatatcaagtgaccatacatacacaaaaaggtgggggtgggggagaaaaaaaaaactgttttcaaaaatattctgaaattttaaagctttttattagagtataatataaagacataaaagtacagaaatcgtaagtgtaaagcctgttgaatttccacaaagccaacacacatgtctaacaaacacccaaatcaagaaatagaacattcagccccacagaagccccttccagtcattacccacagcccccaaggttaaacagtattttaacttctaactccatagattagtctcaccaggagttaaacttacagattcatctacattgttgcatgtagttgtagcatgttcattttcattgctgggtagcatttcattatttattttttatttttttgagacagagtcttgctctgtcacccaggttggagtgcagtggtgggatcacaggtcactgcagccttgacctcccaggctcaagtaatccttctgcctcagcctccctagtagctaggaccacaggtgcatgccactacaccatgctaatttttgtattttttgtagagacggggtttcaccatgttgcccaggttggtctcaaactcctgggctcaagtgatcctcccacctctgccacccagagtgctgggattacagatgtgagccaccacacctggccagcattttattgtttgaatacaccataatttatccattctactgttaatgagcatgtgggtttccacttaggagctattttattttattttatttattttttttagagatggactcttgctctgtcacccaggctggggtgcagtagtgcgatctcggctcactgcaaccttcgcatccctggttcaagcaattctctggcctcagcctcccgagtagctaggactacaggtgcacgccaccatgcccggttaatttcttttgtattttttagtagagacagggtttcactgtgttgcccaggctggtctcgaactcctgagctcaggcaatctgcctgcctcggcctcccaaagtgctaggattacaggcgtgagccatcacgcctggccagagctttttttgttttgttttgagacagagtttcgctcttgttgcccaggctggaatgcaatggcgtgatctcggctcactgcaacctctacctcctgggttcaaacgattctcctacctcagcctcctgagtagctgggatcacaggtgcccaccaccatgcccggctaattttttatatttttagtagagacagggtttctccatggtggtcaggctggtctcaaactcccgacctcaagtgatccgcccacctcggcctcccaaagtgctgggattacaggcgtgagccaccgcacccgggccggagttattttaaattttactactatgaacattcttgtgcatgtctttggatgaacatgtgtacaattttttgctggataaaaacctaggactaggattgctgggtcatagagtttgcattcagctcttagctcatattaccaaatcctatgtctttttaaaacagttttattgacaggctgggcacggtggctcatgcttgtaattcaagcacctttggaggctgaggcgggtggatcacctgaggtcaggagtttgagaccagcctggccaacatggtgaaaccccatctctactaaaaatacaaaaattagctgggcgtggtggcgggtgcctataatcccagctactcgggagattgagggaggagaattgcttgaacctgggaggtggaggtaacagttagcagagatcccgccattccattccagcctgggtgacaagagtgaaactctgtctcaaaacaaaaatcaaaaacaaacaaaaaacaattttccaaaacaaaacaaaaaaacagcttttgagatataattgacatactatacaatttactcatttaaagtgtattattcagccgggtgtgtggctcaagcctatgatcccagcactttgggaggttgaatcggttcgctcacatatgtccaggagttcgagaccaggctgggtgacatggtgaaaccccatttctacccaaaatacaaaaattagccggacgtggtgctttatacctgcagtcccagctattgtggagactgaggtgggaggatcacttgagcccaggaggcggagtttgcagtgagccaagactgcactattgtgctccagcctgggctacaaagccagaccctgtctcaaaaaaaaaaaaaaaaaaagtataattctatggtatttagtgtagtcacagatatgtgcaaccatcaccacagtcaattttagaacattttcattgcctcagaagaaactctataatctttaggtatctccctctccccaacccccccattccctcagccctaaggaatcactaattgactttgtctctgtcagtttgcctattatggatacttcatataaatggaatcatacaatatgtgaccttttggcttctctcacttggcacaatgttttcaaggttcatccatattgtagcatgtatcagtatcagtactttattctttttcatagctgaataacataatatgtattattatgtgaatataccacattttgttatctttttgtctgttgatggacatttgggttgttttttaccttttggtattgtgaatagtgatgctatgaacattcatgtacaagtttttctttgaacacctgttttcagtgatttggggtttatgcctgggaatggtattgctgggtcgtatggtaatttggtttgtcttattaaagaaatgccaaactgttttccatagctgctgtaccattttacatttccaccaacaacgtatgaagattccactttttcacatcctgagcaacatttgttatttcctttttaaaaaattattgttgtgggcgcacagtggctcacacctgtaatcccaacactttgggaggctgaggcaggaggattgcttgaggccaggagtttgagaccaacctgagccacatagtaagactccatctctatttaaataaaagataaaaaataacatttaagtaaataaacaaataaaaataatatttatggccagtctaattgttgtgaagtggtatctcatggtgattttgacctgttttaatctacatttccctagtgattatgatattcagcatcttatcatagacttatctttgaagaaatgtctgttgaagcccaggcacagtgacttacacctgtaatcccagcactttgggaggccaagatgggaggattgcttgagtccaagagttccagaccagcctaggctgcatggcaaaaccccatctctacaaaaaatacaaaaattagctgggtgtggtgacatgcacctgtagtcccagctactcagggggctgaggtgggagaatctcttgagcctgggaggtggaggttgcagtgagccgagatggtgccactgcactccatcctgggtgacagagtgagactctgtctcagaaaaaaaaaaaaagtgtcctttttgttttgttttgttttgaggcagggtttcactcctgtcacccaggctggagtacaatggcacgatctcaactcagtgcagcctcgatctcctgggttcaagggatcttcctgcctcagcctccccagtagctgggactacaggcacgtgccacagcacccagctaattttttatatttttggtatatacagggtttcaccattttgcccaggcttgtcttgaactcctggactcaagcgatctgcccaccttggcctcctaaagtattgggattacaggcatgagccactgaaccctgccaagaaatgtctattgaagtcctttgcccatattttaattgagttgtttgtctttatgttgttgaagtgtttttaatatattctgggtactatataaagtactcagatcagatataagattgcaaatacttttcacattttttggactgtcttttcactcaagattgtccttttatgtacaaaactttttaatttcaatgacatccaattatctatgtttgcttttgttgctgtgctttcggtgccacatctaagaaaccatttgccaaatccaaggtatgaggatttacccctatgtttccttctaagagttttatagttttagctcttatatttgtgtctttgatccattttgagttactttttgtatgtggtgtgaggcaaggttcaaacttcattttgtgtatgtgaatatgttaaagagaatattccttcttcattgaatgatcttggcaccctagttgagatcaattggccatagatatattgatttatttctggactatcaattatgttccattgatatgtttatccttatacctaccacactgttttgattactttgtagtaagttttaaaatcgggaaatgtgtgtcctccaacattgttctttttcaagattgttttggctattctgagtcccttgcaattaattccatatgaattttaggatcatccatattcatttctgcaataaagtgctgctggaatttccatacagattgcattgaatctgtagatcaattgggaagtattgtcatcttaacaaaattaaatctttcgattcataaacacagaatgtctttacatttatttaggtcttctttcatttctttcgacaatgttttatagttttaatttttatacttcttttataaaatttattcctaagtattttattctttctgatgcttcagtaaatggaattgttttctttcttttttctttttcttttctttttttttttttaagggtctcactctatcacctaggctggagtgcagcggcgccatcaatccaccttctggcctcaagctattctcccacctcagcctcccgaggagctgggactataggcacacaccaccactgtcagttaatttttgtagagacaaagtttcaccatgttgcccaggctggtctccaactcctaggctccagcaatcctccagcctcagtctcccaaagtgttgcaattccaggtgggagccactgtgcctggccagaattgttttcttaatttcatttacaggttgtttattgcaagtgtacagaaactttatactgatcttgtattagcaatcttgctgaactcctttgttagctgtcattgttttcattgatttcttaggattttttgtatacaagatcatgccatctgcaaataaaaatagttttactttttactttccaatctggaggccttttacttctgtatcttgcctaattgccctgactagaacatccaatacaatattgaatagaagtagcaagaatgggtatgctctaatcttagtgggaaagcatccaatctttaactattaagtatgatgttaactgagggttttttatatttgccttttatcatgttgaagaagttcccttctattcctggtttgctgagtgttttttgtttgtttgttatcatgaaggggtggtaggattttgtcagatgccttttctgcatctattgagatgatcatgtgttgttttttattctaccaaaaaaatataatgcaatacttgatttttgaaagtaaaccaagcttgaattcctggaatgtatcccactgaggcagtgtatacttctttttatatgttgttggctagtattttgttgagtatgttacatccatgttcataaaagaatattggtctgtagttttcttattaggtcttattttgttggattttaatttcaaggtaaaactagcctcacagaataaactagaaagcgtttcttcctcttctatttattgaaagctttttttatagaattggtattaatttttttcaatgttttgtagaaatcactagtgaggccgtctgagacctgggcttttctttgtaagtagtttgctttttagtatatattactaatctctttatttgttatgtatctcctcagattgtctatttcttcttgagtcagttttggtatgtgtctttctaggaaattttatgtttcatctaagttatctgatttattaacatacagttgttcatagtatttctttgtgatccttttttatttctgtaagattgtaagtactgtcccatctttaatttctgattctagtaatttcgagtcttctttttttcttgatcaatctgggacaggtttgtcaattttgttgattttttcaaagagccaggatttggttttattgattttctctattgtttttctattctctatttcactaatctctgctccaatctacccagtttatgatattttggtatggcagcccaaatgaactaagacactctgtcacttgaaagacagcctgggagagtaggtatgactacaggcatggctcaggcacctaaagatatcagggcaaggatcacccaaacatccatcaaaaggaaactggttaaacccttcagtgaactacgatgcattattataaataatgaagtggatccatatatattaacaggggaaaatgcccacgctctattggtaagttaaaaaaaaaaggaagttgtagacagtgtgaaaatatagtcccatttttactttttaaacagaatatatgttagtgtacagaaaaaagttggaggaatgtgtattaaattattgacaatgagatttttggagggtttggattttgaaggggtggattacagatatacattatatatctataaagtatttgatatttgaaaaactgttatatctgcaatccaataaaataatttaaaaatttttaaagaagtggccaggcacagtggctgaagcctgtaatcccagcactttgggaggccaaggcaggagaatcacttgaggccaggagttcaagatcagcctgggcaacatagtgagactcttgtttctacaaaaaaatgaaaaattagccaggtgtggtggtatgcgcctgtagtcccagctacttgggagtccgaggcaggaggattgcttgaccaggaaagttgaggctacagtgaacagggattgcaacactgcactccagcctggatggcagagtaagaccctatctctaaaaaaaaagataaagaaacgaaggggagggaagggaagggaaagaaggggaaagaaagggagggaaggaaggaagaaagagaaagaaggaaagcaaaagagagacagtgagacagaggggaagggaaggggaggggaaggagaggggaaggagagagcaaggagaggggagaggaggggaggagagggaagggaagggaaacatagtctatggagtcgaacagatggcttttgaatcatggatctgtgaaaggaggggaaggaagggagaaaagaagaaaagagaaaggtaggaaggaaggaaaggaaaagaaaaagaaagaaagaaagagacatagtctatggagtcaaacagattgcttttgaattatgcatctgccaactaccagctgggtgatctctggtaagttgcttcgggtctctcaattttctcatcaataaaatgggggaattaataccagcctcataagaatgagctacctatctcaccagtttcatctcatctcatcatcccctcggggtgctctagtgtaggggtcagcacactactgcccttatagcagtaagggtctggtttttgtttgtttgtttgtttgttcttgagacggagtctcgctctgtcacccaggctggagtgcagtggcgcaatctcggctcactgcaagctccgcctcccgggttcacgccattctcctgcctcagcctcccgaatagctgggactacaggcgcccgccgccacgcccggctaaatttttgtacttttagtagagacagggtttcactgtgttagccaggatggtctcgatctcctgacctcgtgatccgcccgcctcgtgcctcccaaagtgctgggattacaggcgtgaaggggtctgttttcagaaaataaagttctggcggggcgcggtggctcacgcctgtagtcccagcattttgggaggccgaggtgggcggatcacgaggtcagaatatgaagaccatcctggctacacggtgaaaccctgtctctattaaaaaaaaatacaaaaaaaaaaattagctgggcgtggtgggctcctgtagtcccagctactcgggaggctgaggcaggagaatggcgtgaacctgggaggcggagcttgcagtgagctccacttgcaggcagagcttgcagatcgcgccactgcactccagcctgggcaacagagcgagactctgtctcaaaaaaaaaaaaaaaaaaaaaaagaaaagaaagttctattggaacacatccacagccatcaggatgttgtcttacacattgtctatggctgcttttgcacttcagcaacaaagttgagtaattactacaggaaccatatgacctacaaaatctgaaatatttactctctggtcctttgtaggaaaactctgccaacccctgctctaggaagaatatataggccttctttcacctcctaaaacatgacacattccttctcaccacaatacctttgaacatactgttccctttgcctagaatgacattcccacatcccatatctaatcctttcctgtcaatcctattcattctcatgaccttctcagggaagcttttgcggatcctcaaactagattaactttcttgatatacattctcttagtatccctcatagagtttattgtgatggcaattacccgaattatctgtgctcttatttctttaacatttgactgccccgatagactgcaaacccattaaaaagtctgtcttggctaggcgcggtggctcatgcctgtaatcccagcactttgggaggctgaggtgggcggatcacctgaggtcgggagttcaagaccagcctgaccaatatggagaaaccctgtctctactaaaaatacaaaattagccaggtgtggtggtgcacgcctgtaatcccagctactcaggaagctgaggcaggagaatcgcttgaactggggaggtggaggttgcggtgagctgagatcacgtcattgcactccagcctgggtgacaagagcaaaactgtctcaaaaaaaaaaaaaaaagaaaagaaaagcctgtcttgttcagtgctgaatctctagtgcctaacaaagtacctggaatgtaatggatagaagaatgtatgcatgaatgatattatctataaaaggtatttattgtctgatatatactatatgacgtatactttataacaaagagttcaactaataggtgtggaattggttaagagcacaaattccagagttggacatgctgagatgaaccccagttcttccatttaatagatgaagaaccttagacaagtcccttaacctcttttggcctgtttcccatctgtaaaatggcaataatattagtacctacttcatgaggcttgtaataaagattagatgctatatattatagttattggtgttatgaattattattattggtgcatgtcttagctggacagatattattatgagtccttcaacgttgactccaggttactcttgaatcggttactgggacagggtgagccgaggtctcctctcccactcccactctcaacccagttaaatataaattaaaccagagccatggttaagcaacattctttctttaatttccctttgcaaatggaagcccctgagctggtgcccacccccacccctaccccataccctggggacccccgatgcaaggcccccacctcaacctggtgggaaaagaggagcaccccctccctatgatggtccattaaaaaattcctagtcatttaagaaatgaggctgggaatgggagaaaggaactggaagacaaggcccaggtcaggccagtctgaagatgttggggttgtgagacccttgagaagggtttgcaagcacatccctaagctcggggccagcatggctgaaggaggagaggtgacacacagacagatagtctgattcctcaaggtcctgcctgcctggctgtactgtagatgctgacactcaccaccaccaccaccaccaccaccaccaccaccaccaccacaggcctcctgatggagaattttccagttactctgggattgggtttgctaagcatcccctctggcccctgatctggggcatccctggggtccccctgagaccaaacctgggagaaggagggactctgggaacatgcaaagtgggggagcagagaccccgccccaccccgctgctctacaggatggtggctccagctgcatctgggctccgagggtccttaacagcgatgatgaagttgttggtccttcggctgccatggacccaggataagacatctactttctccacgtggtgacccctggcttccaggaactcaatctcttcctctgtgaactcacctgaaaaccatccccgacatatacacattcagaatgtacagagcactagttcaagagtcctacagtcagacctgagtcctcatcctggctgctccaccacagagctgtatgaccttggacaaatcactttaccttgctgagcctcagtttcctcatgcataaatagggattatatgagaacatgaagttgcagggactaaaggagataatgcacacacagcactgaaccttgcatacagtaagtgatcaataatatgcagtcattcttaatattgaaaacaggacaggccgggtgcagtggctcatgcctgtaatcccagcactttgggaggctaaggtgggaggatcacttgagcccaggagtttgagactagcttgggcaatatagggagaccccatctctacagaaaatttaaaaattagctgagcgtggtggtacatgcctgtagtcccagatactcaggaggctaaggtaggaggatcgcttgaccctgggaggcacaagttgcagtaaagtaagctgagattgcaccactgcactccagtctgggcaaaagagcaaaaccctgtctccaaaaaaagaaaagaaagaaaatggaaggaaggaagggagggagggagggaggcagaaaaaagaaaaaggggctttgtgggtcttcatctccacctgccaaagtcaagctgccatcattacttgccaggatttctgcataatccactaactggtctccctgcttccagccctcccttccttccttccttactggtctccctgcttccagccctccctccctccctcccttcctttctttctttctttcttttttttgaggcggagtctcactcttgttgcccaggctggagtgcaatggcacgattttggctcacctcaacctctgcctcccaggttcaagcgattctcctgcctcagcctccccagtagctgggataacaggcttgcgccaccacacccggctaattttctattttttttttttgtagaggtgggggtttatccatgttggtcaggctggtctcgaactcctgacctcaggtgatctgcccacctcagcctcccaaagtgctaggattacaggcgtgagccaccgcgcctggccccctgcctttcttatagcctgttcaaacagcagccaaggggatccttttaaaccattagtcagaccttgtcacctcccctgctcaaagccctccaacagcttcaacggaatttagaataaaatccaaagtccttaccaaggtgcctctaagcccaacattgcttgggaccttgctacttctctaaattcctcccctcatttccttctatttctcaccttgcttaactgtattccagccacattgacctccttgctgtccctttagaaggccaaacatgtttctacttcagtgcctttgcacttactgttctttctgcctggaatgctctcctagaaagtcacactgctggcccccttactgctatccagtctttggcacctcttcaagaatttcctccaccattacctaaaacagcagtccctaccatctttaccttgtttggttttcttccaaagtacttactgctacctgtatttgtttatttatttactgtgtctccctccactagattataagctttttgaagttaggaacgttgtcttgtttgctattgatctccagtgacagggtcagtacatagtaaatattgagcagatacttactacatagatgaacaaatccccatcccattggataagttcagaccctcatcatctcttgcctgggccatatcccagctgcttctcatatttccctgacttaaattctcctcccctcaatctacctcccctaaataagacaaatcaggtcatgtgtctccccttcccaactggataatcttaaggctgacctctgtgagaagccctgtaactccacatcctaccgcttctcaataaagatctagtcttcttctttccctaataggaagacttttggtagctcttgagatgaagacccaatcttgaatagcattaaatcacttaatcgaaaatctatttcctttgtggttcactttcaatccttttgattatggcaaggaacaagtttcagtctgctctctaacgcttcctaatctccttctttaatggagaaagcagtctcagagccttccatgggcaacaatatttaactaaaaactacacatatctatttgtatagctaacaaatagatgatagctatttgtcatctatttgtggcaaatgatgtcatttttccatttgtgattatgatataaggtctatttttaaaatacatttagggccgggcatggtggctcacgcctgtaaatccagcacttcgggaggccgaggcaggcggattacttgaggtcaggagtttgagactagcctggccagcatggtgaaaccctgtctctacaaaaatgcaaaaattagctgggtgtggtggcatgtgcacctgtattctcagctactcgggaggctgaggcacgagaatcacttgaacccaggaggtggaggttgaagtgagctgagatcgcaccactgcactccagcctgggtgacagagtgagactctatctcaaaaaaataataaaatacatttaggctaaaaaggaagttcatttagagagacatgttatgtacatattggtttagatggtgtgcaaatgtggcaaaagtcacaaaggtgctgggtaaattgagaactctaggaaacaacagctagcctcctggctgctctctgagccattcattctggtttttgcctaggctgttcctcctgtccagaatgtcctttacctccacataccaaattcctactcatacttcaaagccaagctacttgtcacctcctccataaagcctccccagggcctcaggtagatgaactttcccttcaccaagcccccactccttgtacctccatcttacactaaggccctgaaggcaggactgggctgagcccaaataacttagcacagagcctcacattcaacagagaccagcagatatttgttgaacaaaattcaatttcaaggatgtggccttgtcatctatcagctgggatccaagtgtcgctggccaaccacaggatgtgattgttgaagatcgcggtctctgcttctaatgtgattcagtccaggagatatcaagagctgtgcagtaaagaatagagtctttggtatcagccaggtgtgtgtcctaattgaagttctgccacttagtggttgatctttgactagtttataacttctgtgagcctcagtttcttcctctatagaatggggataataatattgaacaggcaaggactgtgtctcaatcaattctgtattcttttggactcgtgtcatattaatacattgtctgttataataaaaactcctcaaaggtgcagatactttcctgtttataaaattcagctgtgccaaaattaagcccttttcttagaggaaagtccgtctcctcaccctaaggtccacgatccggcgcctgcctgcctctctgatctaatttcatccttgcttaccttggtctcctttttagtcctcaaactcaccaaacccactcctgccctgagttctttgtacttgctcccctgacctacaaagctctgcaccaattctttgtatagtgggctctctcttactttttttttttttttttaggagataggatctcactctgttacccaggctgtagggcagtggcgtgatcttggctcactgtaacctctgcctccctggttcaagcaattctcctgcctcagcctcccgagtagctagaaccacaggcacgtgccatgcctggctaatttaaaaaaatttttttatagagacgggggggtggaggggggtctcactatgttactgaggctgctcttgaactcttggcctcaagcgatcctctcacctcagcctgggattataggtctgagccattgcacccagtttctttctcactctttagatctcagcttaaatgccaccaaagagaagtcttccttgatcattgagtccgtcctattatatcaccctgctttgacagttggcagagcatttatttgtctcatatttctttgatgacttattttcttgtttgcctgtaaatgcagaatccccagcacctaggatgatgcctggaacacgtacgtgttcaatacaaactgttgagtaaatgaaagtttgaagaatgaacaactgtgtcttattttacaaatgagaaaactgaggctcagagttgagacatggatttcccaaggccacacaaccaggaaatggcaagactggttccaatccccagatcgttcactgctccaatagaaatttgccaaataaaaccaaacttcactggcagttggtgctggttgaggcatgggcacccttgggaggagtcctttctctacctgtccctgtgcccgccccacgaggtctctgctctgcactcactgtccacctgcaggaggttggactgcaggtccgggtgtaggcggccgcgggccaggctgtcactcaggttccggttcaaggtcaggacattcagcagaacctgtggtagccaaggtacagaaaaatcagggctgtcccaggggtgatggtccaggattcctcagctctcacccttggtccaggctccttagtcttgagaattcttacaccgggtgtcatctgagcctcctaacagccctggaagacaggcaggcctgtgatgactgtttccatttcacagagagggaaagtgaagtccagcaaggaaaatgacttactccagagtttagaggaagccagggaagatacaccactagaaccaagtctctttaatctagcccggggctcccttcttttctctctggatagggcaaggttaatagctaggagtggtctagggcacaatgtgggtgcttttaacttagtggttaggagtgtgcgtaggctctggaaccaaactgcctccctgctctttctagctgaaggtacttgacctaaagtcttaacctctctgggcttcggtttccttatctataaaatagaaataaggattctctccagaactgggaaggttaaaatggttaacacacataacacagtgcccagcacttagtacgaactctttaaatgttagctattgttattatttccattttaaagatgaagagactgaggttcagagctgttaagtgaatgctccagcatcacacagttacaaattggtagcacttgggccggaacccaggagtgtctgattccagaacttaagatcgttaactcaccacctgccaaaataggtgcctggcatatatatcaggttctcaagacattcatggagccattctgaggtgttctggagaaaagcaggcccttcctttcaaatcccaccctaaagagggctggttgtctattcagatgctgggtagaggtataatgggacttgaggttaacagaacccaggccacccagatgctaaccccacttttcaatctactgaccctgccatttcccctgcaaccgggaaagacagggagcatcagggctccattttcactaagaaactcagcgcagcccatgtccacattgcccaggatgcgcctggcacaaaacagcctcagcccatgtttgccgcatgaggaatggaaacaagccacagatatgacaggcatctgcagtctaggccacagcttggctcccggctgaaaaaggccaaccatggcgtaaacctcacctgtgtcaggccgctgaggccccgcgcagctccattggcccccagagcgaggtaggttccacagagcccctccgcgggtcggaccactgtgggcagcaggaaagagagtggccgcttccctggctgcactgaattctcctgttgttagaggacagagaccacaaggggcaggtggggtgggacaagaccgggaaagggcccctccacaacccttccaactgctctccctcttctacatcttccacaggcccagttttcctgggagactggtcccttcccagacaacagtttgctatctgtgaaatgggtagggtgcctggatgggtggggtggatgggggagtgataagtacatccactgagctatgaggctgctacgggtcacaggagaaaggaccaagccaagaaagatggcaatggggaagaacaggataaccccaccctgatcatctctatgtgtctttgccctgctggggccccagatggcggggtgtaagagtgctgatttttaactagataaaaattattaaatccttcctccttgggtccctctttggtgcccaaccatagggctgagccccatcagctcaagctcacatagtcacagaccgctagtgctggaaaatgcccaaaacatcaaataggagccaaaaccctcattgtacaggtgaagaaattgcccagagagggcaagatcttcacaaggtcacacagtaagacagtgacagaatgggacaagggttcttcagacccaccaggctccatgtcccagacttagcagggctagggatgaggtgaacctcttctttaggcttccttatactagaagattctggagaaagtagggagaaaggggcagccatgccattgcacctcctacctataggcctcagggtccccaggaaagcagggaagcaaatcctaccaggctgggtgcagagtggttagctgtccggttgggccaggagaagtccagcatctggctgttgagcaggatccccgagggggtgataaggccgctgccaaagggctggttcagggagctgggggccgaggtggggttgggtgagccctggcccatcctcacctctacccagcccccaccccctcttggttcagaggatcccttgttccaggttctgagtctgagctggcatacctaaccatggccacaatgaagtcatcaggtcccatgatcagcacctgggcagccgtgggagctccgtctagttcatagacaggcaggagtggggcaggggctgcctgggagtcattgatatggccccggaggtaggcggcctccaccttgctgaaaagacaaggggtgggagatgagcaaacaacaggctctcaatacaccccacctacctcacttttgtggtgtttgtgtaattatttgatgaaatctacctccctcactggactactaggtctatgagtgcagaagctcattaattgcacataagaaatacccagaaaatagctgttgaatgtatttaggtattatttagattcttttctggaaccaacttttatttaatgtttaaatcaagagccttttagttatctgacttcttaatcctttctatgaaagtgcctggtgcataatggatcagaaaatatttgctttgaattaacaaactggattcatttaaactaatgtttgtagtctaaagttttattaagagtttagttgggggaggattttgtatatgaggattttttttttcttcctaatgagatagagtttttctctgtcacacaggctggagtgcagtgacgctgtctcagctcactgcaacctctgcctcccaggttcaagtgattctcctgcctcagcctcccgattatctgggattacaggcacctgccaccacacctagctaattttttttagtagagacggggtttcaccatgttggccaggccggtcttgaactcctgacctcaaatgatccactcacctcggcctcccaaagtgctgggattacaggcatgagccaccacatccagtcaggatctttactttcttttagagttttttcccaaggcacagagtaagtgctcaataactatttactggatgaactggttgaatagatttcatataggtgtgtgtgtgtgtgtgtgtgtgtgtgtgtgtgtgtgtgtgttttagagcaaagtttgcattgaccttagaaacaatatgtaatgctccagacttttaaaaattcaactgaggcgggaggctgaagcaggagaattgcttgaacctgggaggcagaggttacagtgagccaagatcatgacactgcactccagcctgggcgacagagcgagactccatctcaaaaaaaaaaaaaaaaaattcaactgagggtttcttacctaataactatgtgttggattatccatagctgattagagaataagttaccaaagattacttgaagacatttattcaattttcaaccaaacaaagctttacatgtatgattttgtttagtccttaccacaaccttacaaggttgataccattattgtcaagcccccttgtagaaacagatttagagagtttaaaccacttgcccaaggctgcacagctagcgaagggtcaagctggaatttgaatgaaggcagtctcaccagagcccacaagctactactatgttatgttgctaatgaagctgtattaccaccaccttcagtatttgcttggagactgtttgtttgtttgtttttggagacaaagtctcactctgtcacccaggctggagtgcagtggcatgatctcggctcactgcaacctctgcttcccgggttcaagtgattctcctgcctcagcctcctgactagctgggactacaggcacgcgccaccacgcccggctaatttttgtatttttagtagaggcagggtttcactatgttggtcaggctggtctcaaactcttgacctcaggtgatccacccgccttggcctcccaaagtactgggattacaggcgtgagccaccgtgcctggcttttgtttggtattgagctttcttttcctactcaaaaggaggagcagatgggcttatataggtgctatgctagcctcaaaaaaatttaagagccacatgaagtaagccaactcattgtgctgataggaaaggtgaggtgcagggagaggcacccagtgtcacgttgtgagttggggttgagctgaaattgacttaggatttcaggcctttattgctataccagctgcttttctcctgaccctttccccacacccaccgctgcctctgtagcccccaggtcctgcccaagacccacctgagcatgtcatccatgctctcagtgatggtagaatcatagacgggatctcccagtctgctggccagggctaatgcaatcttcagggtctgaaaatacagcagggatatggaagaggctgccaggcccctcccagaacccacacccagtggactttcgtgtgtgagaaaacttggaggggatttagtcctgccctatggcagtacccaatctccccactcctaatatccttaaatccagggaaaggcagacgggtcagccttacctctgccacccagtgaagagcctgttctcgggataccaggctggtgagattgaagccctccaggatgttgagagcactgatgagggcagggcccgtgtgcggaggtgggggactaagaaccaggtggcctgaaaggacaggaagtgactgatggcagggtaggggtcaaggcaccttcacatcccacatcccatctccacattccaccatcacacactgagaccactgcgctgaactccctcaccagatggggaaactgaaacattgagaggcaaagagactcattcaagttcacatggcaagtcaagggcagggccaggacttgaactcagaacactggtcttcagtttcctctgccatttgagaaaactaaggctcaagagggctgtggcttgcccagagtcacactgcaggctatcagcagagcacagcagaaacaggtgaccagatgttcatattcctggcctgtcatgtgtctccttttagctctcccataggccaggatattatccatgactcctgatggtctcatccagccccaaacttcttggcagcagcaaccttctcttcctattctgttactagatgtttggacatcaaaggaataatagctgatgcataacactaacattaactcatttagtcctcactgtggctactgttatcacacatatttgataggtccagaaactgtggtacagagagacaaggggaatccagagcactcaaggtactagcattgttgagacaacccaggctgggaaggggaaatggaaaatctatattcagtgcatgctctgatcagggcaacttcctacatcatctcatcaaatccttatgggcatcctaagatgtaggcactattattatttccattttaaggagggaaccaaggctcagagtgggaagtagcttgttcaaggtaaatggcacagttggtactcaaacccaggtcttcctagctccaacgctacgcttgttcttttttcttttctgtgtgtgtgtgtgtgtgtgtgtgtgataatggtctcactctgtcacccaggctgtagtgcagtggcacaatcatgcttactgcagccttgacctcccaggctcaagcaatcctcccatctcaacctcctgagtagctaggactataggtacaccaccacgcctgggtaatttttaaattttttatagagacggtgtctcactatgttgcccaggctggtcatgaactcctgggctcaagtgatcctcctgcctcagcctcccaatgtgctggggttataggcctgagccactgcacccagctgataggctctttccattgcttcatattccactgcctctggcagaggaatcaggttggagattgaggcctggaaagttgaactcagagaaaccctttcctggggcttgatgtgatctggctctcctagaagggaaagaacctgagaatcttctgagaaatccagcacctaccaccttgggttcagtaaacatggaccccacccatgtcataagcttggttttctgggttccctgttggttttcttgagtttggccagttgttatattccctcctcgggcctcaatttctttttggcactatgaggagctgggtctatgactgtcttgaaaggttcattctactgtgaagcttggatggactttgtcttaaaaattcttaggaagtacagggcagtgacagcgctgctggggaaagggcagaggcaacacagagcccaaatcaagaaaacctatggccagaaccccaacttccaggttggaccctttgaccaggtccaccccccaatatcctaaatacttggggtaactgaccccacagctacttttcagaaggtgggctgactctggtttgcttcaacagttgactgcccaggtagctcactgccttagtttctctcctgtgaaatggagaggagtctctaggccaaaacgatgtggccatggactgggaggcttctcctgaggggggaccctgggagccgggggagaggtcacctctgtacacgccacacacaggcttctccacaagggcgctgtaattgctgaagtcctcttcggttatgacaccccctgcgtgctgagcctggagggaagagaatgagggaatgacctcccaccactgtgacatggtggttttggcctataacacgtttggatcacagacagatcagctgtttataacttctgtgccttctgcaacccccatcgtggcctttagagaccccattatccctagacacctcaggaaaaaggaagggggaaaagcactaacattgagcacctatcatgtgccaggcatcacactgggtacattccatgaatgacctccttagcttgccattcaagactttttgtgatctggccccagcctacccctcccacctcatgtcctgctgttccccagtgagctctatgcagctgcagagtgacctgcagttcctgaactcatgccttcgtgtctttgtacctgctgctctctctgcctatgtaaaaggaaggttttctacttatggcacacttgcctaggagataccaaaactgaatgctgcatctcaccacaaccaactaaagccactagaaaaccatgactttgagtgatcctagaaggactgacccttattggacataaccaagccctcattattgaccaatgaaccaatcttgtacaaaccaatgggctcattccatcctatccagtgtgctgtcaaccctaaattagcataaccactctgaatcctttccttttttgtaccttatagtacttgaaacccttgagttatctatcttcagagaattacacattgattttttttttttttttttttgaggcagggtctcattctgtcgcccaggctggaatgcagtggcacgatcatggctcactgtagcctcaaccttcccaggctcagatgatcctcctgcctcagcctcctgagtagctgggactacaggcacatgccaccacacctggctaatgtttgtatgttttgtagagatggggtctcactatgttgcccaggctggtctcaaactcctgagctcaagtgatccacccatcttggcctcccaaagtggggattacaggcatgagccaccatggcctggcccatttgaattcttgagttcctttttctggcaagttaataaactcaactttgggtttctttttatcaaagatctgatggtctttgttacaatctcctgcattccctttgccacctccaggaaagggcacacaacccaggcctggccaattggggcattcccttctgtgccacagtgattgatttgggaatagtcatgaaacctatgatgagctaataagacacaacctggaggcttttgctggaactactgggaaggaaaaatgctctttctctgggatagcttgctggaaggatggcctgatatgggctggtggggagcaggtggaaaggatctgagagtgaatccaaacaaaggaaagtagagttgagagagagagaaagagaaagagggagagcaaatcctaacacagtggattgataatctggacacagaagaatctaaagccagtaatctcctggactttccagttaagtctgtttgagtctatcgccacatccagtgcccagcatagggcttggcacagagcaggcactctgtgaatgttgaatgaataacagacctatttaattcccacaactgtatggcagagacagatataatcatccccattgctcagatgagagaaccactgagttggtctatgcatccttaccatgaacttaattttccattaggacttttgcactattaatgacagttctcacatctgttactgcctgagactgggactctttgggattggatggtaaacttctgtgtcaatctccccagtcttgatactcaacaatgaaagaggtgcttccctcagtccctagaaaacccaaaagcagggaaggattgtgagcttagggaagctgaggccgatactgggtctccaccaggcctgggagggacatgacaagcccctgcacaggctggcatcacccctgagaagcccaaaggtacctctgaatcaagacagaacacttctggctaggcatgggggctcacacctgtaatcccagcactttgggaggccaggacaggtggatctcttgaggtcaggagttcgagaccagcctggccaacatggtgaaacctcatctctactaaaaatacaaaattagctgggtgtggtggtgcacacctgtaatcccagttactcgggaggctgaggcaggagactcacttgaacctgggaggcggaggttgcagtgagccaagatcgcaccactgcactccagccagggtgacacagcaggactccgtctcataaaaaaaaaaaaaagacaacacttccatcatcccaggaggtttttcatgtcatatcccagtcagctcctcccagccccaccaaccactgatctgatttctgtcactagaggttagttttgactattctagaatttcaaatgaacataatccacagtaaataatatagaaagaaagggagggagggagggaaggaaggaaaaaatgcggacgcggatgtcctgcaatagggaccttggggcatgcccccacccgcacaacacgagcacttacctcggccaccatctccagtgtgaggttgccacctgcgtagaaggcagccgggccggaggtgccaagtacatccagcacctcagccaggtcgggccgatgcagcaacgagccaggtagtggcgggcggcccgatggcaggaacgtctcccggaagcgctcggacatgttgggtggcagctgttcagccagggcacgggctaggggcagggacgggaggctgggcagggcgggacgccaggactggaccggatgagacgcgcaatagatggggtagatgggggctgagtggcccaccctaagtgccctgacccccaggagcctgttaagtgcgaggcagggatgtctaagggcccttcccagaccccctcgtttgaggccgcctccaggtgagggtgggataaggtggggagggggtctgaggagcaaactggaagagagggcctctctggcttgggctccaaatctcaaagattctacccttctccatcaacctcatgtctctcccaaatccccaggccccactgacctagatcatgagtcacgttgaagccatcttgggccacagctgctgcaaaggccaggacttgggaccatggcagcctgggggggccggagagcagggggtggaggaggtcctgggggaatgaggaggggtccggggggaggggggttcctgggaaggagagtcctggcaagggaaggggatattaggagggggagttgggaaaggaagaatccagggaagtaggagaaggccacccaaggagagatgcaaacgggggtccctggtccccagggggagggttgttacctgccatagagctggtgagcttcatgtagccccttcaccattccgggaacccccaccaagagcccaggctgggcaaggcgggtaggcgagggagagaggagaccaggtcactggaaggggggtgctgggctgaactccgcagagccccaagccagggatggctggcacaggggagagacacaggccaagtatcccaggggagggacaagctttcccaagcaggcacccctcccatctccctgacttcctatcagcaaatgcagaaaggcctcttttagctgccgtagttgggggatttataaattaagcaaaactcttttaagagccaggacataaccagtgtagaaagacacctgtctacattggatttcaccaacccctgcctttttttttttttttttttttttttcctgttacccaggctggagtacagtggcatagtcatagctcactgtggcctccaactcctgggctcaagtcaagcgatccttggtgcatgctactgtgcctggctaatttcaaagcattttttgtagagacaaagtctcactatgtcactcaggctggtctcaaactcctggcctcaagcaatcctcctgccttggcttcccagagtgttgggattacaggtgtgagccactgtgcccaggcaaccctaccttttaaaacggtggacaaaggaccttcatttaacctattcagtttcaccccaccattactctgagctctgaagactcaggggtgtgtttggcttttgccaccgcactaagtacccatttttccaagttattcgatatcttctttttctttcagcagacagttggtttacttctggcaattcccctctaatcttccaatatatcaagggctgggaaagttatagtcaactggctcagagtgagatgtgtgagtttcattgcatcaacttcgtgacatttcagggtactcagtagccttttttcttccttcccacgtgccagataggtaagattcccagagaagtaaggttccagattttctagttcattattttatcttgggggctgcctgactctctcatagcctaagagaatcctgctcaactctttttcccactcccctggtaaatacttagcaaattaatgcttgggttagcagaagggcaatgaagagagactcccctgaactctctcttctcaccagggtccccaccttggtctcccaggatctttgcagggtctcttccctgagggcccctggtgcggactcccggaaatcaattaggtggctctcatttcgtcggatgtcatgtaccagcatcacgcccccactgggagagacacagaaggggaagtgtgatgataacatgctacccctctgtacaatgaatctgctgcccctccacccccagtggtgagagctgtaggctcagtttttcatttggggtcaggtgtctgagctccctccccagcatggattcacagactcagccaccctaagaggatgggagcaaaaccaagagggttggagacccagggtccatggacctcttctatcctgtcactggagactttaatccctgattaggaaaagcccagagactggcagaacaggatgttctgccccatgcccccaccctggaccagagctggacccctgccagcttcctgcacctgtctacttggtatgtcccttgcccctcccccaggactggattatgtaaggatagaacatgcaaaaccaaaagaggaatttctttggtacggcttggagagctggtcttacaggagccaagataggaactttgtcagcttgttccttttctgtagcttatttacgtctaagatgggggctgcaaacttaaatgcccacagccaaatgacaaactaaggcaagcaggacagagaagaggaagtggtagaaactacggcaaactggacagtgcatgcccatcatgggaagcagcttctattccacgccaggtaacttcagccatgtgagaatgcgggcccaagttgttatcggatttcccgattgttcaagagatgttggaaatctggatttttatgaaaattctcaactttttaacaaaagcaaacaaaattttaagacagttcagtgtctaaaccaaaccagtctgtgtgctgggtgttgcccatgggtggccagcttgtaacttctaagagttcttagtgcagggtgtatttttggaggacagagggtgcaaggcttttcatcagacccatagggatttatgatcctagaagttgaaatatctctgccttaattgatgacagtatacctccacctgtgcatcttaatttatggtttacaaatttctttttctagttaaaaaaaaaaaaaaaaagcttctgaaaacactttcaggttttccataaggtagctttgctcttctgactccatccagggagaagggggtgaaatttggtgtagaaagagaaaatgcaaggagttggggcccaaaagcccctctccctaagttaggagtgctgcacatgaggcctacagacctggaggcaagaagtaggcctgggggaccccgacctccactgctccttacccgcccaggccagaactgtgtggagccacgatacccaaacacaaggctgctgccaccgctgcgtccacagaagatccctgtttactgagcacctcgatgcccagtgaagtgcagcgggcagcatcggtcaccacggcaccctgctggaagatctgggaggggaaagaggacttggtgggggcaggaggagctgtccacctccctagggcacctccactagccctagaactctacgcggcatgaaggtcgaagccctgcccccttgttgccttgactctgccctcattaccccaagtgcctcctaatggatctgtccttattcttccttgttctgtctccctcatgccctggagctcctctctttgggaccttcctctcccaagtcaccaccctctctccccttctaccactcagccattccccagtttccacagttcctcaaacattaccccactccccactccccagtttcctccccctccccatttgtccccctcacctgggggtccccgaagtagatctgcatgaccagcgccacggtgacaccggtagcgaaggtgagacaggccgtgacgatgaccgtgagcccatcctggcggcaggagcactcggccgctgcggcggagaacgggtctttgcgcgtctcgcgtagcggcgacccgtcttggctgcccatctccgacgacgacgatggcagccgctgcagccgtgcagacttcaggaaggagtccgggtctgcgggcaggcagccggggtcggtctgggcatctcctatctggccctgcccaccctccaggtgggactattcagcgctttccctgccccgcccctgccacacaatccccgcactggctagcactactcacctttcctcattttcgcgtgcaccccaggacaggcggggcaacggtgcccggctaggaagagacagggacctccccagctgggcagcagggaggctggattcccgcccctccctgatacctaggccaaatttcctggcacccagggcccagggctgagaacacttcctggggggtggggtgggggttccagccctcagtggaaatcggatcctgccccagttggggcccagccttccatgcaaggaggcagctacataaacagagtggagggaccctgccttccaacctcacttcagttatcagctcactcattccttaaatatggagagccctatgctaggtgccaggggacgggaacagatagttcctgccctcatgtggttcatagagccctggaagaaaaagccaataagcaaaggagtctataattacaagttgtggcaggtgctatgaagaaaaaggaggaaatgacagaataatggtggtaggggagggaggattccttagctgcagaaatcagggaaggcctctcaggaagtgacttttaagctgaaaactaagggatgagaaggagccagctataatgtagagcaaagagtatgtgtgtggaatgttctggaaagagggaacagtggatgcaaaggccctaaagtgggaatgagcttggcacattagaaaaaaaaataaccaaggcctgggcggctctggtgtagcaggcatggggaaagagtagtaagggtggaagctaggccagatacatactgagcgcagtggctcaatcttgtaatcccagcactctggggggccgaggcgggtggatcacttgaggtcaggagtttgagaccagcctggccaacatggtgaaaccccggctccactaaaaatacaaaaattagctgggcatggtgatgtgtgcctctaattccagctacttgggaggctgaggcatgacagtcacttgaacccacaaggtggaggttgcagtgagccgagatcgcgccacagcactccagcctgggtgacagagtgagactctgtctcaaaagaaaaaaaaaaaaaaaggaagatatgtggggctctactagcctggggagaagcttgggttttaccctaaggactatgggaggtcactactcgagaggctatttttgtttgtttttgagatggagtttcgctcttgttgcccaggctggagtgcaatggcacaatcctggctcactgcaccctccgcttcctgggttcaagcgactctcttgcctcagcctctccagtagctgtgattacaggcacatgccaccatgcctgagtaattttgtatttttagtagaaacagggtttcagcatattggccaggctggtctcgaactcctgaccccaggtgatctacctgcctcagcctcccaaagtgctgggattacaggtgtgagccaccgcacccagcccactactagagagttttaagcaagaatgtgaaaccatctgttctgtgtgttattgttgttgtttgagacagggtctggctctgtcaccccagctggagtgcagtggcaccatctcagctcactgaaacctctgcctccctgcaacctctgcctcccaggctcaagccatcctcccacctcagctcagcttcctgagtagttgagactacaggcatgccccactacacctggctaatttttgtattttttgtagagatgggatttcgccatgttgcccaggctggtctcaaactcctgacctcaagtgatccactcacctcagcctcccaaagcgctgggattacaggcatgagccactgcgcccggcctgttttgtgttttaaaatgatccctctggctactgtctggagacaaactggaggacgataagagtggaggtaggagagaactgaaagctcactatttgctggtggctatggacaagtcagtcaagtcatgcacctcaccttcctcattctagtaatggaactaatccctaactggtgggataggggtacaaggattccatgaggtgatgtgcacccagtgcactgtaggtactcactccaagttatttctattccttttccaccttgaccagggctgagaccctcttccatcccatagctccctcctctgagtgttattagctgtgaacccaggtccctaaatggcctaaaggtcctaggtgtttgtgaacagtaaagaaatagtctttactttaccttgacctcatgctgtactcacaatatgttttttaaagtttattcattcaatttttttagtacctgctactatgcactaggactataacccctttaaaagtctatgtgataatattaaaaactgaccattttattgttctgtttaaaatacgtggttcactgatgccaacataataaacatctaagctccttgtggtgtttaaagaccttcatgatccacagtcccatcttttgtgtaaataagaaaccaaatatatagataaaatgatgatatatgcaagaaatgtttataaattattacagaagttactcttgggaaaggatactgaagatgggaatgagatggggtgggagtttttttggtttgaaatttttaccacttatatctatttcctttttagaaatcaatacataaaccgggagtgctcgtgcatgcctgtaagcccagctattcagaaggctgaggcaggagatcacttgagtctagaagttcaaagctgcagtatgattgcaatatgaatagccactgcactccaggctgggcaacatagatagaccctgtctctaaaaaaaattaacacatatattttgaaatgaaaaggaaaaattacagggagataggaatgggaaaggggacttttttattcttcctcactattgctttttttttttttatcatgaacatgtaatttttgtttttgtttttgtttttgagacagagtctcactctgtcgcccaggctggagtgcagtggcgcaatctcggctcactgcaacctccatctcccaggttcaagtgattctcctgcctcagtctcctgagtagctgggattacaggcacatgccaccacgcctagctaattttttatatttttagtagaggcagggtctcaccatgttggccagtctggtcttgaactcctgacctcaggtgatctgcctgcctcagcctcccaaagtgttgggattacaggcataagccaccgcaccctgctgtttttaaactttattttcaaaaaaaggttatcttctgagactctccctcacttcataatgcttgcctctaaccctcaacatcagcatcacagagtctgtaaataaaactggaattcatccaaacaaacagacgttaaacacccactgtaggcacagaactctccttggcccctagaaatgtcttgttgttgttgttgttgttgttgctgttgctgttgttgttaatagagacaaggtcttgctatgttccccaggctgttctcaaactcctgagctcaaacaatcatcccgcctcagcctcccaaagtgttgggattacaggcgtgagccacagcacccggcattagaagtttcaaaagaagtgtgggaaagggttttgaacttatatttattgatgctgactacatattaagcattttacatatattcctttattgaagtgttcccaagactttatgaaataagtcccactctcgccactttacagatgagaaaactaagaccaagaaaggtgatattgcccatctcaggtcataaaatgagtaagtgggccaggtttggtggctcacgtctgtaatctcagcactttgggaggccgaggtgggaggattgtttgagcccaggtattcaagaccagcctgggcaacatagcaagactcctgtctctacaaaaaaatttttttaattagccaggaatggtggtgtgcacctgttgtcccaactactcgaaaggctgaggtaagagcatcacttcagcctggtagttcgaggctgcagtgagccactgcccaccagcctgggcgacagggtgaaaccctatctcaaaaaatttaaagtaaaatataaaataaaataaaatgaataagtggcaggaccaagagtctgtgtaactagaaagcctccttcccattgctccacatggcatcaagagccatttctaccctcagaaaccaaccttacaagctaatttttgttgctatttcttggtacttattgctttgtttttgagagataatcttcctgccaggctggaatgcagtggcgcaatctcggctcactgcaacctccgcctttgggttcaagcatttctcatgcctcagcctcccaagaagctggaattataggcatgcaccaccatgcccagctaatttttgtatttttagtagagatggggcttcaccatgttggccatgaggctggtctcaaactcctggcctcaagcaatccgcccgccttggcctcccaaagtgttggcattacaggcgtgagccactgtgcccggccctaggtatggtttaatttgttttctccagtcagatataaggatccaggaggtaaaggtgacatgtccctatcatagctattcaagactctctactccaccagtccatcataaagttattgatttatacaataaaaatatttactgagtacctactatgtgcactgtggaacagctagggcaataacagtgttgattttactgatagggaagagcaacagcaggatactggaaaaagattaatttgcaaccagaaggaataagtcttttgggagaaagatgacaagttcaattttggttattataaatttgtgggacaccataagaagctgtctggaggcagttggcctagtagatatctaatttttaccttcagggctcatccctggtatctgcttggataccacttctcattcaattttcttttaaggaacattctctctcctctctcagccaactccctcatccctgaccaaagtatataactcagacttggccagtcagaacaggtacctctgtgcagtaacaggcaatgtgaacaaagccaggccaataagacccaaactttgttattttgctggaactactgggaaagagaaaggctcctctttctattacacttaagttgctaagttggtaggatgtaagcctgtagctgctgggggcatcttgcccctaataaaatgggaggccttctgccaatgaagcccaccaaaagaaggcagagcaaaagatggagaaaagtccattcctttttaggtaccttaatccagctatgcctgaaaccccatatccctggacttttcagttatgctacccagtaaaattctctttttggatgtagctcagttaaactgggtttataacaaaataatcctgaacaaaattgattatacaagtccagagtttaggagagtgatcttggctagaggctagggtcatccctggcttgttgtttattcccttaaggggagaatcactaaaataaataaataaataaatatatatatatataaaattttgaaacagtgtctcactctgttgcccaggctggagtacagtggtataatctcagctcactgcagcctcaaccttcagggctcaagccatctgcccacctcagcctcccgagtagctgggactacagacaggcatgcaccaccacacctggctaatttttgtattttttctagagacagggtttcaccatgttgccccggctggttctgaattcctgagctcaagcaatctgcccaccttagcctcccaaaatgctgggattacaggtgtatgccactatgcccggcagaatcaccaaagatgtctgaaccagggagtgacatgaccagaagcgatggatggattggggtggggactgggcaagagggaggaggcaggaggagtagctagaagcctataaataatattgataagagaggttggtggcttagtctacagtggtgatgacagggatgatgagtaggaatttggaagatacttaggaggggtgcagagagcacttgatcaccatttggaaatgagaagaaaaggaggagtccagcatgccattcattattgggagactgggtgactggcagtgtcattaatggagaatggcagtggaggaagagcaggtgcatggggaagggatatgatgagttcaaaatagaacatgctatagatgaggcacttgcaggacatctggagacacaggcctgggagagaaaggaacacaagggcttggagctcagaagaaagaaagtatttcccaaccttggaatgatcactgtctagctctctttcccacagagcctgatgtggggtgcctggcacttgggtttagggaatggcaggctagaggctagctgggcacaaccaaggtcctggctaagaggatggtgctgtgccactagatggtaccaccaggttgagaacacaggaggccatgtcagcctgtagtctggtccaggtgaaccgaggaagccttggggcttggaagtaggattgggagatatggcattcaaatgattacactgaaatgatggcaacacacaaacctgacacataaatttggcataaggtataaactcccagaagctcagatgactaggatctctgctggatttccatacaggggtgagggcagagcctgtattgaacttcccaaaatactccctgaggttttggaacttgctctctcctaccattctttcatcctctctcctaccattctttcatcctgagatcttctctctcatgcatttattcattcaacaattattgagtgcccaataaataaatagagatgagggttttttttgttgttgttgtttgtttgtttttttgagacagagtctcactctgttgcccaggctggagtgcaatggcgcgatcttcgctcactgcaacctctgcctcagcctcctgagtagctggggttacagacacctgccaccaggcctggctaattttttttttttgtatttttagtagagatggggttttgtcatgttggccaggctgtttttgaactcctgacctcaggtgatccacccgcctcagcatcccaaagtgctgggattacaggtgtgagccaccacaccggccagtgtattttgttttgttttttgttttttgtttctttttgagactgagtctcactctgtcacccaggctggagtgcagtggagtgatctcggctcactgtaacctctgcctccccagttcgagtgattctcctgcctcagcctcccgagtagctaggattacaggcacccaccaccatgcccagctaatttttgtatttttagtagagatggggtttcaccatgttggccaggcaggtcttgaactcctgacctcaagtgatccacccacctcaggcatgagccaccgcgcccggcctatggataaggtcttgatgctggagaaaggagagtgaacaaaacaatcatgatccctgccctcatggggcttacagacagggagtaatcagataattgcacaaataaataatcatagattttggtaaatgctaagacatttacagagggccagaagaaaacatgtcaggcagttccaatctctaggtcaagagagacaggcattctctgttgagctggaagaggaaactaaggcccaggacagggtaggtgtgcctgttgtcgcttggtgagtcagggctgtattaggaccagaagtctcactcctgactactgaataaaaggcctagcttcaggctgatatccatcatgacacatcttcccactcctctccctgctacctcctgattccactccctttggaaaataagttttgatccgcagccctgacatttgacgcccataaacctctaaactccatcttcattatctcctcacccccaccccatacagagtgcagtccagtcaggttggcaagggctgctggtcagggccagatgaccagaaagtgtagaggaggagagaatttggggctttcaggctgggagcagctagggaagggccaagccggaaaagcagcatctgccaggctggtaagagacaaggctcaagtgcaggcactgcgaggaagcgagagtgaggtagaaggatgctctaatgccaggaagtgacgtgcagggacagagggatgggggatgaaggatgaagaatggaggggaggatgaagctgggccacatggctaggaggaagagcagcagggaaggaatgcacagagagctctttgcccccaggtctcttccaatccctgtctcctccttctcttacccccacttctcacaattccagcagagggctgaggggaacacagtaaaattctggagactgcttcctagggagcagagtaccttactaataccccggccagatccatggctcagggaggggtggggtaatccacaggagagtgaaggcgttctagtccccaaggacttttgagaggtcatgcagtccatgcctccgtctcccaacacccaacagaggggaatcatattctctttacccctccctagacatgaagagattctccgcttctcccagaccctctgcttctcacaatccctggctgtggggaacttctcttaaggcacagattggatccctcttgctgcagtctctgacttggtttctcctatcctgtcctctgtggctagagaaagccctcttctgggtgatcacagcggttccttaggatctccccttcaacattccttcatcgttagttggttcttcccagaaggtaagcccaatcccttctactgcagtccctagcatcctctccgttgtcgcatcctacgcctccaaggcagaaatgcacccccttcctcaccaaataattaacagagacaagggagaagaagggagagatccaagaagatggggatgaattaaggagatggagctggaggtggatgcttgacacagaagaaggaagaccggggacttcccaaggcagggcagggacggggtcagcgggcctcaccggtgtcggggtctcccagaaaggcgtcctcgtccttgcggcccctcagcggggccgcgggcgccggctcgtcctcgggcagccgcgggaagctggtgatgctcatgtagtccactggcgagtaggcgcccagggcgctctcctggctggcctcgttctccgccgccatcctcgcccgcgccccccagcagcgcagcgcctgccggaagtggctgcggcgggggagtgggagggcggagggcggggcctgatcttcgcgacagccgggagggggcgcctctcccagccctcggccgtgtcccggtctgactcgcccccgtctgctcagcgctatcagcctgcagctggcacacaggtgcgtgtagatggacagccaggaaggcagcgcagggtcgaggggagagcgcggggcaagcgagacttcagtggctctgcactttacgcagctcagggaccaaaccccttcctccttccagcctgaatacagctagtgtcctcctcaaatcccaggcttccttttcgggccccagaccctttcactgaccgcaaatccctctcgaccccagatcctgtctctgaccccaaactcctcggaccccagacccctccttgaattccgagatcctcctcctccgattttagactcctcctccgaccttagacctctttttcgacttcagactctgtcttcacccccaaacccttttgaaaaccccagcccatgcttcatctccaggcctctttgactgcagacgcctctttggacaacagatccctcctctgacctcagatcccttcccgcaccccgacacttctgactcctctttcaaccgcattctcaaactttagtgtgtgttaggatctttgaaagcggatccccagattccactccagagatcatgattcagtaggctgggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggatgtctgggttctattctgccaccgctcaaacactgtgtaatcttgggcaagacaattagtctctctatcagtttccccatctgtgaaatggaaagaataatagtacccattttagagggttgtcatgaggattaagtaacagaatggaaagcgattagtatagggcttggcacctactcaataaatggcatcatcatcatcatcatcattgccttaatctggtagattcattccctccaaactcatccatcctctctccactccaaaattccaaccacactacagcttgtactacttctccatatccaaggatgagggaggttccttcttttacgaggtctctgttccaaactttcattgtgaagtccacaggaagagaggggggctggtgaagcctctatacacacatcctttctcttcccaaccccagaccagtctcagggatggcctgaagtgcttgaaaaatctactatatacacagcagctgcagtagcaactatagacaggagggggaagcagtgtgtcgggaacagctctggggtttgggtgtaggacttgggagagaggataggaaggagagggctactcagagctgtgtggtaagagtgcccagggagggtaacagtctatcaccaaaaagtgtacccattgtctgtgcctttccccaccccagagagttcttatctcctcagtgatgtttgtagggtctattacactaccctgaggtctaatccctctggtgggacccttccccacttgatgaggtctgcaccttctcagtgatgtccactcccacagtgtagttggcagctcctcactggagtttgagtcctctggtagggtccacgtctccttagtaaagtctatatcctctgtatctcttaggggaaatccatgtctcctcactagggtaagtgcccttcaaagccattcatgtcctattagcagggcccagggcccttcagtcagatctgagaacccccagcaacatctgtgctcccttagtggagtccatgtactgtcagtgaagtgtgtgtcccttcggtgcagtgaatatctcctttatgaaagtatctgaccccttggtggggtctatgtccaccccaagaggtctgtactccttcagtgggccctcagattcccgccctccttgggattgggcagactctcggtctcccatagagagattttttttcagcttagggtgtgcaaggtttacagtcagctgggcaaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcaggtgagagatggaggagggtcctgcctgacttctttctggggtggaggggctagagagaagctagaggtaattaagcccaggttgtggtggtggtggtgggggtttcccttggtggagtaaagagattgtgaaggaaagaagagaatgtgggccaggtgtggtggctcacgcctgtaatcctagcactttgggagcccaaggcgggcagatcacctgaggtcaggagttcaagaccagcctggacaacatggtgaaatcccatctctactaaaaatacaaaaattagctgggtgtggtggtgtgcacctgtaattccagctactcgggaggctgaggcaggagaattgcttgaatccaggaggcagaggttgcagtcagccgagattgtgccattgcactccagcctgggcgacagagcgagagactccatctcaaaacaaaaacaacaacaaaaaaagagaatgtgaatgatttttcctatttgcacagactttgatattttacaagccttagcttcaagcctgacgaggaagtaaaaccaaatctggagtcaaagaacctagctttggccctaacttggtcgttatttgctctctgactgtgcaccagttccttccctttcctgggtttgccatttgtgcaattaggaggtgggcttattacaaaaaacctgaaggtgtctcctagtcttcacttattgagtcttgtactttagatctggatggagatttgtgaaggcaaggagattgaagacatgtcctcataagagggagaaaatctgagctggttccagggtgagcagagaggaggtgctgtcgccagagcatgccctcaaggtcatgggagaagtttttccggaggacgagaatgtgggtgtggctcagagaggggggacctggagggaagggtgtcacctggaaggaactggtgatagtcaggactgtgcaatcagatcacggggcggctccgcgatggaccttactcaactcctctccttagtccatccctttccctttcgatccttgccttaacccaaccccttatctgtcactccaagaccccaccccactctggtcactccatggctctgcctcctctcctgtcacaaccagccgggttactccccatcactccatgggcccacctcctctcctgtcccgcctggccccgcccctcccttggcactccacggttccaccctctcccttgtcacacccggccccgccccttctgctttcactcgacggcgtcactccttccggcaagtcagctccacccctatccctcgacttttccttatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatggaggttctgtgaaggaagaattgcggttctttgaaaatggaaaagggattccgggaggagacgagggttccatgggagctggggagttccctgcagacttggagggtccgtggtggagatgcgggtttttgcgaggagacgcgggattccgtgagggaagaagtgaggttccttgagattgggacggggaggtcggccaagagagtgaaagtttcatgggaagagaaggggagttcctgaggcgaaaagagggtctctaaggggcgacgggagccttgaagggaggagggccacgaatagaactttctttgcttccctttcacaccagctcagccactgcctcctgagacccttaacctgtgaactgttgagggcaataacgggtctggttcccatcttggggtcctcagattagtaatggagtccccgatctatttttagtatatcggacatcctaatggaaattacgcggtataagactgaacgagttactacgatgtcaagttgttttatttatttttttaacttgggctgggattgtattagtaatagttcagaagttctgatagatggttccatgtctgttaaaatgtatgaggaaaatcggccaggagcagtggctcacgcctgtaatcccagcactttgggaggccgaggcgggcggatcacttgaggtcaggagttcgagaccagcctggccaacatggtgaaacccccgtctccactaaaaatacaaaaattagccgggtgtggtggcgggcacctgtaatcccagctactcgagaggctgagacaggagaattgcttgaacccaggaggcagaggttgcagtgagccacgatagcaccactgcactccagcctgggcgacagagcaagactttgtctcaaaaaaaaaaaaaaaaaaaaaaaaaaaaaaaggtataaggaaaatccccctacccttgccctcagtctgggtaaaggacagatagatagacagatagatagatagatagatagatagatagatagtttgttttgagacaaggtgttgctctgtcacccatgctggagtgcagtggcccgttctaggctcactatagcctgcatctcctgggctcatgcgatctttccgcttcagcctcctgggtagctgggactacaggcggacgccatgacacccagctacttttttgtattttttggagagacgaggttttgccatgttgcccaggctggtcttgaactcctggcctcaggctttcctccttacttggcctcccaaagtgctgtgattacatgtgcatgagctactgcgcctagccaaggagtcaaaattgcacccccattgggaggcagcatgatgtttggttgtgggacaaacatgggccacgaatcaaatccagaaaaatctagatttagaccctggctctgctgttcatttactgtggggtcttaggcaaatttttaagcctgtctgagattccttttcttccatctataagataggtctagtaatacttgcctaatgggtttgtatgaggtctaaagtgtgtaataagtatgcgctataacatgcctgatgcacagtacacattcaataaatagtagttagtctgatacaatataaatcaagcaattaccaagtaatgcaagacaggattcaatcaagtgtaaagtggtggagttgggatttgaaccaagacagtttgactgcagaatccatatcctaatagcaatgctattcctcttccatgaccccacagaatgcatttcaccaaattccatcaaatacagaatttctaccagggaagcagcctcctaatttgtcctctcttgcctagtttcgccaacttgagtctttccagtagatttatcaagacaccattagattgatattatggaaatatgctttcatatgtcactgcaaaaactttcaatggttccctgtttctggcagtttctaattaaaattctgcttttcttttttttttttttttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggctttcaccgtgttagccaggatggtctcgatctcctgacctcgtgatccgcccgcctcggcctcccaaagtgctgggattacaggcgtgagccaccgcgcccggcctctgcttttcttttaagacctccagataatctagctccaccctgcctctctattcttatctcccactacttgctaccactcccctcattctagatagatcattctccttgatatcctggatacacatttattcccaccttcttgcctttgttcatttccttctgcttctctctacctagtcaaactccaccacttccaatagagcattcactgatcatcccaatttatgctcacctttttcctcttctgaatatctttagtacttagaaactatgccactcatccagattctgacacacacacacacacacacacacacacacacccctaccccccccaaaaaaacccagaaaaactaagtgtgcataaaattcagttttgtagccaaacatggtgacgcacgtctgtaatcctgctactcaggaggctaaggcacgagaattgcttgaacccgggagacggagattgcagtgagccaagattgtgccactgcactccagcctgggcgacacagcgataccctgtctcaaaacaaaaacaaaaacacctcagctttcttcattctttgttgatggacataaatgtggtttataaatagttttatatactatatgcctactattatcacttgaaaatatttttgagtatttgtactctcgttattagctgcgtggtccttggcagagtttcctgtgcttcctgagcttcagttttctcatctataaaattaggataattaatgtatactttgtaagaccataatgtcataaagattaaatgagattagtccagtccctgatacatgaatggcatttactaaatactagctctcatttgctttctctttaatggccatttattattctatggtattactacttgtattactagttttcatcagtttgttattgttgggctattgggttgtttccagtttcactattatagtgttgctataaacatctctttactaatcactttttttctttgtgattattttcttgaagtctattccctatagttgagatagcagagaaaagggtataaaaagttttatgggctgggcgtggtggcccacacctataatcccagcatcctttgggagggcaaggtgggctcccaaagcttgagcttaggagtttaagaacagcctgggtaatatggccaaaccctgtttctacaaaacaaacaaacaatgtgcgcctgtagttccagctactggtgggggagggggtacagctgagatggggggatcacttgagccagggagatggaggttacagtgagctgagatcatgctactgcactccagcctgggtgacaaagagcgagacaccgagctaaaaaaataataataatagaaattaaaaaaaaaaagttttatggctcttgtcatgcattgccttgcaatctaataagactgcgccaatttcttacaatgccattattgtgtaagagtatctgttttcccagggccacccagacattgggcttaataatttttttaaatttttactagttttctaggtatataatggcaccttggggttgatttaatttggatttctttaatacattacaacgttgtacactatgtgatttagctttcaattatattctgtcttgtacattaaaaaatatttcatgtgttaatcttatctctccaactagattgtataagctctaaattgtgtaacctgaaacaaatgacttagcttctatgaattttatttcttatgaaatgaaatgagggggtgataatctgtaaggttacttccattgttacggttctaattgcttctctttcctccaaatttttttttttttttttttttttttttgagatagagtcttgttctgttgcctaggctggagtacagtggtgcaatctcaactcactgcaacctccacctcccaggttcaggcgattctcctgcctcacgctcctgagtagctaggaatacaagcacccgctaccacacctggcaattttttttttttttttgtatttttagtagagacaggatttcaccatgttggtcaggctggtctcgaactcctgatttcaggtgatccgcccgccttggcctcccaaagtgctaggattacaggagtgagccacagtgcctggcatcctctaactcttgattcagtactcagactatcctaaattctctgcattcatatgttttacctgttgagtacattttctgcagaatagccaggcagatattttaagaatgtaaatttgatcatgttacttgcttaaaacccttcaatgaattttcattgctcttgggatatataccaaattccttattatacacagaattgcatgatttgcccagtttatgcatcaattcctgctattctttcccttattctcagtgtttcagcctcaaggagttcctcctaacatatgcccttggtctctttttttcatatgggagtggagaaaaacttctattcatctttcagattttagcaaaaatgtctcaaggaagtttagatcttgacttagtaattgtgtaaccttagacaagttatttaacctctctgagccttgattttcaagtttataaaatgagaaaagcctcccttctagagttgtggtaaggattaaatgagataatacatatgaaaagcttaaagaaacatttggcacatagtgaataacacttatataagtagaagctggagaaggagatgctcaatatataattgctgagagagaatgcacgaattaagagaagaaagagttggtcatggaaggttctgtgggtgaagaattttttctttttactaattacttcattaaaaaatttactttctagttagacagatggtgaaaaaaattgtacctgatttcagcagaactcggtgtgtacctataatcccagcttcttgggaggctgaggcaggaggacagctgagtccaggagtttaagacaagcctgggcaacagcaacaaaaaattactgattgcctattttgtgctaggcattgtgctagtactaggtggctctgattttaatagatggtaaaaagtgagtaggcagtcttgaggacaggaggaagaatttgagtcaagattcagcccaagagaatagaagatgggttagaagagtgttggctgctggccgggcgcggtggctcaagcctgtaatcccagcactttgggagtccgaggcgggcggatcacgaggtcaggagttcgagaccagcctggccaacatagtgaaaccccgtctctactaaaaatacaaaaattagccaggcgtggtggcacgcgcctgtagtcccagctactcgggaggctgaggcaggagaattgcttcaaccggggaggcagaggttgtggtgagccgagatcatgccactgcactccagcctaggtgtcacagtgagcctccatctccaaaaaaaaaaaagtggtgggtgctaagattagacaggtaaagaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattcct

SEQ ID NO: 510 - DNA, 42978 bp, Homo sapiens
gcacagagcaatcacacggccacagggtaatgggcacagcagcaatcacacggccacaggataatgggcacagcagcaatcacacagccacagggtaatgggcacagaagcaatcacacggctacaggataatgggcacagagcaatcacacagccacaggataatgggcacagagcaatcacacagccacaggataatgggcacagcagcaatcacacagccacaaggtaatgggcacagcagcaatcacacggctacagggtaatgggcacagagcgatcacacggccacaggataatgggcacagagcaatcacacagccacagggtaatgggcacagcagcaatcacgcagccacagggtaacgggcacagcagcagtcacacagccacagggtaatgggcacagagcaatcacatagccacagagcaatgggcacagaaggaatcagacaagccctgccttcactctttataaacttgccttgggaacaggcttcaaacattcttctagctttcagggaaacggtccaccccacagctccttccagtcaaaaacaaggtactcatggccctagctctgtgggagaaaccagggagtagatacagaaaatactgtgctagattaagccttccttcagggaactaacgattgacacagacttaccatggaaaacatcttgggatgtttaatcagacatgggtttaaatcctagttcagccatttaaaaatgatgtgattctggccaggttcagtggctagcacttgtaatcccagctacttggggggctgaggcaggtggatccctgaggccaggagttcaagactagctggggtaacacagtgagactccccctccatctccgaaaaaaaaaaagggatgtgatcttggtcagattgcttctccaagccttccttctgcatatgtggggataatacagacttcatgttatgcctttggggatcatgtgatatataccagtcaagcccttgctagtgggttggcactgctatctcctgaccccatctccccgggacgctatgatggataaatgagatagagctacagtaagaatccagttacagagtctaattaggtgctcagtaaatgttggtttccccaaaccttttcatggttggcaagaccagaatcttgtcactattctttgcctcccccagctcagaaacatcaaaggatgtaggtctttatcaggtatgtttcctttggcccagaaactaaaacgagggtgcaaacactgctccctattcctcattcctgagtcatctcccctttcccaggagtgagagatgctactccttcctcagtctgtcatgcccccaagagctcatattccccattttcacaggccagacaccagcagagaaaacactgactccaggagactaaggaccatcttacccctcccaccatttatgggagcggcagcaggccaagggctcagcactatgtaacccacttgtggaggcaatccatctcatctcacagtggctgagaccgactcccagggagggttacgctgcgaaggggacctccctgggggttaccgcccttctttctggctcaggaggctctcccagggtcccaaaatatagtccctcctgacgctgtaaatttaattttattgcattattggcttagttgagcagatgtttggccctaaacacctgccttccaggcgcattaagtacgcacagtttgaagtagtaagtcccagggcggttactagctggaaaatactccggtactctatcatggatggttaactagtgcttgccacagcccgcttcttaggtttattaagcacctactccatgccagacactgtgctaggtggtacacaggtaagatctcttctattcacaatcaccttttgaggactagtattcctgctctagagataaggacactgaggcgcagaaacgatttgctgagggtgtcccagcctgaatgtggtggggctgggaagcaattacggctgaggggctccaagcccttagagctctgccattccgctcctgaaaagctgtctgggggcggggaccagaccatttccccccagcctactactgctgacacatctcggggtgcctcacccccagctctcccagaacagcctcctggtcttagcagcgtgtgccaagatttagcagggagcatctagttcctatgggctccctcccagaccttgcctgtaagattctgaatccggacgcacgcaggttcacaaagtgatacctcaggagcgcagccgcccccaccgcgggtgtgacccgcgcaaccccacaagggacactgtacctcggcgatctcaatgcaaagtcgcccaaaactcagtggggagacacacttccattctccccgctctgtcgatgaggaaacgtcatgagcgtaagacacttggagcgttaagacacttgctcaagaacgcagctgccgttcaggaaatgaggccgtcggggcgcccaggggtgctcggagggagcccgtttcccaaagcacgtgcgcgagccccgggcgcttccaagggctctaacttcacgtctgctccgtgttttcaagcgcagggggccggaggcggcaagacgcggcccaacgcgcggcgggacccggaccaccccccgccaaggccaccccgggacccctagacccgccccgacgcgggggacgtttcggtccgggcccgcgcgagcgtgcgcgacaggaggagacgcgacggggcagcaccgctctggtggcgcattgctggacgcagcccggggccggggagccgcggcacccacctaggtccatggcggcgacgccggcggctgcgcggggctaacgccccctcccctccgagaactcgaacgcggcgcgggacgcacggcacgatgggagacgcaggagccacggcggccgcgcttaggcctgctcacaacctccgcccggccccgcccacagcctccgccgcgcacgcgcagtcctcacgaacgagcgcgccaagcgcacagcgccgccttccggcagagccctcccaccagccctcaggtacccggacgtcgctcactagacccctccgcaccgtcccctgcccggcccctcttccggggtcccagcgggtcgggctcatgattccccggccccgcattcaccctcacccggtaaccccgggcgtgccccgcacacagttcacccccaccgagcgcctcccccgggacgcccaccacccagcgcggccgcaccacgcgaggcttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccagagtgaggagatgaggaagaaggaggctggctgagggctcctcgggaatggaaagggcttcttagaccttgatggctgaaatgtcctgaaactgtcgcaagcttagccgagacatcaataaatcacttaaactgcatgagagtgactgctgttggaaaggagaaactcggtgactgagtgctggggaggcgtccaaatacacagactaactttttgtatggttttgggtggagttcccagctctcctattacaagagcgtatgtaggtatttggaaggacgagggggacagtgtgctgtggaaatgcccaagatctgagggcaggagaccattctccagtgacagcctcttgggaggttgaggccccagccccttatctcttcaaggctgatttactaataccccagcaccacagaggggagagggactctgtcctcctaaacactaaagtcaagtccaaaagcccccactggaacacagggcctacccggttcatgttttgagggagaccaagctttccgtgatgataatgtgatgaaacaattgatgcgccagaacacagcagtttagaaacaatggagcagatggtgtcaaaatcccagccccagaaaggctcacctaaggccgggcaaccaaaatgttcccgggactattctgtacttaaccctggtttctgcttaggggacggtgggacaatatgcatatggatgtctatgtgggatttgttgcaagagcacaacacaccccttgacctatgcaagtgccagagtgtctgagcccagcttctactcctgttaatgatcacaggagcctcatacacaaccattgtgcatggcggctggagtatggagtagtaaatggtatccagaaaggcaggtctacggtggcatatgggatttcctggtacttcttctttaatagaaactatcttcacagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggaaattgagtcatggaatatgcaaaaaacttccttttgttcctaaacagataagctacaagacagaaggccacatatctccccaggtggtctccctcacctgacaatataaattaacagcttatcttcataggtaagggacaaagacaacaccagaaaccatccctcaccagccgagacaaaacatagatgtactgagctgaatgcataactgttcctctgcctgctgctttcactgtaacatatagatttggtgagcagtaaatgtagatttactgagctgaatgcataactgttcctctgcccgctcctttcactgtaacatgtagatttggtgagcgctaaatgtagatttactgagctgaatgcataactgactgttcgtctgcccgctcctttcactgtaacatgtagatttggtgagcactaaatgtagatttactgagctgaatgcataactgagtgttcctctgcccgctcctttcactgtaacatgtagagttggtgagcgctaaatgtagatttactgagctgaatgcaaaactgactgttcctctgcctgctcctttcactgtaacatgtagatttggtgagtgctaaatgtagacttactgagctgaatgcgtaactgttcctctgcccgctcctttcactgtaacatgtagatttggtgagcactaaatgtagatttactgagctgaatgcaaaactgactgttcctctgcctgctcctttcactgtaacatgtagatttggtgagtgctaaatgtagatttactgagctgaatgcaaaactgactgttcctctaccccctcctttcactgtgacatgtagatttggtgagcgctgatcaaagcctaataagaatgtaaccacttatctccctacctaccctcctgtatttttcctttccctcttccctcccttcctgctctttcccttttaaatacttgttaggaataatgctcaaaatcctaaggaaatagaacactcgaacaaaggattcttagcaaagcaattttacttctgtgcagaggggtgcctccttggccagttgtcatgagagcacacctgaacaaaggggcacgagagcctttgttcctgacacaagtcctgcccctctaccctttccccattggccggggtcaggtcgtacaatctaaactaatcgcgcttggctaaacatttgatttttttagatagggtgggcccgtaaaagaaagcggagaggaaggggaaggggtgtctgtaatgagctagaaagttagtcctctttccaaataaggaaaggaatgtgagctggtactgataacgcctggtgctgtggcgtgcctgggcatctcacaaaggcaaaaagggaaaaggagaaaaagggggcggggcgctatgaattaaagaataaaagattgatcagattatttgaagagaaacgtcgtcatatcccacatactgaggccctaaaaatcctctctggaaagtgtgcgggggccacagatctgtggttgtgtctcaggcacatcctcagccttggcaaaataaacctctaaatgggcgagacttgtctcagacacttacccggtttacaataccttttcatattgttttcatttttgaaccatgtggctctattgctttatataaagaggatgaggcaagggcacttctttattatcattgaagtcagagtaaatttactattgatttcccctgaggttggggtaagaactcttagaacaaacagggaaacttctcaactcttaccctgaatttcaacggacacgttggaggtctcctgaaaactctggctgctaagtcacagcggcactgagtggcaggtgagagagccagaaagccacatgaaggagcactcaccgtccctaggtttgttaattccggtaacatgtcagacggacacggacttcagacagtcctgcaggctaactaggagagctctggcaacacggccgttctaagtcttcccggagatttaactcaaggcacacttgtatttacatgtaggctccacaaccccttgattcaaaaaaacaactctggagaagctgaagaactttccaacttcatctgtttgaaacaacagcttgcagcctgaacaacgcagtgagacggtcgctacaaaagatcaaaacgttggctgggtgtggtggcacgtggctgtgggcccagccattcgggaggctgaggtgggaggatctcttgagccccagaggtcaaggctgcagaaagccacgatggtgccccactgcactccaccctgcgtgatagagcaatgtctcaaaaaccaaaaatgaaacaccagcttgggcaaagctatcttcctcatgccattttctaattgatcatatcccccagatgtgggaaactaatcacttttgtttaaaattagtttttgcggatctaatgggcgtctaaataatttttttttttttgagacggagtttcgctcttggtgcccagctggagtgcgacagcgtgatctcgcttcaccgcgacctccgcctcccaggttcaagggattctcctgccttggcctcctgagtagctgggattacaggcaggtaccaccacacccatctaattttgtatttttagtagagatggggtttctccgtgttggtcaggctggtctcgagctcccgacctcaggtgatccgcctgcctcagcctcccaacgtgctggcattataggcttgagccgccgcgcccggcctaaataataatttttaaaaattactcttttttggtttagaattacttagctgaactgtgcagaagcaagcttctggatgccttgataaaaagccaaagttgtacactagagggctttaggatgaataaaatgttaaaaaacgccaacaggacgaggtggctgatcacctgaggtcagaagttcaagaccagcctgaccaacatggagaaaacccgtctctactaaaaatacaaaattagccatgtgtggtggcacatgcctgtaatcccagctacttgggaggctgaggcaggagaatcgctcaaactcgggaggcagaggttgcggtgagccgaggttgcgccattgcactccagcctgggcaacaagagtgaaactccgtcttaaaaaaaaacaaaaacaaaagcaaaaacaaaacgcaacaaagcgagacatgacaggcaatgaaataaataaaaggaggcagatctcctaaagccaaaatgtcctatgcagacaaacagcattactgttcaccctgcatggtgcccactatcatgcacagttgtatatttaggagaaaaacgttttggtacgccaaaatacaagataagcagataaaagggaaacctgtgtgtgttatttagttattcggtacttatataaaccacttattttactacaacaaacttcgagggccacattatagcagcccaatacactgggaaaaggagtttcttttcacaaggacaatattactagagatgaacattaaaaattacttaataatctaatagaaaattggaaaattaacatacattctaaagagaagcagaagtttacctggttattcaaagttcatataataatttccacatgtataaaaaaaaagagaagggcacggtggctcacacctgtaatcccaggctgaggcaggtggatcacctgaggtcgggagttcgagaccaacctaaccaacacggagaaagcccatctctactaaaaatacaaaattagccagacgtggtggcgcatgcctgtaatcccagctacttgggaggctgaggcaggagaatcgcttgaaaccgggaggcggaggttgcagtgagccaagatcacgccattgcactccagcctgggcaacaagagcgaaactctgtctcaaaaaaaaaaaataaaaaataaaaagaaccaattacctagaggagggccatatatataacttggtttgctttgaaactcaagactgcttccctaggatatggaattcaagctgaatgaaaagttgtagagctggatgagaatttatttctctccgtgaaggtataatagcatcacccctataagaagataagctcaaatacaaccaaaatttcgatgccctacgccctgccagtaagggaggaaagcagaggttacgatttacaagtaattctctatgtgttctttgggaaccaggatcctctgagtcaatcccttccaatctcctaagtttatttttaaaaatctgaacctggccaccactttacatgatgagacttagagactggtatcacagcttgatttcagaagcttactttcaaaaaaaatttattcaatgaatacacaatataattccatttcgagtgattaaaacctatttgttgtttagaaccaaacaaaactacaagaaaacattttcaaaaccttttttttcaggctgaagaaatcgtttaatccattttaaagaaatctcacatgatgttctgtcgggattaaaaatatacacggaaaaaaataaaacaaaatatatacacagaaagaagctcgcacagagtcaggcgtgcagcaacgtcacacactcattcctttctgtttcctctggacactcaaaatgtgaaagcaagtaagaggggggtggttaaccaaaccttttggtccaaggaataaaatttctttaaaaaatttaaaacgtcaaaacctgccagaataagacaatagaagagcgtatcgtcaggcgctgggaatggcaccacgacaaggcattaatgtggattcacttgcacagctgctctcataaaagctacacgattcagaggtaaccctaactatccgcaatcccaaccaaagtcatgttcatgccgctgtcctagtctggacaatcatctgtcactcatccaacacagttatatacagaatgcgcagtcccagcaacagtgtagattacagcaggcgttctctacctggactcatgattggatttcatttctaaattacatcagagctttcaaagattgaaatacacaaatctgcactacccaagcctccttgcctgtacgggaaacaaatcagaagagcatttattgggaactgacacgtcaggcctcacaggtgctgggcaggaatcacagaggcttgctctgcatcatgtcttccgttaacctgaagctttgggtttattgtgtttggcaaaccactcgtcacttttatctgctgccattgcctgtaaaatagaaatagaatatacactgactccaagcctgaaaaacaaaagacatagcccactttatatctcactgtactgaccacaataaaaaaaattaacattaaaaaaaggacccaaacccccgctccaaaaaaaagagaagagaaataaaaaaaattttttaacatttaaagagtattaatccagtacagagtgttatgttcaataaggcaagagatactggtgataatgagcaactgtggatcctcactcggcagagtcaagggcaaaccaagcctgtagccaggaagtgtggctggcggaccaacgaggtcagggacccgcatgccaggcggtaggatctctggtaaaagagcaagtcctgccactcacagcatctgggcagacgctcaagaatctttagtgtcatgaaactcagtctgatagtgaggccaaatatgaaactctacgtgatgttttagtgatgaagcctggaatgattcctttttcgtaagtctcctcccggcctactcttctgatgttggttctgtttagtttgggcatcttaattaaaaaggaagccttaagccgtgcccagtggtcacacctatagtcacagccacttggaggctgaggccagaggatcacgtgagctcaggaattcgagttcagcctgtgtaacagagtgggaccccgtctcatatacatacatacagatacaaataaaaataaatgaataatacaaagccttaacaataatgttttggttccacaagcatccctttcgttgtttagtaaggacaaacactcatttatgtagtcaaaaagagccaggtaccacgctgggttcagatgtggcagcagagacagtcggaagctttgaggagtgtgcagaacagctgagaactcagatatggaaacaagtattttgcatgacagagtgtgtgtacgcatgtgtgtgtcttgaagcatttgctataatatctacctcagcaggaagtcacaagatgaggtggcaattgaaaaagaagaaacaaatatatttattatttagaaacagtgaaggtgaaagtggctgtcctaggtagtgtgactcagagttggaccgtttcatttctaaaaaatcttagtactatctgatttattatcttgatgaaaataagaatttaaaaatcaaagatatgcttaaaaaaaccacaagtcacaaatatgcacgtttctgtcttttaggagccataaaaagtgggaggaaagaacaactaaattatttggagaacctaagaaagctttttttcttttttgaaatggagttttgctcttgtcgcccaggctggagtgcaacggcgccatctcggctcactgcaacctctgccttctgggttcaagtgattctcctgcctcagcctcccaagtagctgggattacaggcgtacaccaccgtgcctggctaattttttgtgtttagtagagacagggtttcaccatgttggtcaggctggtctgggactcctgacctcaggtgagccacccgccttggtcccccaaggtgctgggattacaggggtgagccatcgcgcccggctgaacctaagaaagcttttaagtgttgaaggacaagtaaaagaggagagggaaaaaaccctttgggttggatgcaagaagaagtatcttagctaatataaccagttcagtgggactggaatagggatgagttaggggacttagggaggcaggtgggaaagaaggtcagagggtagagaatgtccaaaaatgtcacatgctctgtcagagagtttgaaatttatctcagaggcaagagagagctatcggattaaacggttttaaaaattactggctgtttgctttgggacagaccgtaagttgacaatgaggcctttcaaagggaaagctgataggcagaagacatttcagaggtagaactcacagctcttggtgactaatagctaaaataatttaaggatgaggagaaataatggtcaaaagtgactgtctgtaaatctaaaacgactattaaatgttaaaaaacaaaacacaacaaaataacaccaaaactggctctgaggattccagcgtgaacaactgggatcacagacacgctgtactgtccagggagggagcagggcgcagaggaagaaaaaggactaactgtaaagcctgaaaggcttccatccaggccccggcctgcacctactcagtgcgtgatcttcagggatgaaggggaataatttcatcaccatccaggccccggccggcacctactcagtgcgtgatcttcagggatgaaggggaataatttcatcaccatccaggccccggccggcacctactcagtgcgtgatcttcagggatgaaggggaataattatttcatcaccatccaggcccctgcctgcacctactcagtgtgtgatcttcagggatgaaggggaataatttcatcaccatccaggccccggcctgcacctactcagtgcgtgatcttcagggatgaaggggaataatttcatcaccatccaggcccctgcctgccacttactcagtgtatggtattcaagggtgagggccaatgacttactcattcttagcctcggtttcctcatttgcaaaggctgatgctatcaaccttgcaggttatattaagaatcagagaatgtggctgggcgcggtggctcacgcctgtaatcccaacactttgggaggccgaggcaggcggatcacgaggtcaggagatcgagaccatcctggctaacacggtgaaaccccgtctctactaaaaatacaaaaaaattagccaggtgtggtggtgggcgcctgtagtcccagctactcgggaggctgaggctgaggcaggagaatggtgtgaacccgggaggcggagcttgccgtgagccgagatcacgccactgcactccagcctgggcgacagagcgagactccgtctaaaaaaaaaaaaaaaaaatcagagaatgtatatgaagcacttaaggttggatgcggtggctcacatctgtaatcccagcactttgggaggctgaggcaggtggatcacctgaggtcaagagttcgagaccagcctagccaaaatggtgaaaccctgtctctactaaaaatacaaaaattagctggacatggtggcgggtgcctgtaatcccagctactcgggaatcccagctactctcctgaggcaggagaatcacttgaacctgggaggcggaggctgcagtgagctgagatcacaccactgcactctagcctgggcaacagagtgaggctccatctcaaaaaataaataaataaataaaaataaagcacttaagaacgtaccgatatagtagcatttatttctttttatttttatttatttacatatttttagtataaatagagagttcatctgggccaagcttgaagactgcagcccgggaacatagattcaggtttcccagaatctacactcccaagtagcctttatgtaatattactggaagaagaatggatttgaggtaagataagttatggacacgctgagtctgatatgtggtaggtttcctaggtgaagaggttctcaggatataacatcggtctggacagagaaagtgctacatgtaagagaaaaagttcataagctggacttcaccaaaataaaaaattcctcatcttcaaaaactcaattaatggctgggaaaaatacttgaatttgcaagtgacgaaggaatgatgaaaaactacagtacagagtcaaggtaagagtcacgtaaggctctgtcgtactctcttcggttgtgcatatttggaattttcatcatgaaatattaaaaattattaaagaatggacaaaagacttgaacataaaattcacaaaaataagtaaatggctaataagcacatgagaaggtgctcaatatcattagtcatcagggaaataaaaattaaacctctgtggggccgagctggaaggatcactggaggccagcctgggcaacacagtgagaatctgtctctacaaacataaaaaacatcagctgggcatagtgctgcagccctagctatgtggtggctgaggcagaaggatcgcttgattgcaccaatgaaaccatttcgcatgtgctagaatagctaaaaaacccacaaaaagcaaaataagtgttggtgagaatgtagacctactggacctctcgtggacaaacgatggtccgatcactttcgatgactgtttgacactttcttatacagtaaaagcagttctactcctaggtatttactcaagagaaatgaaacatctatctacaagaagatttacactagaatgttcatggcagtcttccttataatagattaaaaaatctagaaataaaccaaatgtccaccattataagaatgaatgagcaaattgttatattcataaaattgagtatcagtcagcaattaaaaaaaaaagagctgtgatatgcaattacatggtggaatctcaaaaccatgttgagtaggccgggcgcggtggctcacacctgtaatcccagccctttgggaggccaaggtgggtggatcacaaggtcaggagatcgagaccatcctggctaacacggtgaaacccgtctctactaaaaatacaaaaaattagccgggcgaggtggcaggtgcctgtagtcccagctactcggtaggctgaggcaggagaatggcgtgaacccgggaggcggagcttgcagtgagcagagattgtaccactgcactccagcctgggtgacagagcgagactccgtctcaaaaaaaaacaaaaaacaaaaaacaaaaaaagccatggtgagtaaaagcagccaggcacaaaaggaaagaaaatactgaatgactccatttgtatgaagtccaagaacgaactcacctacagtgacagaagtcagaatagcagctgatctgggagatgaaggtgccaactcactggagatgggcatgagggaacttcctgggaaaatggtctgtattctgagtagtggttgtatgagtaaacacaaccgtcaaaacacatttaaattctacctaaattatgcctcatcaacaacaaccacctgtctgagctgaggaaggagttaaaaactggaagtgaggaggctggagccaggatgatggttacgttcagggcagaggtaaggagaggtcgcaggtaagctctcatcagagtggaggaagaatgcagaatgggaaaaacagcaaagtagggctatgggtataaaaacactttgggatgagacacagaaagaggtgcccgtgtctgaggagaaactgtcaggaagatgaaaatggtaggatggccaggcgcagtggctcacgcctataatcccagccctttgggaggccgaggagggtggatcacctgaggtcaggagttcaagagacagggtttcaccgtgttagccaggatggtctcgatctcctgaccttgtgatccgcccgcctcggcctcccaaagggctggggttacaggtgtgagccaccgcacccggcctactcaaccagcctgaccaacatggtgaaaccccatctctactaaaaatacaaaaattagccaggtgtggtggtgcgtgcctgtaatcccagctaccagctactcaggaggctgaggcaagagaactgcttgaacctgggaggcagaggttgcagtgacctgagatcgcgccactgcactccagcctgggcaagagagtgagactcccaactcaaaaaaaagaaaaatggcaggatcgctaacagcagaggagaagagagctcagggagcaggagttcatcaatggttcacatctataatcccagcactttgggaggccaagatggatcgaatgattgagcccaggaagtttgaaaccagcctgggcaacatggtgaaaccccatctctagaaaaaatacaaaaattagccaggcatggtggcgcacgcctatggttccagctactagggaggctgaggtgggaggatcactggaacataggaggcggaggttgcagtgagctgagatcatgccactgcactccagcctcggtgacagagagagaccccgtcttaaaaaaaaaaaaatgggcccaggcgtggtggctcacgcctgtaatcccagcactttgggaggccaaggcagacggatcgcctgaagttaggagttcaagaccatcctggccaacatggtgaagccccgtctctactaaaaatacaaaaattagccaggcgtggtggcacgtgcctgtaatcccagctacttgggaggctgaggcaggagaatcgcttgatcccgggaggtggaggttgcagtgagccaagattatgccactgcactccagcctagttgacagagcaagaatccgtctcaaaaaataaataaaataaaatgggccaggcacagtggctcacacctgtaatcccagcactttaggaggatgaggtgggtagatcacttgaggctaggagtttgagaccagcctggccaacctggcaaaaccctgtctctactaaaaatacaaaaattagccagcatggtggcaagtgcctgtagttccagctccttgggaggccgaggcagaagaatcgcttgaccctgggaggcgaaggttgcagtgaggcaagattgcaccattgcactccaccctgggcgacagagctagactccatctcaaaaaatttaattcagtaattaatttaattaaattaagagcgaggaggaagagtctggcaaatttgtcagctgagaggatgacagattctactttccttcaggataaaatgtataaagactgtattttctatacattgcctgctttaacgttaattgtgcatctactattatgtcagtaatttgccaagctctataaaccataacaatcttatgagatagatcctcttattttctgaaatttttggataagaagactaaagttcaaagaatttaagtcaactgtttaaggtcagtcacagagttacgtgacagaaccaagaaagaccaatttgttcctttaatcattcaacaaagtatttgcagaacgtctagtacatgccaggtatgtgctaggagctaggatccaacaactactttgaatgcttctgaattactgagtttgatgagaatctaaaagtagttgctatatttggcaagaaacaaaagcacttcactgagtaacaagagccagtgcaaaacagactgaagtgaaaatgggaggcgagaaagagaaacagtgcacactcagatttttagaagaagaaatctggagaggacgtaagagggagaaacagcgcgcactcagatttttagagaagaaatctggagaggacgtaagagagagaaacagcgcacactcagatttttagaagaagaaatctagagaggacgtgagagagagaaacagcacgcactcagatttttagaagaagaaatctggagaggacgtgagagagagaaacagcgcgcattcagatttttagaagaagaaatctggagaggacgtaagagagggaaacagcgcgcactcagatttttagaagaaatctggagaggatgtgagagagagaaacagcgcgcactcagatttttagaagaaatctggagagtatgtgagagagaaacagcgcgcactcagatttttagaagaagaaatctggagaggacgtaagagagagaaacagcgcgcactcagatttttagaaaaaatctggagaggacgtaagagagagaaacagcgcgcactcagatttttagaagaaatctggagaggacgtgagagagagaaacagcgcgcactcagatttttagaagaagaaatctggagaggacgtgagagagagaaacagcgcgcactcagatttttagaagaagaaatctggagaggatgtgtgagagagaaacagcgtgcactcagatttttagaagaaatctggagaggacgtgagagagagaaacggcgcacactcagatttttagaagaagaaatctggagaggatgtgtgagagagaaacagcgcgcactcagatttttagaagaaatctggagaggatgtgagagagagaaacagggcgcactcagatttttagaagaagaaatctgaagaggacgtgagagagagaaacagcgcgcactcagatttttagaagaagaaatctggagaggacgtaagagagagaaacagcgcgcgctcagatttttagaagaaatctggagaggacataagagggagaaacagcgcgcactcagatttttagaagaaatctggagaggacgtgagagagagaaacagcgcgcactcagatttttagaagaaatctggagaggacgtgagagagagaaacagcgcgcactcagatttttagaagaagaagtctggagaggacgtgagagagagaaacagcgcgcactcagatttttagaagaagaaatctggagaggacgtgagagggagaaacagcgcgcactcagatttttagaggaagaaatctggagaggacgtgagagagagaaacagcgcgcactcagatttttagaagaaatctggagaggatgtgagagagagaaacagcgcgcactcagatttttagaagaagaaatctggagaggacgtgagagagagaaacagcgcgcactcagatttttagaagaaatctggagaggatgtgagagagagaaacagcgcgcactcagatttttagaagaagaaatctggagaggatgtgagagagagaaacagtgcgcactcagatttttagaaggagaaatctggagaggagatatggggtcagtaaaaggtttttaaaggatgggagctttcagcgcctgtttgcacgctggcgagaataactcactggaaagaagagactgatgctgcagaatggagaagagatgatcaaaggagctgcagagctgaggggatcagatggaggcatctccctggggagagctgaggggaacggatggaggcatctccatggggagagctgagggggtcagatggaggcatctccacggggagagctgaggggatgggatggaggcatctccatggggagagctgaggggaacggatggaggcatctccatggcaagagctgaggggatgggatggaggcatctccatgcggagagctgaggggaacggatggaggcatctccatggggagagctgagggggtcggatggaggcatctccctggcgagagctgaggggaacggatagaggcatctccatggggagagctgagggggtcagatggaggcatctccatgcagagagctgagggggtcggatggaggcatctccatggggagagctgagggggtcggatggaggcatctccatggggagagctgagggggtcggatagaggcatctccatgtggagagcagaataagcacagatccaccagcagtggttccagggcagcctgaggttgtggtaaggcacaaatgctaagtctagacaagcagtctacacaggtggcagtgaagacatcggtccttggctgaggtcaacccaacagcgaaaggacgtggttctgacattaagaacctggaccctgttgcttagtctcctcccacacacacttaatgccatccctctcaggcccatggtgacataaatgtagaaatgggactcacatcatccaacaatttgcttccctctggatccatcttagaaagttctcgaaatgcttcatccccgacaaagcaaatttcatgtccgtcctacaccaataaagagaaaagacacctgccaaagacatccttgaagaaacccctggtccagcctgccccctgcctgagaaatacttacagggtcggccagaatgaccacctgtactgttgctttccctggggtgtccaggctcaccaggggagtcagaatcttctggttctcccttttcatcaagtcttctaagtctggcaacttgaggaaaacagaggcaacgtgagccaggggtcacacactactcaggacacggccctcgtcagtcctagaggagtatcagataccataaagaaccaaggcgccatttgtttgaatttattatctcagctgctcttgaaacaactgctgaacttgatactaaagccacaatcaaaaaggacctcaagaagggaaggacaaagttcttagctgggttgaactagctagtcagaaagctcaaacgatctggtatcaagcgttacctctttctgggggcaagagaaggcaattcttccaaaagctgctgcatggtccaccccacccttgacgccctgtagctccagcttacactgaaataggaaagggggttattttttggaacaggttatacattcattacacgtatgtggtagaaaaattcaaatattatatactaaaggaataaagtaaaaactgagtctctatcctactctcaccccagagacaactagtccacactttcctgtgtatccttctagaagcactgcacgcatctatgtttttttttttacacaaatggtggtataatttacaaattattctgttccttgtttttctccacttaatgttaccatgtcaatacataaagatttgcctcaatctttttgctagcgacatagtaatccattccatgaatgagccgtaaattactgaaatatgtctctaatctataggacactgaaattcttacacattgtgattacagacaatgctgcagcagataaccttgcacacacttctttgtgccgatgtatgttgagcacatctgtaaaataattcctaggagtagaattgcagggtcaaagtgcaaggactaaatcgtgctcaaacgctgggttattagaaaaagaagatgaaaaagatcttgcattaaatccattcaatctcttggattaagcaattccacttctgaagagatatatccccaaatataaacaaggtaatatctgggtggtaaggttatcacttattttcttctgtttatctatataaatattgaatcactgtgaagaaactatgggaacaaccttcatgttaacttcatttataaaggttataagccatttataagcttcgtttacaagccaaattcaaagtaacaggttattcttctccaagattgctcacctggttatcagcatagcccagcaaagccctttgcttttcttcatctttttcataaattttcattcccagtagattacaccagtagttcaaggacttttgaagatcagacactgctagagttacttttaatacaggatctgttgggtaataaagcaggaatagacagatcaatttaatagaataaaatagaaagaccaaaacatgcgcatgtatacttacaaattcagtttatgataagaaagggattttaagccagtatgaagctgggtgcagcggcccatgcctgtaatgccagcactttgggagactgaggtaggaggattgcgtgagcctaggaattcaagaccaatgcaggtaaaacactgagaccttgcctgtatgaaaactttaaaaaaattggctgggtgtggtggctgatgcctgtaatcccagcactttgggaggccaaggcaagtggattacctgaggtcaggagtttgagaccagcctggccaacatggcaaaaccctgtctctactaaaaataaaaaataaaaaaaattagctgggcgtggtggcgcacgcctgtaatcccagctactcgggaggctgagacaggagaattgcttgaacctgggaggcggaggttgcagtgagccgagatggcgccgttgcactctagcctgggagacaagagcaaaactctgtctcaaaaaaaaaaaaaaaaaaaaaaaagattagacaggcgtggtggctcatgtgtgtattcccagccacttcagagatggaagcaggaggatcgcttgagcccgggaggttgaggctgcagtgagccaagactgcactactgcactccagcctgggtgacagtgagaccctatctcgaaaaaaaaaaaaaaaaaaaaaacaaagacagtatgaaaagcctcattattcaatggacggcgctaagaagactggctaatcatttggtaagaaaaacttacatcttcgaaataaatgacaaaatacattcctgatgggttaaaaaaataagtttagagaatgaaaccatgaaaatactagatacagatgattatttatacaattttggagtagaggaagatttttctttaaacctgacaccaaagatagaaaaactatgaagaaaaaacttctgctacataaattacacaaaatggaaaactcctagacaacaaccaagaaaaggaattacaatcaaaactagagtatacaacacagtagggggaacaactgcaatatattggacaaaaagtccttaatatgtaaatcacctgtaaatatcaataggaaaagaatgaacatgctagaaaaataggcaaaaggcacaaagcaataatccacaaaacaaggaattagaatggtcaaataacatacgaaaaaatattcaggccgggcgcggtggctcacgcctgtaatcccagcactttgggaggctgaggtggcaggatcatgaggtcaggagatagagaccatcctggctaacacggtgaaaccccgtctctactaaaaatacaaaaaattagccgggcgtgctggcgggcgcctgtggtcccagctactcaggaggctgaggcaggagaatggcgtgaacccgggaggcggagcttgcagtgagcccagagcgcgccactgcactctagcctgggcgacagagcgagactctgtctcaaaaaaaaaaaaaaaatttcaacccgacgcccccaaacaacaaagaaattagaattcacataaaatcctttgttaactaatgtgcaaataatgttaaaagttggcagtgttaactgtgttagtgtagaggggaaaatcacaatcatgtaatacaagtgtaaatcagtacatttctgggcaatagtttgatggaatgtaccaaaagctttaaaaagtgctcattgcttttgaaagaacaagtccattttcagccactccaaaggtaattgtggatgtatgaagggcttttacgacaaagacattcaccagtgttgcttagaacaataaaacactaggaacgacataaatatccaacaatagagaattgtttctcttcctacaatgtaataatacgatggaactcctaaaaaaggatatacagaaatgtatacacttaattatatatacgtatttttgacaaaagattggaaagatatactctaaaatgtcagcagtggttctctctgggtacatgggtgtgtgtgttttttttcagcttctctgcttgtctaaggaaaaaacttgattattttgtaaaaagaataaaagtcatattgaaacacctactgttactggaaacttttcacattgtaaagtgactttctaaagagctgttccacgtctccatctgactacgataaattcagtacatttttctttggctttactgccttagtcctgtttgctagaacagcaatattgggattaagacgctgtttctcacaagtgcctccgcctggcaggctccatttttttctttccatttacttcaaaatcaacaaatcccagttgacttggagcctgaagggacgcaggacaggaagttaacgcgtgggtgaagctgcacagaagtgggtaattcaaaggaaagatgaatgccagccggacagaaggtctgaccacattgtcaaccagaaatgcccaaggggatttccattccaaagaacaaaagcttcttagcaccatggggctctctattattttaagcactgaaatatcactaaggctggagagaaaaaatggatggtggagctagctgcaagcgttaagttttaaagtcagcaaaggatcaatcacctatcaacaaaaaaacaccatcaacaccctttaaatcaccagtgaggcagagaaacaccatctctccacgagtcccacacagccaagtctagcctcccacactggaacagacggatctttcttttgctgagcaccggatgataaacaaggagcactgaacattctacagactcagcatgggggcatcggggacaggaggccgaccagtgaagaaggagaatttccaggactcccttctcaggcccacttgcaggcatacgttcaccaagtaagggagtcggcacaagtgcccttgccattcgccagcattttccccgtttttgcttttgttttgtcagagcaggtagctgaatttgcaggcattaaatacaaaatgaaacactgatgaggctgcctctgcagtcaacaaaacaaaccctgcaaagtttccttcttgttctgtgtggcagtcagcgtgggggctcctcacttccatgccatccctgagtacccacgctcaagtctgggaaactgacctcggctccagaggaggcatggctaaatggtttgggggtgatcctatttctcttgccagtgattggtttaggagcaggcacagtatatcaaatctgaacaggaagtttgctggaagattctaggaaagtttttcttctgctcctaaaaagaaagcaaaaagggccgggcacggtggttcacgcctgtcaccccagcactttgggaggctgaggcaggcggatcaagtgaggtcagaagttcaagaccagcctggacaatatagtgaaaccctgtctctactaaaaatacaaaaatgagctgggcgtggtggcatgtgcctgtaatctcagctactggagaggctgaggcaggagaatcacttgaacctgggaggcggaggttgcaagtgagccgagattgcagcactgcactctagcctgggcgacagagcaagactccgtctcaaaaaacaaataatttttaaaagttaataaaaatactaaaaaaaaaaaaaaaaaagctgagcgtggtggcaggcgcctataatcccagctacttgggaggctgaggaaggagaattgcttgaacccgggaggcagaggttgcagtgagcagagatcatgccagtacactccagccggactgacagagtctcaaaaaaaaaaagcaaaaagaagtcagcatctcctctcctaccagatgggattgtgggagcatgtggccccacctgctcctggcagctctcctgcaaccttgaggggactagttctaggagaggtacccgcagagaacaacagaacgtagaaagagaaaatgtggggagctggtgaatcatctaaccttgaaatctttcccacctatagaatgcctgctctgtgagctaaaagattctataactgttcaaagtagttgggttttctgttatttacagatgaaagaatcataaatcactacattaccagtagaacagaactagtctagatcccctactgctatgtatttaagttctgatatgagaatgtagtctctccgataacaggtaaaagcactggctggggaagacacgtcacgtgaacacagactctacaaaaaaaagacaggcagccctcactctcctttcaccaaagatgcctttagacagaggcttttactggttctggtataattacctgactgaggcagactgcgattctgcaaatagaacttatatcctcccggggcctcggtttcaaaaacaccttctgcaacttccgtcagtggccactccagcttcctggcgttgctgacagcctggctagaagcgagcgtgattccctacaacaaacaacagtacatccaagtacatgatcacaacagatattttacagaacaagacaatgagcccaacccctattgcctactgcctttaggtaaaatcacctaagatttaactggcatccaacattttcttctagtgatttaaaaacaggttttcaatgttttatcccacaaacattcagacctttgtgaataataggacagaaattgaaatgccagtgaagtctgattcatttaacaccaaagataacgtcttctaattctaaagatctagccacagaaatcttgatgttacctgggtctgccagctagctacctatttaaggtgacctgttcttgcttttttaacaaacaaaacaaaaataagcaaactatcaaggtttccttacatttaatcaaagtgcctagaaatgtacacgtgtgctttgagaagaccagccttgtttctggctcggtttattataatggcctctctgcctccagtcttgtaaatccattacccactctgcagccaaagtaaactttccaaaacgcatcctatagtccacccccagactgcagccagccttgttttccctttgctcaaagtccgccaatggctcatttcactcggtgacttacggcctaggaggccccctgcagtcttaccccatggcactgccgaccccatctcttaccacgctcccctctcgttctctattccagccacactggcttccttacacctcctcgaacacgccagatgttacctgacggctcttgccagaatattctctgcctggaacgcgcatcccccagatatccacgtggctaactccctgacctcttttgagtctctgctcaaatgttatctcttcactcacacacacccttggcactctactcaaatttacaaccagccacctacccccagccaaaactctgctagaaaaaaacggtatttaccataaagtcattgccaagcttgtagtctccgacgccataattgtaagtcagttctgcgacaaaatgatcatcctcaggcccaaatcccaccattgttttactccatttcccatcataaggcctagaaaataaaagtaaatgaactcagtgactacagacaagtcagcctcaggccacccccagagaactactgggcacagagagatgagcattcctgtctggtcctaaaagttctcttaaggatgagatgacctcagatggtacagaaagcagctgtgggcagtgctcatgggaccctactacaagctccaaagactatccagcatctacctgaaggaaagatttgttcaccttttctgtaaagcaaggaacagaatcctaaagacagttctccaactgacctgttatttccttgactatcaatcaacaagcatgaaattcctaataggccttggactgttccaacttgtcacggtactaagcttaagagatggacgggcgtggtggctcaggcctgtaatcccagcactttgggaggccgaggcgggaggatcacctgaggtcaggagttcgagaccagcctggccaacatggtgaaaccccgtctctactaaaaatacaaaaattagctgggcatggtggcacatgcccatagtcccacgtactagggaggctgagggaggagaattgcttgaactcagaagacagaggttgcagtgagccaggataatgaccccgcactcccacctgggtgacaaagtgagattctgtctcaaaaaaaaaaagatactggaaagccgctgcttcatctagagcatgtacttatttgcatttgtggcataatatgaaacatatctggtcattgtccctggttcctgtctcagagctcccaaaacctctggaatttcctgataggaatatcttttgttatattcataatgagcccctttcagtcacacctgagtttatgctaatgaagtgacttagagtggggcctctacatagactcaggatggggctggtcaccagaaagacaaatgattagaggactgaactttcagtcccatccaccaacctctgggaaggaaagggatggagactgggctctattaggcttgaacaatgagactcatgagcttctgggatgctgaacgtagggaggtgctggattggagcctgcccagaagagcatggaagctctgccacccactccccatgccctgccctgtgtatctcctctgtccagccatttctgactcgtactctttatgataaaccagtaaatgtaagtaagtgtttccagcgtttcccttagttccatgagccactgtagcagactatcaaacccaaggaagcaggagcgggagccctgacttgtagttggtcatcggaaatcctgaagatccagactgtgaccggcgcctgacgtggcggaaaatcttctgggactgagcccttaacttgcaggatctgacattaactccaggtagagtcagaatcaattaaataacaggacagccggctggtgttagagagctggagaatccctttgtgtcccacaggtgttgtatgagagtgcagagaaatgtgttcccgacgctcctgaagttgcctccctaatttactgccttcttaattaattccactgctttatactcatgagagtgcagagaaacagtatgtgttcccgacgctcctgaagttgcctccctaatttactgcctccttaattaattccactgctttatactcactttgagaaactgtcttctgttatccgggtgtagtcagagcctaaaggagattttaagaaacaaggtatcatacccattacaggcagctttgcagccttcttcaaattcctcatgccgcagaacctggtgtgagatttagaataaattgtgaagtgttgctagtactgctcacagcgtctttagcacagactaaaatgtcaaaacacaaacattatcatttataagctttacttgtaaaagaacaaaagcaaatgagctttacacttctcccaggatagaagcagtggaaggacgaacagcttgacaccaagggtcaggctaccaaatcagttgtgaaatctatttagattggtaagcagtgctatgcagtgggaaaaagtgtggccttcagcattaaagaagtctgatttgggccgggcacagtgactcacgcctataataccagcactttgggagatcaaggtgggtggactgcctgaggtcaggagttcaagatcaacctggcaaacatagtgaaaccccgtctcaactaaaaatacaaaaattagccaggcgtggtggcgtgtgcttgtgatcccagctactcaggaggttgaggcaggagaatcacttggaccatgagatggaggttgcagtgagccgagatcgtgcccctgcactacagcctgggtgacaagagcaaaattccatctcaaattaaaaaaaaaaaaaaaaaaaaaaaaaaaaagatgggcatcgtggctcacgcctgtaatcccagcactttgggaggctgaggtgggcagatcacctgaggtcgggagttcgagaccagcctagccaacacagtgaaaccccatctctactaaaaatataaaaaatacaaaattagccaggcatggtggtgggcgcttgtaatcccagctactcaggaggctgaggtaggagaattgcttgaacacgggaggcagaggttgcaatgagctgagattgcaccattacactccagcctgggtgacaagagcaaaactcaaactcaaaaaaaaaaaaaagtctgatttggaattctgtcatttagtagttgtgtaactctgagcaaattagaatctgagtctcagtctcctaacatgtgatgggaatggatgttatgaaagcatctcacagaaccctgcacacagcgggctctcaacgtgttagctttagccctcctttttgattcccacggctcctgccagttgaagttcccaacgcttcgctcagactattaaaaatcatccttattggccgggcgcggtggctcacgcctgtaatcccagcactttgggaggccgaggtgggtggatcatgaggtcaggagatcgagaccatcctggctaacacagtaaaaccccatctctactaaaaatacaaaaaataagcagggcgtggtggcgggcgcctgtagtaccagctactcgggaggctgaggcaggagaatggtgtgaacccaggaggcggagcttgcagtgagccgagattgcgccactgcactccagcctgggcgaaagagcgagactccgtctcaacataaaaaaaataaaaaataaaaaataaaaaaatccttattgatatccttccttaataacaccaaaaaagcacatgcctaaagcacaaagcactgatcccatcaccaccctgtttaagaacataagtgagctcccatcttactgcagcataaaatccaaattctttagcatagcattcaagatactattagaagcaatgccgacctgtccatcctgatatcccatctccttaacttcaactaagcaacctcaactaaaggcacataaaaccagcggcttcgcaaacatgtgccatctccgcactggctcttcagttttactatgtagctcctcctctcatctacctgtggatatcctatctttagacgtcaactcgaatcctggctaacacggtgaaaccccgtctctactaaaaatatttttaaaaattagccgggtgttgtggtacgcgcctgtggtcccagctactcgggaggctgaggcaggagaatggtgtgaacccgggaggctgagcttacagtgagccgagatcgcgccactgcactccagcctggcgacagagcaagactccacctcaaaaaaaaaaaaaaaaaaaaaagtcaactcgaatacaaggtctacatgaattatttcctcatcacccaggttggaaaaccgctccttcttttgtatttttataatagtggctaacacttatataatctactattaccgatatgttaaatactatacatataataaggtgttgaatcttttttttttttttttttttgagacggagttttgctttcgtcatccaggctggaacacaatggtgcgatctcggctcactgcaacctccgcctcccagatacaggcgattctcttgcctcagcctcccgagtagctgggattacaggcgtgtgccaccatgcccggctaatttttgtatttttagtagagacagggtttcaccatgttggccaggctggtgtccaactcctgacctccagtgatccacccgccttggcctcccaaagtgctgagattacaggcgtgggccaccgcgccggcacgtgtttaatctttgcaacaaccttttgatcgacgaggaaatactaacaagggacagctctgtggtttctgctatcgaaagtttggtggtttttcactatcaaattctgacttccattaccatcatctacgtacaaatccagttccaactcccaccccaacccaggccatgagctctaatggaggatatatatcagggtcatttgcacctttgttgccaaaactcaacgtagtaccctgaaaatagcagatattttaaaaatgacctgacgaattcagatccccgtctattgcaccgtctatacactaaaccgcgctcttgcacctttcaagtcttccttagtggtgtgttccctacctccctggcttatcaaaggaggtccccaaaacccagttccccaaccaactgaatcctgcaaataacagctcctcaggacccgagacagaccgcttctgggtgctgttgaaaagcagatgggttgagagttggagcatatattcagagactgagtatccgaaacggactattcagaccagccttgctagaagcagaactctgaatacgctgattttatctacatcaaaggctccaaaccggaaaacacaaatattaactagaaagcattatataacattttatttaccgtcttttccggtagacggtaagctccacaagggcggggctcaataaacgtttacgagtggcttaaatgaaaggacgtgcgtgggcacaccgcggggactaatcgtgttaggcccttctccaaggcctatgatccccaacggcaactcgccacgctcctgaagctgaacaccgcgcagggcctaaggtcggacaccctccggcttaggttcacgacacacccattttcccctccctccgccagggccggctcgggcgccggttccagcctcgcgcgccagcccctgtcggccccggcctgcaccttcatccccaggacgtcccgatagaaacgcgccgtctggaagcggtttcccactttgaatacgaagtgcagagctctgcgagcagccatgattcccgccgcacgcagccgtcacgcgcaccgtacagcccagtccacgaagggcgccacgggccgtgacgtcactagccgccgacggcgcgctttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgaggtgatgtggttcttgagcctgtcgaatgttctcgtttcccttcccgtcgcacagcggaaccttaacctccttccgatggaggacttcttccagtacagcccgctggtttttgtattatgcacagagggccgaataagcgtctttggaattagcttctgtttctccttagctctttgttgttgtttttgtttcaccatgttagccaggctgatctggaactcctgacctcaggtgatccgcccgcctcggcctcccaatgtgctgggattacaggcgtgagccaccgcgcccggccctctccgtagctctttatttctgttacaactaagcgtgtctcagtaacaaggatgttgatagttacctgttttttttttttatttccatctacagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatgggttagtgattacccagtgtatctttttttttttttgtcttgttctgtcacccaggctggagtgcaatggcgcgatctcggcccactgcaacctccgcctctcgggttcaagggattctcttgcctcagcctccgcagtagctgggattacaggcgtctgccaccatgcccgggtgatttttgtatttttagtagaggtggggtttcaccatgttggccaggctgacgtcgaacttgtgacctcaggtgatcctcctgcctcggcctcccaaagtgctgggattacaggcgtgagccaccatgcctggccttacacagtgtatcttaaggtgtggagacctaggattaatttctcatacttgtcttaggacagcagcattgaaatgaaattcaaaatgttacaattagaaaaatataattctcaaacctgtgtatcttagagtattttcaatggaaattgaaacccgtttttcactatcatttgtgttgtggctctttatggtctctaggaagaaccactattcctcaaaccttctattttttagattacttcttcaactttctatgtcagattaaaaattaagaaagcgtttactgaaagattgagcccttcatttttgcaaaacctctgccaatgtggtgataactgtcaataaactgcttattccagaagcagatctaagaagcgaggtacaagccacaatttactgccccgtttagcccaataaacagagaaccttgtcttctagtctgttccttcatttggctgaatctgacttaaccttatgtaactccgatgttgattagcagttacaaagtctttggtctaaatatgagaagataagtttttcatacgtttttgacatgggagttttaagatatgaaaactgaatccttgaactgctgagagaggagattctggggaaccatctcttgtctctgtaacccagtgagtcacagggatctgtgcctctgcactcagagctcttagatcctaggatggggacttggattactaaagtacctagaattactcatgctaagtaaccatattctcactagctacagccctctaatccacacgccatgcttcagtgaaagtgttattcatttttaccgtgcttgtcacttggggcaggtgtgctcacagtggccagcccatcttgaacttgtgcttgtcacttggggcaggtgtgctcacagtggccagcccatcttgaacttgtgcttgtcacttggggcaggtgtgcttacagtggccaacccatcttgaacttcatcatcatacctgctttcatcatttcctggcttatccttatgttactatattttagatttgagggcagggaataagggagaaatggataggaactggcagcacctgtcaggctttagacagacactccccagaatccagcgacataagtagggcctccgtatagtgggttctcatcaccacagacatccaagtagaagtaaaggacttctaaggtcctcagccctactgaatggcttttggccatctgtgactccgaagtggaggctctctcacagcacacagacgcctaatacccttccattgccttcagtggtggataggctttttacctgcaccatcttttagaaagaatcctaaatctttgattgtatcatgtttcagtacaagtactatttcattcatctcctgacttcagtcagtagcccatttattgtagcaatcatatacgacaaaatactagtaagattcaaaaaaactgtacagtcccttgggagcagactacaaagggattgaatatttgataattatacataaagagtttagggtagtgcttggcttaaaaaaaaaagcttactaaaaggttatcattatcacctctaccagtaaacatggtgattcaaaaagaaacttgtggatatgtgatacacccatgtgaataacttcatctataccacagcaatttcatgtactcaaagccatttttaatattgttattagcctttttccaatttttctcttttcccataaattctttccataaaactttagagattaataatgtagagattatataatgtagattattatataatgtatatataattttatcatgtagagatcattaaataaggagagaattttccactaagaaggccacttagggttttcattttcccagatagtcccagaccccattttactcctttgtattagactgaggacagagcggtcgccagtaagtggctgtacccattctaaagctcccaggcttctggacctccagcgtgaggccttggaagtgactcaagcgttcactgcacctacagccccttcgttttgcagagtatgtccctaagacagtgcttctgagccagcgtatttgaaaaaggggttgttactttgatgcattcaagttttgaaattcatattctttttcctaggaatgtagtttgaattttaaaatgagtgataaaggaaagataaatcagtatagcaggctaataattgttttttaaatatttaagcctataaactattttttaaaagcctacctggtaggaagatgggcacaggttgtagaaacaagacagttaaaggagcacaggaattcactgaagaagatcgcagtcagtcagtaaggtgtttagcttctctagtaatcagagaaaaggcaagttaaaataatggcatgctgttttttctatcacattgggacaaatggaaacaaatgatagacccgcttttaagaagggtttgagctggaaaacaggttttgttttgttttgttttttgtttttgagatagtgtctctgttgcccaggccggaatgcagtggcgcgatcttgcctcactgcaacctccacctcctgggttcaagcaattctcttgcctcagcctcctgagtagctgggattacaggcatgcgccaccatgcctggctaatttttgttttttgtttgtttgtttgagacgaagtctcgatctgtcgcccaggcgggagtgtagtggcgtgatctccgctcattgcaaggtccgcctcccgggttcacaccattctcctgcctcagcctcccgagtagctgggactacaggcgcccgtcaccacgcccggctaatttttttgttatttttagtagagacagggtttcaccgtattagccaggatgatcttgatctcctaacctcatgatccgcccacctcagcctcccaacatgctgggattacaggcatgagctaccgtgcctggcctaatttttgtatttttattagagacggggtttcaccatgttgttcaggctggtctcaaactcctgaccttgtgatccgcccacctcagcctcccaaagtgctgggattataggcatgagccactgcgcccagccgaaaacaggtatttatgagttcctgatgtgaataaactgaaagagcctgtgtgaacgttaatagtgcacgcacatcatttgtccatttcactcacaggtatttatgctagagaaatttttagacacatggacagacagtcctacagggatacccattgcagcagcatttgtaacagggaaaaattcaaataatttaacagtccataggggaagagctaaatgaactgtggtacattcatactacaaaatagaggctgggcatggtggctcacaactgtaatcccagcactttgggaggccgaggagggtggatcacctgaggtcaggagttcgagaccagcctggccaacatggcaaaatcccgtctctattaaaaatacaaaaaattagccgggtgtggttgcgggtgcctgtaatcccagctacttgggaggctgagaggcaggagaattgcttaaacccgggaggcagaggttgcagtgagccagcattacaccattgtactccagcctgggcaacagagtgagagagtgggactctgtctcaaaaaaaaatagcctacagcagttaaaggaaaaaagtagcttcaaacatattgacatggtaagttcaagatatattgttgcgtaaataagtcgattacagaataatacagagtatgacacggaatgtaaaacacatttacatatggacaggtgtgcatatatataggtagatgcatagaacaagttctaaaaggatacactccaaaacagaacagttgagggggaggagagtggtactggtagaattttatgttgtttgaattttgccaatcagaatgtattcgtggttttttttttccttttttttctttttgagagggagtctcactgtgtcgcccaggctggagtgcagtggcgtgatcttggctcaccacaacctccacctcccagattcaagcgattctcctgcctcagcctcccaggtagctgggactagaggcatgcgccaccacgcctggctaatctttgtgtttttagtagagacgaggttttgccacgttggccaggctggtctcggactcctgacctcaggtgatccacccgccttggcctcccgaagtgttgggattacaggcatgagccagtacacctggcctgtattcctgtatttttatgtaactaagaccatatcaagattgataagtaaatgaaaagtcagactattccccgtgcccacaccaggcaagtaaaccacctgttttgtttcctcagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggtaaggacatcaaaggccaggcatagtggctcacactcgtaatccagccctttgggaggccgaggcaggagggtcacttgagcccaggagttcaggaccatcctgggcaacatagtgagacctcatctctacaaaaaaaactacaattagctgggtgtggtggggtgtgcctgtactcagtcccagcaacttgggaggctgaggtgggaggattgcttgagcctgggatgtcaaagctcatcacatgtcaagtgagctcatcactgcactccagcctgggcgacagagtgagactccctctcaaaaaaataataaaccaggtggattagttggtctggtctttttttttttttttttttttattaaagagatggggtctcactatgttgcccaggctggtgttgaactggctctgactcaagcagtcctcctgcctcagtctcccaaagtgctggaattataggcatgaacaactatgcccagccaagtcaatcactgttaggtgagctatggctctgggcaggcagacatgcattggatcttgggtctgccttcactagctgtggtccctgagcagtagctggaatgacaggcatgaataaccacgcccagccaagtcgaccattgttaggtgagctagggctctgggcaggcagacacggctttggatgggtctgccttcactagctgtggtccctgagcagtagtccctgaagtgtcagcttcctcgttggtgaactgggaggaataacagaatctccctggtcactgtgaggattaagtgagatgatgcacagaagttacttcataccttacctgcctcacgagtaattcagtcaatgttgattctcttttttaaaaattatgttttttgtagagacggggtcttgctgtgttgcccaggctaatctggaactcctaagctcaagggatcctcctgcctcggcctgtcaaagtgctgagattataggcattagccgccatacccagccatgtttattatcttttaaaattatcatgaaacctgctaggctgttagagaacttcacatcgattatggaaaagaaatagatgccaattttaacacttggtttctggttctttatgtaatgatattgagttcccaaattgctgagtatatgagccactcctgagtcttgacttctgaatcctatgaaaggaatgacgtcagcagctctgaatcctaatgtcattgtgatccgtttcccttagattcccttagcctcagcgtgggtcacatgccccgcacacaaattcgcctcattacatttctgtctcttctcatcagaaatagggattaataggcttggctctaaacagactttcctcacagttggagcacgcctaaaatgtctcttacaccttgggaggtggaggggacagagagtaccattcatcagaaacaccccagccaccattaaaagtaaactaatagtggcacccgttgttgagacttgcctaaattgctgctcgcagctctttctcagtcacgccttgctagaatacgtttctgtgccagtgtgagagctacgtgctggggttctgtgatcagtacccgcttactcgccccattatttagtgctctgatagctgttgtgggatttggaaataaatctaaataatccaagcattgtggttttcacattgatactgatggctggggtgtaagaaatagggaaagaaggtaggaaatacttggtgtggtgcccagtatccaggacatgaggatgacgggaggagtctcgcctttcccctttcccttctcccctccaggcagaggggtcagcctcggccgctcctctcacacgcctgggcctatctctggtttcctgcagggagagggaaagcccgtggctgggggtgcaggcgctgttacatcctctgtgtcttattctccgtttaaaatctggtttgcctggttcgtctatcccgaggtttgacaaatgaacttctaaaataactcgtcaggagaagacttgcgctaacaagctgtgcgggggagggtgggaggccatgcagtcactgcgaggccccaccctcggccactctcccagcccgcccgtggtgaggagccgcccctgggaaaggccaggcgtcgcaggctgctgccggggttgcctcttgcctcattgcctcatctctagagtgttccctgctccggtgcagactgaacgttgaagcccaatgggtcttgatgaaactatagatctgattctgtcactgctttgcttaagatccctcaatggcatgatactgtcttctgataaaatgccaaactcctcagcttcccataggaggcctcctccgtgttggcctgcccacctcccacctcctgtgccactacagccccagcgctgattgaccggctcactgcctgtgccaccacacccccacccgctgattggctggctcacctcctgtgccgccacagcgccaccgctgattggccggctcaccccctgtgccgccacagcaccaccagtgattggcaggctcacctgtgccaccacacccccacccgctgattggccagctcacctcctgtgccaccacacccccccacccgctgattggccacctcaactgtgccaccacacccccaccggctgattggctggctcacctcctgtgccgccacagcgccaccgctgattggccggctcaccccctgtgccgccacagcaccaccagtgattggcaggctcacctgtgccaccacacccccacccgctgattggccagctcacctcctgtgccaccacaccccccccccacccgctgattggccacctcaactgtgccaccacacccccaccggctgattggctggctcacctcctgtgccgccacagcgccaccgctgattggccggctcaccatgcttgcagtccttaggctgcgccactctcccgcttcctctcctagctctgtcctctgcctgggcctttatctcagtgtggtggtcttttagatggttttcctcatcgccctgctttgtccgtgggttttctatgactgtgtgggtgcttcttttacatcagttactgatactgtagccatctgtttaataccaccccactacactgtgcgttccttggggttggggactttcattatctttgcatcttctgcgcagtgtctggcacgtgtgaatgggagatgttgaagggatgcataaaatatcttcagcactagcaggagtgactcctatagtcgctgtgctggatgctgtcagagagaggcagaaggtcccatccctcaagaaagctatcatagaagaactggtttatctcctgatccaaaattgatcagacttactccacagtcccctggtctgggaagatttgtaacatcttgattgtttcctttttattttccaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtgg

SEQ ID NO: 511 - DNA, 151887 bp, Homo sapiens
ttcaatcatgctgcttattgaatgcctatcattttcctggcactatgttaggtcccaaggccacaaaggtgaaaaagcagccacctttaaggatatgtacaatttagtagggatacctgatacctgtaatactaggtgacaagtgataatgaggtatattcaagacctaagtgttcctggggccagggaatgtttgccaggttcagtgagacctgaaagatgaagagatctgccaggtgaatgtgaagggcatttactccaggaggaggaactatagctcaggaaggtacacactgaaggcatgtttggagctagcttttgggtgacagcaacactcatacaagatttactacatcctgagcactgatctaagcattttatcaacaggaactcattagcactctcaacaaccctgtgggagtaggtactattattagccccattttgaaggtgaaaatactgacacacagagatcttaagttgcccagaatcatactgtaagtggcaagaccaggatgcaaacatgtcctccagtgatgggtgatggagtgggaaagatggtagaaaccagagcatgattttctggcaggccaagcttcttttctactaggtgatagaaagccattaaaattaattggtaaaactaagagaagagacagatgctgtcaccaccaagagacagacaatgaaaagatgatgctatagcttacaaagtcctaatgtgggggtggaaactggtagccaagagaaatttggatcacacaatatataacaatttttaaagatcagttgtaaacatttaaaaatgggaaaatctcttagcaaaatccagacttttattgtttcttgaaaatgtgctatactggcaaccgtaggtccatactgcgtggtggcaattcgctggagccaataggaggcccctcccttttggacttggatttccagtttgccacagacctcacccctccctgttataactctagtttgctggactcatgtaagcttccctccctcatcctattaggcatctgagatccacccttcgcccccaccccaccgactcagactggggcttagaatcttcctgtgtaaaatgaagtgtttacactatcagaatttctcaaactgtttggatgaaataaggccctgaggtgcttgttaaaaatataactttcaagagccattcccagaagctttagattaagtggggctggaataaggctcagaatttatttttcctgattcaagccccagaaaaagaaaaaattatatatatatgtatatgtttttaacaagtaattcaggtaattcttataagggaagtttgagaaataatgaatgctctctcggagctctctttacaaatctcagggattaggtagggagaagcttctacatggtcagtttccagtttcccttgatgttagcccaccaaaagggatgcatatttctctgcaaaaattgcagggattcccatgaagaggtgtaccagaaccatttgctacctggagacagataattttcaagttaactcaggtgatcactacacaaaaggtgggagagtctgcaaacagaatggttcttacctctccttgaaccgacagatcaacacacctgttatgtgctagacatggtgctaggcactttgaagacgagggagaagctgacaagcatgattaaaatctgttattgttatactatgagtactgctcagtgtcaggcacacagtaggtgctgagaagtaagtggggcttccagttttcattttttcttttttctttgtttgtttgtttgtttgttttttgagaccgagtctcactgtgttgcccaggctggagtgcagtggcacaattttggctcactgcaacctctgcctcccaggttcaagcaattctcctgcctcagcctcccgagtagctgagattacaggtgcatgccaccacacccggctaatgttttatattttggtagagacagggtttcatcatgttggccaggctggtcttgaactcctgacctggtgatcctcctgcctcggcctcccaaagtgctgggattacaggcgtgagccaccgtggctggccacttccatttttcttacaaccactagtactttctgcctttcatggattttcacattcattaattcatttgattctctgctaaagcaactgaggctcagagcaatcaagagacacctccaaggtcccatgacaaggaagtggaagaatcagaattttacggtgaattcagtcctcttgatgctaggtcagtctctcaaagaggccaaccagacagcagagattagactggggaaggatgaaactaattgaatcgaatcttttacttatccaataagtggggcagagccttgggaaatctaaaggagacaaaaaacactcaagggagaattctaagaattgtcttctttcatcttagaactgggaaagttctaagcatcattgaaaagttgatctttgtgtccctgcatgcttttatgctaatatcttttctagaattgtctgagaaagaatttatacagaaaagcagcaaactttcttagtatcatcacttaacacatgattatatcaccatattgtaatcatcttaccatcattgaaataagcactcagcaagaaatgggtcatctggaggtcttctgatttgattttgcttctttatataactgtgaaggacagggctagcaaaagataagaacaagagtacagcagttaagacagtggccgccactccaggccattgtcttaataccagcctgtaataccagcactttgggaggcctagctgggaggcttgtttgaggctaggagtttgagatcagcttgggcaacatagcaagaccctatttttgtaagaaagaaaagaataacaaaaatgaagaaaaaagacattgggttttagaggcagaaagacttgagcttgaatcctggatcctagctggaacttgggaaagttagtgtaactctcgaagcctcagttatttctcctgtaaaactggggaaataaacaaggcttatatcatcgggttatggtgaaaaggaaaggaaacaatgcatagaaagaacctagctcagttcctagaagcagtcaatatatgtaagctaataataattgcatcttccatgaactggtgattttctatgcctgtttatattccattaatatttaattgttctgtttgcaaattagttatataagtaaaaaaaaaaaaccacccagtaaactacatagcccaacataactgaattcagcaagacaccatccaattaaattatgttaattttcactaatctagtttcccctctccatttccattaacttaatttagttctttatctgtcatttaggctatcagaacagtttctgttcaaaatcaaggttgtgagaacataagtaccgtgtatcaagtactgtgctagagcttgctccataaagatgattgtgacacagttgctacatgcagtttgctataggaactataggaagctgacagacacacataattttcaagccagagtggtgtcacggcaagcatgggtatgcacaatgtgtgtgtgtgtgtctgtgtgtgtgtgtgtgtgtgtgtgtgtgtgtgtgtgtgtagggggtggtcaggaaaccttccaggagaaggtgatgcttgatgtgactcttgaagagcatttaggagctcattggggtgaggggtgtggcatgtgtggggctctgtggtgtttgttaggggattaagtatttaaggaagggagtggagaaaggcaggctgaggaggtagacagaaacagatcacagaggatgtaaatagggggtggggttggaggagagtgataagggtttggaatggaaaggagttgaagaactaataaaagaatagtgaataccaccctccactccctactccccacagaaattagaaacacgacctccagtttttcttcagtagtttattttccttgttcattctaattatcttcatgtcaagaccatgcttaaaaatctcttaccggctgggcacggtggttcatgcctgtaatcccagcactttgggaggccgaggcgggcggatcacgaggtcaggagatcgagaccatcccggctaacacggtgaaaccccgtctctactaaaaatacaaaaaattagcccggtgtggtggcgggcgcctgtagtcccagctactcgggaggctgaggcaggagaatggcgtgaacccgggaggcggagcttgcagtgagccgagatcccgctactgcactccagcctgggcgacagagtgagactccgtctcaaaaaaaaaaaaaaaaaatctctgaacaactacccttccccccatataattcagtacaaactcttggcctttgattatttgacccaactttccttcccagccttgtccacattctcattcccatacttccgttgcaaagatctctgttgctctaacactccaggcttccttagatcttggggcttttgcatacactatttttcactgctgagaatatcctttccctattctttaccaacaaactcctacttgttcttcaaagttcaactaatatattatctcttctatgaaatcttttctgactcattcagacagaacaatttcttatgatagcatttaccatattgcatagcaatttatctgtttatttcctactgcccctgcacctgttactcccactcccactatccttgtgttttctgggtttatcctaggacatacctaccacagtgctagtaggagctcaacaaataaataaatttctctttgttctgtttctataaaccaaacgcactgtcattcatatttaatgtttgagtgggctatttttctttttgtagttatgttttatgaactcataaggtgctactgacactttaagtttgttaaagaactttgctccttaattctattagtggtaggctgtcaatattcaaaatgcttttctataattcatttttccttaaaattctttatagacctgttgatgagccagtagctgaagtatcaggaggtgattctttaaatatcttttaaatacctataattatacacaacaaacccacgtgccctcctctggctccatacgctagactttggttcttctcctgattttcaattcaaggaggaaaatgtacaatgacttggggtggagatggcaagagggttgatctcctctcagatttacagatttatatacaatttaaagctagaggaaatgttaaaaattacctagcctaaatcttttttttaaaagtgaatggggaagtagaatcagagatcataagtgtcctaaggttgcacagtaaatgagtagtaatcagtccagaacatgcatttcctgattccaagatacgtattctttctcttacgtcacactggctaccctgaaaaatggttttctgaaagcatatccaatatacttttggatctctccaggcttctatttcctcatatgtaaagtaggaataataggagtagctgtttcctggatttgttgtgagaattaaatgaattaacagatgcaggccaggtgcggtggctcatgcctgtaatcccagcactttgggagaccaaggcgggtggatcacctgaggtcaggaattcgagaccagcctggccaacatggtgaaaccctgtctctacaaaaaatacaaaaattagctgggcatggtggtgcatgcctgtaatcctagctacttggggggctgagggagaagaatctcttgaacctaggatgcggaggttgcagtgagcccagatcttaccactgcactccaggctgggcaacagagcaagactctgtctcaaaacaaaaacaaaaacaaaaaacaaccaccacacccccaccaaaaaaaaaataaacagatgcaaaatgctaagaacagtacctagtcatagtaaatgcctgaaatatagcactgtttattcttaaggcccagggtattacactcatgattagtaaaggacttacttgtttaccttaccttttacttaatctaacaattaccaaagttactgtttgtttgttttcccttattcaaaccatactacaaatattaagatagtccatgggctgtacaatctgcctgggtgtatgttcttaggacccacccttttatgttgttggatctagcacaattttcttaacttctctgagcctcagtttcctcatctgtaagatggggttaaatcacatctactttcctttaaagagttgttttgaggcttcaatgggagaacacatgcacaatgcccagcctagtgtctggagttcagtgttcctcattgccttgcacagatgtctacaaatgttgacagatgttgcatggccagtgttgaaacgtacatacctcaccaaggtcggatctaaaatgtttatttagaacaaagcacttctagtgcattggccatgggaaaatttttcaaggttaaaagtagaaatgtgaacctgtctgctttacatgggtgattttttttttttcttgagacagagtctcactccgtcgccaggctggagtgcagtggtgcaatctcggctcactgcaagccccgcctccaggttcgcgccattctcctgcctcaccctcccgagtagctgggactacaggtgcccgccaccacgcccggctaattttctgtattttttaatagagatggggtttcaccgtgttagccaggatggtcttgatctgctgacctcgtgatccgctcacctcggcctcccagagtgctgggattacaggcatgagccaccgtgcccggcctacatgggtgattcttggagctgattcccaaaggggatgcttgtctttttacttgcttgtattgtagggcttcatgacaattttttccatatccaagtcaaaggcgtgctattacatacttatattttaaaaaatacaaattggcttactttttatttaaatctattttagaaggaaactttctatcacaacttgtgctagttctggttttcctaatacatataaaactacacaattagtaaaatgttaaaaaattaacatgtgtattacctaaatctcacatgccaacctttacttaaggtcggggacattaatgaacaagtccgtcagtgcctggcttagaggaggtagcactgcccacatttgttcagggagtgactgctttaggcttgccctagtacacaaatttatggatccatagtgcccttgtgatgtcacatagttggcgaatgtcttctgttaggaccatatttaaggtcatttagcggataatgccctcctatcactaagcagggtgtatgtgtggaggggtgggaggtggttggctctagagatcacaagtagtaacgtggggccggggcagtgactcacacctgtaatcccagcactttgggaggccaaggtgggtggatatcctgaggttaagggattgagaccagtctcactaacatggcgaaaccctgtctctactaaaaatacaaaaaaattagccgggcgtggtggcacatgcctgtaatcccagctacttaggaggctgaggcaggagaattgcttgaatttgggagggggaggttgcagtgagccgagatcacaccactgcattccagcttgggcgacagagggagactcggtctcaaaaataaataaataaataaataaataaataaataaataaataaataaaaataaaaagtatcattgtgcacatagatgtctcagctgcaaatctcttggacttacaaacctggcatcttccattatggatgtcaaccatttcagttaagtgctttcatcattcaatagattgtctaggaggatttaaagggtataggaatgcttcatatgtacaattaattctcagtgatgcctaaactttactatgaacttccatttctttgtgctaagtatcactctctccagagttgtatttgacagtgccagtggtcctccacaggccaatatattaattcatttgcacattagcataaatttacttggactgcattttcctccagggcagaaaaagtttttgaaaaaaatgggcaattgaggtgagggttcctttgactaactgcacgtcgcccagggctggcctaaagttaaacgaccttcatggatttaaatgactcagataaagagaaagtaattagggtaacagagggctcatctgaaggcaaaagttatttgctactcacagtggtaaaggggtacagtagcaaatatggtcacgctctgaaaacaagcacaaggccctagccatgccaggctgtgcaaagacagctagaactgacggtgggaccaggctccacaaagatggtcagaggttttttttttttttttttttttttttgagacggagtctcactctgtcgcccaggctggagtgcagtggcgcgatctcggctcactgcaagctccgcctcccgggttcatgccattctcctgcctcagcctcccgagtaactgggactacaggcgcgcccgccaccaggctggctaattttttgtatttttagtagagatggggtttcaccgtgttagccaggatggtcttgatctcctgacctcgtgatccgcccgtcttggcctcccaaagtgctgggattacaggcatgagccaccgcgcccggccatggtcagagttttaagccaacagattataatcctggcatagggaatgagggacaaatactcaaaagacggtcgcctagccccaaacaaggattatagagccccaaataaaaaggtttagagggaatatccatgtgtttatgtgtaactgaccctcgtgccagggaaaaactgatcatggcacatatccagaagaggtggaaagccccatgacatgcatctccacactgagttccaatcactacccgcaggcctgggtttcttgtccatgttaaggctaagtatacatctcatctgcctcttccagcttcattaccttcccttcccccatcttttaaaaactcacccctacccaatcccatccatcatccccaactctcctccactgagagttacaagaactttgtaatttggtcagaagcagtaaaaagtgcttgttagttgttgcctctttttcaaaaccgatgtatctaaatccttcagtcttttactagaaagggcccagggactgtcttttgcccctaccttttgtaagtgtggagtgctggctctcagaagcaggggccatctctgcagcgtgtccggttcatagcctggggcttgttggctgcctcccgcccttgttctttgatgattttgccctcccctcatctctgtgggaatcccagccctgggggaaggggcagaagaggaggcagggcaccttcagcaaacacatagtgaatatgagtcaccaccatctaatgacctttccatttgttatcagtttccactacctcagctagtctcaggatgggaaacagccctccacaggtcagagtcattacgtcactcctcagcagcctctctagctcccctgttggtttcaggataggcaagcaggataggagggcgggatcgggggtcttctgcacactggcttccagtcctcttttctcctcctctcatctcctcccaggacctcattccaacgcatactgttcttctctcactcagcccaaacatcaccacccttggaagcctttttagaggtctttgttgatgtggagctagtccctctttcctctgggctctcacagcactctgtgttcacctgagttatagcacttgccacatgatactacgatgattagtttacatatctgtcattcccatcctccttgctcagactgtgacatgggctggtgtaagtcttattcatttgggtgtcatgggagcctgactctcagcagcttgctctcaggaggtgctcagaaaatgttaactgagtgaaggaagggaaaggggaagagaaatggtcttttattcatttattgagcaaaacacaagtaggatgatacaatgaggcactgacgcagtacagaaagcaatggtgcttttaatgaaacttctttcaaatctgtgaacatgctagctgtgaagtacatgcttttattctttccataggacatatttccaaataatgatcacagtattatggttaataagatgctggacagatgcgtagccaaagaatattacataacaacaaaatctcatcaatgatatatcaaatgcaaatttactaagacatcaagagaatatctgtttgtagttacatggctaaaaacaagacattattacagtaaccaagtccataaaactagaaaaaaagcactgtataacaaaaaggccttttagaagctattaaatgaacaaacattatagataaaccaattttatatctgaagcagcttatagcaccaacacgttggcaggaccagcagaggggtggggtctttggaccaaggcatctgggaacaggaagggctctcagccatcatctactgcagccacttgttttacaaatggagaaatagaggcccagagagatgaagcgccttgtccaaggtcacacagcacaggacagactgggaaatgatccagggctatgatccaggccactgacttcaggtaagtgctctattttaacatacagatataagattctatttgatttgatgtattttttccccattaacaggtctaccataaaagaaagcaataaaacccataatgtactctggtattgtatttatttcactgagaaatgactggcatgtactacgatcattttgggggcctatatagatcttacatcaaaattcagaggaattagtcagataacactattttagttataaattgagaaggtggcatttgaagagaatatttggcacatcctccactacgtaagctaccctatgcctcaaaattactaaatcattggtataaagttttggtttttttcctgatagtttaaagattagtaaagtacaaaaacagtctaaatagagaaaaagcaagtcaggtctttcctttaaaagttaagtatggcacttttcattttaataaggtaaatgattttaaaaacctgacattttttagaagaaaaaaaaaaactagctatgagccatcacttgtgaaccatctggtatataaaatatttcccttatttaaaaaatgtttctgtaaaatacttcggagtcatgaaatcatgccgtggtcctgaggcctcaactggacagatttatgatgaactaatgaagatataagaatgaaaaaaagaaagagatcactgttaacagaagcagcattaaggacaaagtatactgaatatattgaaacagcttcatggaaatgaagccaagaagttgcatgtatatacgtgagaaagattatcattacagtggtagttggaaaaagtaacaaacactgggtatttgtctatcattaacataaaccaactgttgcagacagttaaactgtggctttgtaaggagaataaagcctgataaaaaaagtgacttctgcatatcatatatatgtatacatatattttctcacatagacgtctagttataagtaaatcaacatttagctacaacttttcctctcttgggtccagcatcaaaagatttgatattcatgaacatgccctacacctggttaggaagttatgtatttatactcatagcctttattgtatctgaccagggtgaataaaatgaaatctcctgggacctcaagtccatttcttaccactataagcatattaacagatatatatcaaaacatacttgtttactgttaggtaaaagagcatgtttcagtactaaataataaactatgcctgctaccaataacatgcacataatggtataataaaagtaatttttcatgaaaatattttgaaagaagctacattataaatatttaaagaaacgttaaaaatcagagtgaaaatcagattagtgttctgaaactgagtagaaaaatagacttataaaaaaaagaatgtctcattaagtgaagcattaaatgtaaagttgtctttttagtgtaaatttcaaatctcaccctttgagaggtaaaatcttcctctctcctaaacaggtacctataattgatttgggaactgggcatatcgcagaacgaaaaagcagatgacacaaggctaagggcagtgccgtgattttcacatggccttagaaaagcgaggggcattcataaggctgagtagatagcaacttggagaaatactgaataaatgtgagcagtttgaaaacagtaatgcatttgtccaccctaaatgagctaatactcaaagcccagacattagattttaaaaggggtttgctttccaggacagattgtacaaaatttgggaaaatcgttgtaaataattacttcctggggttgattcctttttgaggggaagtttttaacctttccttagtagttacttttaatgaactgaagaagaattaaagcatcaaaggcctagtgtatgatttgactccgaagtgaccctctcttctactttgataaagtcaagataccttattggccataggagattcctccttttggggctacccccatacctggaaattccaagagtgtgagggctatatttgggcccagaggaaaatcaaggaaccccatatccagctgctaaagcccttgggcccaaggagtgtaccactgaatccaaggctctcttgggtagcctatgtgcctcttggatggtatgtgaacaaggtagggatgaaactgcagatgtctgaaaagagcttaagcatcctgacagcttgcattttttttttaattttttttttcctcaccgtattccacatacctgtggctggggaaggtaatgttacctctgcaaacagatgctctggtaagagaagaaagacacagggaaggcagagagagcaagacagagggctcaatcacaaagctgggacaaggagagcagctgtttttcacacattcctgctcctctctcagctgggctcatgttcactccgtttcattccaatcatcagggtggagatttcagaggtgcctatccctaatccagtagagaacatgagccctgggagcacagctgcctggagtcctcccaagggtctcctccccttttccagactcagcatcattgaagccctaacgggtccttgtaaattaatgtttcatattatcgaaggactgtcagtttagtttggtacagtttattgtagcctaagaggtccagcaagatttcaagagaggagagatgattgcattacttgattacaatgaatacaatctttaggatactctttactttttgtacaataacgatatgaaaggaattttttattctacctatacacagctcaaaataaaggtataacttctggaactgagaaactgatggtatggagagagggacgttttcataagaaaatagctttgataagtgtatacacaaaggcatatatatatacacacaaacacccctctctcttatatactatacaggctggcacacgccttataaagaatataatatcaaggctttaggatttcaatgaattttggaattttaatttgacaggtgcttaggccatttaggtcctgacatatcggaatcccttgtatttctaaagtatataattatgtttttaaaaaggcccagatcaactttccttaaacagtaacccaacataaagccatagttaccaagtggaaaataagattgttattctgtattaaatcagtaaagggtattttaagagaaaggacaacttggaaaatagagacttcagagtccattattccaagctgagaacattttagttattagcagtggttaccaaataagctgaaggtaaatctcttcaaggagctgctcataatttgcgttgttgggaagaggcgaggagctgtttctctattccactataagatgatgcaagtttttttatccttgaaagggttttctgaagttggtattcctatcagcaaagggtcactcctggcatgttcctcacagtaggacatgaggtccgctgatgccttcgaaacctgacatggagataaatcaaacaaacaagaaagaaaatattttacttgcacactttcagagcgtatttgaatgctaggctattgaatggaagactgatttgaacaagataatcagagtctcaaagcatcactctcagattcttgtcaggtataaaaaggaaatggtacctttaaaatggtgcaatttggcaggtaaggtctttcttaaccaagcaacttaacaatggtcagacaaactggcaccatgtatcccttcatgggagtgctgaggacacaccgccagctaatgagctagcattcctgtccaacattgaactggagtccaatcagcgaacgatcacacccgaagtgagggtgattctgcaaaataagtggcctggattcttcaaaaatggactgtgtgtgaggtattcttattagataatcctgaactgcaaataactttcaagggtttaaagaagacattatatatgttttgtgtgtatgtgtgtacagacagaaggagggagagagacagtgcaagcaagtacatgtggtcaaatgttaaaaactggtgaatcctggtaaacggtttataaatgtttgttgttacaactcttcagcaggtttgaaatgtctcaaaataaaaagttaggggccaggtgagaaaaagcatatgtgaatcaagggaaggttgtatcttaaattctacccagaaaaaaacagattggaatgcagaacacactttaagaactgaacgatgggctcggagccaaaactctggagccaagttgtggagcttcaggatttactgttagagattgggcttgcggaagtaaaaagagagacgaaaccagcatgggaagaggcagtaccttactcccgcatgaattaaacacggaaaatatcatgccctgtttcagaagtctgggagggagatcctacagaataggatctctttgccctaagcaaagagcaatggggcagctgagccctgtctagcacagcccagatagcctcatgctgggaagacaggtgactatctccaggcccagaggaatggatcaagtgattgcttcagtttcttttttcttttctttcttttttttttttttttgagatgaagttttgttcttgttgcccaggctggagtgcaatggcgcgatcttggttcactgcaacctctgcctcctagattcaagcaattctcctgcctcagccttccgagtagctgggattataggcgtgcgcacgccaccgtgcctggctaattttgtatttttagtagagacaggggtttctccatgttggtcaggctggtctcgaattcccaacctcaggtgatctgcccgcctcggcctcccaaagtgctgggattacaggcgtgagccaccgcgcctggccaactgcttcagtttcaaggaagaactagtcataacattccagggcactcactgcctagttctctcttgggatttaggggaaaagacttcgaagtcaggtgatctaagaaatgcattccagtttctctatgggatctcaactaaagctcgcattattactctgggcacagaaagtggtcactgagggccaaacacatttaaaagcttcatttccctaaaaaggaaacctagactgctgacttcttacgtgaagctgcctcagctgcactgataattctagaacacttaaattccaaaggaatgactagggtgtttatgaagtctacttggaacccctgtcccactttagaacacagggatcaacggacttgaccatgttcattcaggggagacaggtccttaggaaatcctgtccagagttttacaaacagagaggctaatgcagacacttttgaagtgaggcccatgctatataggaaaatgaaagttaggattttgagactctcagcctgttctggaaaaatcctggaagcaagcggaatgaaatggtattatcttctctgacaagtggtccagccacaaggaacagggggaactgagcagaaagcatatgttatccagtcggggcttcttacctttattctttcaatggaggcttctaatcttaactgctgcacagttctccttgcctgggctatattgttggtgcttgctgttttgctggacatcttcaattattgtttttacctgaaatctgaggagaattttttttaaagacaagtaacaggcatctttaagttatttaaacattcataataatatgttctacttaaagggaaatagatggattttcctagtcatcacagcttcttggaggcagttactaaaacaccccttagaaattcgagtggtgacctaggtatctaagtttgtcatccatttgagcacctacataaatctttagtttgcagaaacccagcactagcagtttaatcgatgcaccccaacatataacacaaaactagacttttctaggatttcctaagaggaaacaaatacgcaaacacttgtagcacttaggggacctgtggcaaaagtgagcatttgctatgggaggcatattacatgtcagtttaatattactgctacctactttcacagaaggtttgatttcatttcttttgggctcttgcccccaactattaggctgatcaaagacttggcaacagaaaatgagaagagagctcctctagagaactttgaataaagggtgcttatttttagacactatcatgatgtggaatcgttttgaaagtgttaggcacataaggaagtctttattcatgaaagagtgaaaactttcagtggagactctccgtgatagatccactgtaaatgtcaggtgggatatatgagtagcctacagtctgaaataattaataaaacgttattattccctcctttgacctctccctggtctcatcgtgatggtctgggcacttgctaatcctattactccatcatatgttcgtggattgattctcctctctagcctgagctgttggcctctaggctgccctgctgccctctctccttagccacctggtgtaaagcaatggaaacagaaacatcctggcccttgctttacaaactggttgtccaatagcacatttcaagaggaaggcaggctgggggaaaagtgttgcctggtgccctgacctatatggctaagttcattctcatcagggtggcaactgaaggaaaacgcagggctggcaggcctggtagcagtgtggcagttttatgactcatgggagcaggtggacagtaggtgtgcctccccggcgctatgtgagggctcagcaaagtcttagggctccgtggcgccagcagcaaacccaggctgactcaaccttttggagaggctacagctgaataatgtaattctgccataaaggccgagaccagacaaagctgcaaaaaaacactagcaacccagactccagggcatccatcacgtgggcaccacggtgctccacactgagttctaccagacttagaatattcccaaaggccgagttctacgacttgggtagggcttgtagcctctgtggtcagaggaagttttgggtcaaatgcacaaataaaattgtgcttttaactgtgtgcaaaattttgaaatcagcctaataagcaaccttcacattccaaaggattttttggggggattcaatttaccgttgcacatcaagtgttttgcataggaccaaggcattccatgaactgcagctgctagtatttttatccttgggggtcacatactgcacagtgaattgcagttccctgtttacctgtttgttctgcacctccccaacaagtggtcaatgagcctcaagggttttgattgagcgggtatgggtggggctatcggcaccagccctttttagagtccctgggcaatttgtgccactagtgtcagagcccaatgcaaagactagtgacagccatcagaggatttccctaggaataaggaagctctagcagtacagaaaactaggaggatgaagcatgtggcagggcagggtgggcttgccttgtgctaagccttggacaagctcatttcaacacattcccagagtagctacctcttcctcggattcctcagtcatccctgccccacccaaaagagaggcctagggtctctctgattctgctcacaccgagtggcctggcccaatccctttctgtgctcccagaccagcacttactaacagagcctctgaaatgcaactgaggaagtaggcaacctcaccctgaacagtgtgcagtgctctgactcacagcaagttgcagatatatatatatataaatatatatatatttgtatatatatttatatatatatagttatatatatatttatatatatagttatatatatatttttatatagttatatatatagttatatatatagttatatatatatagttatatatatagttatatatatagttatatatatatagttatatatatagttatatatatagttatatatatagttatatatatatagttatatatatagttatatatatatagttatatatatagttatatatatatagttatatatatagttatatatatagttatatatatagttatatatatagttatatatatatagttatatatatatagttatatatatatagttatatatatagttatatatatatagttatatatatagttatatatatatagttatatatatagttatatatatatatagttccctgcagcaagtaaaactgggctccccttccaactggcgctggttctgaggcccccagaatgcgaacatgacaccctttctcagtgacctgtggtttctatgttgcaccctaaggactttctaaatgttccctttgcatgaggataaggtcaagcattctcttcttcccaatctccagggcataaagtttccaaggcctgagcaagttttccagtaactgcagaacagttcacacatatcaggactggaccagtaattgctcccacccggcatggccattggcaagcagtctacagtcagactctattaatatttataaaatgctcgggtaggtccctctaaagttggcgagacactcagcatttagtacatgaaggtctttcttacttcctgactatattatagtcaagactaaaaacagccagcaattcatgattcacacttgccagctcaggcttcttgcagctttccctcattctgatatctgcgttcagacctgcttcttcagagggctttctccaacctcgttactcagaggctccctgctcccttccaatggggtattcctgctggtcccaggctcgacaaagtccatgcaacacatttttaattgagtactactgctactaagtacaatatgttgagaataaatgggtaggacaggcacacagctcctgccctcacagagaaaacgttaaacaagccattagacaaccccttctgcttcaggcatagcctagccccttctcctgctctgctacccctctcaggctcctaactcaatttctcttctgaaagtcccttctcatctgctggtacaaacatggatagcctcacccagaatacaaattaaagtttaggagataggtaatttttacaccttcatagatttattaaacacaaacaactttctatgaatattgtatagcaattgctttgggaagtcgattaaatgggggtaactgtgattgcaggggaatgaaaaatgacttccctctacctttctcagttctatggctgggctacaaattaacctgacatataaacaggttgacaggaggaaaactgtatttaattatgtatgtacacacgggagtgccacaaatatgagactcaaagtggtcagatgatgaaagctcacataggatcctgagctacagaaaagaatgggagttcagggtttctcgggggggtggtggcaacgagttatgggaggtaaggggaagagataaatggtgaataaaggtggttttctcatgcacacagaaattctcagttaatacaagttgtttcacagcagccctcggaagaagaggtgacagtctgtctgggtgtggtatcacctccagtctcccctcttgggatccgagttaatctttcccagttgataagatttctgggagaatatttgtgacaactaagttccttttggaggatctgtctttaggccgataaggggagctcagagaatgcctctgcctacatctgctgttccccaagtgtcctcagttcaaagtaatcagcacaccaaagtgttatattttgggtggcatttcctgaactccttcatggtcattcttagaaaaagctgtacactgggccactggaaaggaagataatttctgatcataacattcttcctatggagaaagcagatcaaaattagaccgtttcaagttaaggagcctctggtttgctgagttgccacatggctgcacaaagagggccactgtgtgatccctgagaggcagaggtgtttacaggagctggagttctagctaaggacttccttccgacttgcagctgctctgcagctcctcaacagctgggctgtgcacaacaagatagaaagcctggggaaacaaatatctccaaatatctctgtgcctttggagggttttctttggtcttccctcagtggtgaggatgtctggctgttttttctactaggtagataaaaagcttgctttattcttacaccaagaatagcttccaaggcaaacaatacctgatatttgtatggaacctgtgagcacacatgttgcttgcatatgcattattccatgaagcctcactataatcctgaaaggtttcttattagatgaggcaatcaaagttagaaaatcttgcttcaaaagttaacccaggctgggcacgatggctcacacctgcaatcccaacactttgggaggccaaggtgggaggaacacttgagtccaagagtttgagaccagcctgggaacatagtaaaaactagtctctacaaataataacaaaaataattgccaggagtggtggcacatatctgtagtcccagctactcaggaggctgaagtgggagaatcgcttgagcccaggaggttgaggctgcagtgagctgtgatcataccattgcaccccagcctgggtaacagagcgagacccccatttaaaaaaaaaaagttaacccagttcgtaagccttttcattctagaagccacccttcccactgcgccaaggaaaggattaattccaattagtttgattcataaacactcagggcatcagtgaatgctctaccatgtggttcttttttttttttttcccctctttttttgagatggagtcaggcacctgccaccaagcctggctaatttttgtatttttagtagagatagggttttaccacgttgaccaggctggtctcgaactcctgacctctggtgatccgcctgccttggcctcccaaagtgctgggattacaggcatgagccaccacgcctggcccactatgtggttcttaatcaggggtgactgacacgcggtgacctaaagtagggggcttgctgattgccttgtgtttgtgtaacacctcccttctcatgcatgcaagctaaacaagacagtttcggctcctagacaaggactgaagttagcatctgcagatcttgagccaccaagtattctatcccacccagaagggccaaggcctgtgcatgcctgtgcagactgccagtcggataacactctggctatcacttctgcagccttgctttcatttttgcatatgggtaacagatttgaataaacacatgtagtatttagctattcaaatacttcgcattggttttaatgctgtgtttcatctgaattctcaggttcctagaaattcctaggaacatgatggtccattagggaaatatgggtattttcatctttgtcaagaggggcctgaagcagggagagcagggtggggatggaaagagtgtcacagagcacactctgggaggaaggcaccaggaagccccagggtctgaatcacaagccattatggcctggccagtaattgaatcactggagtgaagccaactttcatgagcaaacacacccatgtggctgtaataaaagagcaggttaaaagaaaaaaaaaagccactggctcccacttactctctggtcttgccttcaactttcaatgtctttctctagctctttatctgcctcttcttctgtaaaagagggactacaatgcagacctcatagggttgtcaggggagaaacagaagcaccttcccttgcacatacaaatgtttactaaatgccggcccctaggctcactaacaagatgaaaaacatgtgcttggtgggaaatgaaaaagattccagaaacaacagaagaatttcaaggtaatgtgaccaggtagcaacagctatctaatgtggccttactgagtaggcagagttaggttcttaagaatagttcctctattttcatgagcagttcttatttatatcaaagcctgcaggctaaatccaggctgcagatgtgtttggttgggccccatacagtgttaactccattgtgtgtgtgtgttttaactttaaattgaatgtcaacgtttgaaaaatggagagatttccttttaaaaggaagacttctggaaaaatcagaaaatcctataaaactgggctggatctgagcagcagctgccccttcaagcatttgctggtacacctgccaggccctctatttgaacttgtggcactgcctttacactatgccttggatatttagttccagggacacattcagggattcgccgggggcatctgggctcactcccgtcctgccacttcccagatctaaggccttgggagaggactgataacgtatttaagcctcagctttctcattggaaaaatggggataacaatactttcctatctcaaagaactgttaaagagcatcagataaaataagtatgtgagtgtaataaacacaaaggatacttggtttccgagtgtttagtatctgcatcctcttacacactgtgtgaagtacacccagcactttgcattcctcaatggactggagccaggcagcagttctaccctcctcctagcatgcctcactggactgcggggctggaaagtggaaaactacatcttccagtgggatgggctgaattgtgtcccccaaaatttatatgttgaaatccttacccccagtaattcagaacatgactgtactcggagacagggtctttaaggaggcaatcaatttaaaatgaggtcattaatccaaaatgattggcatccttatgagaacgagaaatttggacatagatggggacagagagaagaccatgtgaacgcagagggagaaaacggccatcttttgtttgtttgtttgtttttgagatggagtttcactcttgttgcccaggctggagtgcagtggcgcgatctcggctcactgcagcctccacctatttcaagcggttctcctgccttagcctcccgagtagctgggattacaggcacccgccaccacacctggctaatttttgtatttttagtagagatggggtttcaccatgttggccaggctggtcttgaactcctgacctcgtgatccacccgcctcaccctctcaaagtgttgggattacaggcgtgagccactgtgcctggcctcgaccatctactaataaatgccaagagtgaggcctcagaagcggccaaccctgccaatgtcttgatctcagacgtctagcttccagaaatgtgagaaaattcatttctgttgtttaagccccctggtctgtggcagtttgttatggcgttcctagcacactatcacactcaggttttcttgatgttagagctccagatgacacagtctctgtcaattcaatgcgtttaggagcgatctggcaggtagaagtgaggaggccagtttcttgatgcttgggttatttctgctgacaagcagggtggtgggcaagctgctcttagggcaagtggaggcatcatagtgtccagtcactagcaacacaggactgagaagctgcatggctgcagcagcctcttgagtctctactccccactgggcacccgtgggcagttctgcagtggtgtcttggagttgttcccagggactgtatcgtgggcctgctcctccagccccttccaatgattgtacaagcacctaattctctttattgaagctcattctgctaactttgccaagatcaccttctgtttgctgtgactgaaccttggctgattcacaattgttaaatctgttgctttgtaaactgcaaataacttataaatattagctattatttggattattaccatgccatcattgctggacatcccaaactctaaaacttgaagggaggaaggagttaagacataaaattctttctctttctccccaaagttgcaggttatgaggccagggtgcttgaacctgcggtcagctgcaagtgctgccctggtctggcatagttatgagagcaaagagcaaaagagaacatgttgctggcttacaggcaaggcaaatgagagggagagatgaggaggggctgcacagagaggtgggaaatgtggtttcgggtagggaagacagagtgtctagagctttacaaagagaagtttacataggttcacaatcagcagaatgagaaagaatgagaacacctctctctgaaaacctcaacagagctcattctgtaaaaacagcaggctttcagatttggaaatccttttgaggtccctatctggtgtctttcattagttgattttatctgccatccagggtacatgtccctgaataataataataaagataataagttataatgattaattttgacaattaccaccatttactgagtgctgagtctgtgccaggtaagtaaattccatgcagcattgcatttaagtctgtcaacaactctaagagatgaatcctattatttctgtttgacagatgaagcagagagaggttaaaaaattcttgcccaagatcacacagatttacatggcagagactcagggctacctggctctcaagatcatggtcttacttaccaccctttgttgcctgcctctgaacagcaagaatacaaggaaggggctgggagaaaggagaggccaagtatcagccagaagcactgaatacagaagacatggcctccattcaggggttgctgttattcagacaggttatccccatagcaaatcagcaggaagcgtgaaggcaagtggctttgacagaagacccaagcgaaggagaatcaattgttcttatttctaagaacaactgccccagattctacataggaatattgctaaagacacaagatgattctcctgtgcccaagagaagttggcaaggatccatgagaatgagccaatcctcggcaataaatccagaggagagtgagctgcagagcctgggcagcgagttcctcacttcactgtgtgtctagaacacctggggcacttgtttaagaaagtctgattcagtagggctggagaagggcccacagatctgtattcaaaggcctcctagatgattctgatataggtcctctgaagaaatggcttatggtatgatcagagtctccgcctcttgatcctccccatgtttattcctgcctggggattaaaaaatgtcaatttaaaaggacactactcggccgggtatggtggctcatgcctgtaatcccagcactttgggaggccgaggcaggcagatcacttgaggtcaggagttgagaccagcctgcccaatatggccaaaccctgtctctactaaaaaaaggaaaaatcagccgggcgtggtggtgcatgcctatagtcccagctactggggaggctgaggcaggagaatcccttgaactcaggaggcagaggttgcagtgacccaagattgcaccattgcactccagcctgggcgacaaagtgagactctgtcaaaaaaaaaaaaaaaggacactactttttttctgtgcttaagttttcaaagctctgaataagcaaaaattctaacttcttttaattaccttaacctacaggattaagtgttcttcagactgaaatttttcttaccatttaacatacttctttgctacaaaagcctgattttgttaacagccattgctttctgaaaagcatctcctccctggcatcagtgatgctagactctcctgttcttgccctgtccagtgatattcctttggtacagctctcgctccttctcctgagtaggtattctcaggggctggaactctagcacagtgaacatgtgcttttatagccagataaattcaaatcccggctcatcacttattacgctaagttgctgtacttctctgggcctcattcgctcatttgtaaaatgggaaggaataacaatagtacttaccttaaagagttgttacaggatgaactgagagagcacatatgagttgctcagcacgtgcctgacatgcactggtcctcaggaaaggcagatgatgctctctccaccctatgacttcagctatgaccaacccacttcacatgcagccctgacccttcacctgaattccaatgtgtaaatgacagcctgtttaattttaagcttgaatggtccacagttgcttcaaacacaacacaggtaaaacccaatgaaacaccaccgtctaccctcaacctgaccaccactgtcctggtcacagaggcctccttttgcttctgccctctttctaactcctcagaccatctttgtcctataaaaatgtgagccacgtatgtgatttaaaattctttagtagccatattaaaaaaaaaagtgaaattaattttatttagcccaatatgaaaaaactgatatgtaatcattgtaaatattattgaaatgttttttgtactaaacctatgagacctgataaatattctatacttgcagcacatctcaatttggacatgatagtggctgccttactagacagtgtgacctgaaactctggactctgaaaatcttaaattctccactttgacaacccacccccacccccaacccattttaactttccccattctcctgtcttctattttacctgagtcttggctctctgcagctcaggtcagggctaccgcctgagccttgtaacagcactcctgcccctaatccttcttcaatctgatctaccctgaccactatgctcagatatagtacccctttcagtttggtcctctctggctttcccaggaacccccaggaaaagtccaaagggcttggcttcacactcaagatcctctctaatgtttttgccaccataataaaaatcctaataataaagcagctaatttctacacagagcttactatatgcccatcaatgtcaatacattatcctactgaatcctcaaatggccctgtgaggtaagctctattttcatgcccattttacaaacgaagaaactgaggcacagagaggttaaatatgtgtcttgtgtcaaacagctagcaagctgcttggttgggatttgagaccaggcaggctgattccagaggcccggtgcagaacctctattgctatactgtcatagtatcaggggagtgttaccccatttcctggcttcatgggctgtgtttaaagtctcacctgcgagcctccactccaattctctgtcttcttctcttgacctatttaaattctccttttgtaggccctagttcacatcacctcttccaaggacggtctgtctccctaattaattttgtttatagtaattaattcccttcatgaattcctgctacatgcttacatcttatgggttcaaggattcctgagggtgggtcatgaatgcaaaaggtgggcatggggagttgtgcactaatgccctaaaactgtatgcaaaatctggtgtgtgtgcttatgttttgcttttttttgttttccgaaggacaagatttatagccaccgtcaagctttcaaaaaggtctataacaccatttatttcaatggttaattgtatgttatttagtgcctactgtgtataaatattgtcttcccactgttggcttggtaataatatagcaactacacttattcattactatatgccagctactgtgtcaagtactctgtgcagatactaattcatttgatattttctgcaactataggaggttgggtttatcatacctactgagatcaaaagctcaggacagttgcataatttgcccaagatcatacagctattacatggcagaaagaggatttcaacccagatatctgactttaaagccatgccctaagcagacagctgagttatcccatgccatcttctctcatattgactaatgtggagaatgaggcctcaattaaaactggattagattaagacatgcgatgtagcaaccaacacatcagccagcctgagtctcgcaccctgggtgtttgcgtgcccagtgtttgttttcttagaaacaggatacaccttgctgctccttcctacaagtatcccgtgaaatactgactgttctgagcccacagatgctcacttgcttggtggcctgcacagctctgagaagcctgggtggagcttctgatgtttccatgcatttgattagggccagttgctggtgctctgaactttcacctccagcatgagatggccacttgtgtggcaccaagattccaagggaccatgcacactcatcctgtgccccaaataagttttcagctggtgaaggcgggcccatggggagtagccctcggatggggacccatgaaggagtggaacttagccccttctgtgctctgctggaccagaatccagtaacacacagacatgtgtttacagtcaacactaagaatgacgtttacaaacaagttttactctctaactagtatagcaagacggctgacaaaagatttgctgatatctgcatggctggcttaggagagccagatatctcatgtgcttatccataaatgaatagatgaatggataaattcagcaattatttaatattgaaaacaaaagctaacatttagagtgctttttctgtgccaggcactgtgttaagggctttagataaaattattttatttactcttcacaacatccctgataaaggcattactattattcattaactagttttcaaattctaaaagaatatatacatgagcaaataatttaaacagtctaaaaggttatacgacaaaaactaggtctcctggtactcctggctttcccaggcaacaactgttatcagcttttcctgtttccttctgacatcccatgcatatatagacatgattatgcttatatctgtctttaaaaatagaaatgggagcatattatacacattgctctgaaccttgtctttattttgattaataatatattcttaagaccatggtaaagttagttttattaacccattttccaagtgaagctctcagagatacctagttaataagctccagggctgacatgaagcctggtgctcctagccatcactccacactgcaggcctcctgcatccctcagaaagcttctgagcctgcagagaggaagtgggaatgatcagggaagcagaagaaaaaaattcctgccctaaaagaactcactgcttttaggagcaaacaatactatatgaagtgagagaatatttccaaacaacttaagaatatatccaggacacaggttcacagtactccaaggtgctaagcatgtgtgaaggaaggagccccagagtggagtgactccagcaaggaagtccgctacagctatggttctaaacgcgtggtcacaccagccagcagcatgagcatcgcctgggagccccttagaaatgcaaatccacaaaactcatcccagatctactgaatcagaaactctgggagtgggcctggcagtctgttttaacaatccttatgaatgattttgatgctccctaaagcttaaggaccaccccactagaaggaggtaatttctagatagagcttttcaacagaaggatgatccagctatcaagtaaattagcatcagtctatttaagccaagattgatccatattcttagcattatcctaggactaagctgagaatgggggatacacagacagaccctacatcttaagaaggttattcctggcaagggacataatatcaatctgcctaagaaaagaggcagaatattccaaattccctggttgagggctctacctcttatctgtgatgaagtggtctgtggcccttttgatacctaaacccagacaacttgtaattccctacgtgaccaactgggattccttcccatcagcattcctgctctctgctcccctggctgagcagggctggaggttgtctgaaatggaatcctttaccctggatattgcccacaatgtagctaatctacccccagttcttggtgggctgacaaagcagaagaacacagaaagaacaacagagatatttatgattctagtcttaaagccctagcatctgacccacattaagaagagggcatgctttctaatattgctaagcaaataggagctcacccacttccttagaatgcacttaaaaaaaaagaaaccgaaaagcccaaacacctgatgggagggttgaaaatgaggcaactggcacatggtgctgcatccattttaggagaagagaaattaaattcctagggagccattcctctgtgttgagttgtgtcagcttcttgaaggggcaggagaaatggattcaggagagaaaaaggctgagaaaggacagagaagagtgtgtacagctcgctgacatttgcagtcgccagctggggctgggcttcaccaacaaacaatgaatgtgggcgactgggctggtggttaaagggcttacaactccagcacgatggactgagtcctgcacataaataaggaatgtaagtgggtcagtaaaacatgccaaaggcaagcagtaggtgcttagagaaaggatggtcagtgaggacttgagtagccagaagacagatggaggagagaggtcttaaatgagtcaatccttgaagggtaggaacttgacaggtgggggtggggagaatttcaaaacagttactgaggggagtggtagacagcagattaaagttaactttctcatgtggaatgggagccaccaaaggtttctgagcagaaaaagcaggcataagggaacactgtggggaaaatgattgagcaacctcctatgcagggtggaacagaaatgggagacagtgaaagacaaagtagactatttccatacaaggttcaggagcaggcaacatggtcagggcttggggtcagatgaaactgggttcaattgggattctgccacttaatgttgtataatattgaacaaatcactctccctgagccctcagattctctatctgtaaaacaggataacaagagtgcctatctcacaggactgtaatgattaaataataaagaggcagcacatagaaaccacccagtgttcatctatctatcaaacatcattattattaggagttagtgcatgagatttcaaacagatggaagcaattacaatgcaaaaaattttttaaaagctggatgtgagagctgtgaaaatgtaagaatgaataagactccattcttggggctgaatgggagtgacagcccagaaatggctgttgatttccaaggggtgcatgaagaaaagtgcagaggatggctttgagcctttctcacttggatggggatagtagggcagtttcaaaggagcagagacaggctgagggaagccaccctggacagggcaacatcctcacaaaaggtagggaaacagagggagtgttagggaggaagggtaagttaatgctgtataaatacgtttagttaaaaacatattataccaagaaaacagaagaatgtacttcaagatgtagctattgccaggttgtatgaattttaggggatttttagtgttgttttctatgtactctggtagttgtgagtttttcattttttggaattaagagttaatatttatataccacttacacttgccaagcattgttctaagggctttacagatattaacttaattttcaaaacaatgctatgaggttattcccattgttcttcctagtttagaattaagggaactgagggaggcagccacttagaacacggccaaggtcagaaagaaggttaatggaggagtcagcactctaatcctggcagcctggctcctgattctatgctctttaaccacatatgatacttttatgattaagaaaagaaaaacacctagtaattgttattcacaaaaccagggggaggagttattagtcactttacggggtaaaaggaagtagagggcaagaacagctcacagatgactgggagttactggggactgctgagtagtttccacagcttgaagggaatggaggtcaaatgataaggggctgaacacagaactattaattcagggaccaggcagtgactacagaggaatatttagaaaaatttggcagtgtagtcaagacaaggaattgtatcgaaactttcaggggcaggagggttgtttcagagatggttggcactggagcatttccagaaacagaggaggagagttgagaaactagggagagtgaagatgtgcaaagagggtaactgagagggcagaaggggatgagctcaggactgcgctcagaaattggtcaaaagaggagctgataaaccagaactggaggatacagtggtggaaaagcaggaaggaatgaactgctcatacaatacaggtgaatctctcagatattatattgaacaaaaaagccagttatagaagagcatgcactgtcaattccattcgttcattcgagacgaaatctcactctgtcgccaggctggagtgcagtggcgtgatcttggctcactgcaacctccgcttcccaggttcaagtgattctcctgcctcagcctcctgagtagctgggactatgggcatgtgcttccaagcccggctaatttttgtatttttagtagagatggggtttcaccatgttcaccaggctggcctcgaactcctgacctcaggagatccacacaccttggcctcccaaagtgctgggattacaggtgtcagccaccgcgcctggcccaattctattcatataaagttcaggaacaggcaaaatgcatctacagtgatagaaactataagagtacagagtgggtggggatatggatgaagaaagactggctatgagttagttgttaactgctgcagccaggtcacttcaacaattaaactgcatgaggttcattctacttttatatatgtttgaaaattaaaaaaattaaaagtctatagtcctaaacatgtcataacatattatatgataattaacattatcagttatttttatcattatttgtcatgaaagaatggaagacacgttaattattatctacaatttccttctttagatcatgatctaacaagtatgtccaatgtccacagcacaaaggaagcagctgccttttgagggagcatggacaggattaaaaaagccacaatctgggccctctgcccatttcacacaatgctcaggctctgggtcacagacatccaatttttacttgccaggaagcatcattccttggaggtacgcatgaaaaaggaaaggcccaacattgtggtgcagatactcctaactttgacatgccaaaaaatgcaaaataggatacttaatttttctttcttccctcatctcaccttctcccataacacgctagcaaggaaacatgccctcaccaccttttaaacatgtctggatttgaggaaacatgtctgtcaaacatgtctgtactttgaaaaaggtcaaagtctgtggaatttctggggtgaccagcaaggtgaacattttgtgttggccctcatggttaaagtacttgttttgagactcacagtatctaaatgtttatatattttcaaaggggaaaggactgatgatacaagatgttcccaagtcaacttctgacagttctaactcattccctaaattgattagaattctctctctctaaaagcaaacttgataacagcttctttttaaaagtgttacttgagggaaaacatgggacagaaatcaaagcaagccatttaaagtccaaacccaatcagcaacatcaatacaatttacataacatggcacccatacagtacgtttatactttagttcactgagttttgtatttcagaatgtctccagttcatcttaaggagtgacataaaatttctcagaaatattatttcaagttcattaaaatttttctttaaataggtacagaacttttaacatatgtggttgagtcaaacaaaacatgacggagcatcacttacaacaaatgaaaagatgacaccaatttaaatactcatgttactataaacaacttgcttgttaagttttactcactcaaatttaagaatatcacaaaatgagagcatgaagtggaatggagtaggaggattcctgtctgtaatccccctaaaagaacttccacggctaatttcagcctcaggtttcttgggccagacctatttgaaatattctgcttcttttggtatatcagtaactgaccaggccatgggtcccaagcattggctttttaaaactatagtcagcagacttttcacaaatattgacatctacttcacccatgagagtctttaagttgaatcctctatctgatggtgggcacctcatattatattgtgctttatatcttccatatgcaatacacaaagaataagtatgtgctgatttatcatgagtcacatggatggtcttggcaggaagtgacagctttgtcattctttttcataattcaggaaacacaggaacaacatatgccttgggttgggcacagagtgagaactcaataaacacttcatccagtgaaatgatgacacagaaatctgtggcagtgctttagttgagtgataagggcttgaacccaatgtgtgaaagccagaatttatgaaacaaatgagatgatgtcacattacaaaaagattcctcctaagactttcccaaatgtattatctattgaatgaaaaggttaagtcagagaaactaattgtttagcttttttctagttaaatatcaattaggaactgtaatgcacatctctaaatcaaaatataacatttctgcacaacatcttgtgtgttctgagtataactctacttaagttcccaaagtacattactagtgcatgtgttctcatcattcttgtacttgtgaaagggagggtgatatagactttggttttaggatacccactacctttggtttcaggctacccactacctttggtttcaaaagccgctcctcttctgatgtctgttcttggtgtattaaggacaaatactggaaattatacatgtgaccctgcaagctttggaaagaaagaagtgcgccaagtgcctccattgcttaaatctgcctgtgcaggtcaattacttaaagtggagggaaatagggctgcgtccaagggtaattcatcttatgagtggcactgggcataatatacactttaaagcaaatcctaacaggtaatacaacaatattatgccttttatttacttacttatttaattgcaaagttaattaaacttttctagcactcaatgggtccagggattaaactcctgggagagatcacaggagaccagtatttagttgtctgtgaccaaataagagtttcagaaagttgaagcaaattctatacaaagtctgttcttggaatgttttcacaagtgtgtgagattctttgaaacacttttatgcaaaatgtaagtcaaaataaatgacatgtgtttatattacatgtagaaattataagattgattttggtagattgaataaatacatgcatataattcttataaacaaccattacctgtcagtgtcagcatttacaaatgagcagatccggcattcgcatgatctctggatgcatgtgccttcatgagctggagggctttataactgaaaacgattcccagctgaattctgggaaaacatacctatgtgtcccatgtagatgctgccacatctttgtatgtcccttctgcctttacccaatgtagaaatctggtattgtatttctaatgtggtaagcctgctataataataatgccatcaaaagatagcaatttacaaggcgctttctcataccatctatattagatagggctaattaattacttaattttatttgcatttctacttgtggtcttgcatgaacctgttgaatttagcatgcaaatttatgtgataagtttttttgcagttaattggaaaaaacagaaccttttgcctcattaagaatcctgtttcttagtgccctatcagttgcttctcctctttttagtgtattttcacttctaataattccctggaccttaaacagaggaaaatattgtttttccccttttaaacagaaccatttaatgacattttcttagaagcagatcatacctgcacttaagaggtagggcaaaatgaaagacagaaatcacaaagccaccagaagatggatccctaacagggctgcctttcagaatcacctgggcagctcttttcatgcatccaggtgcaagcctcaccccgtacctccagagtcagagtatcagggtaggacttggcaaaagtgcactctggaaaagctctggatgagtgtgagctgcactcctagttaagagccatgggactagaacacagcagaactgtcagtcacaatgcatggtctccctgattgctctgtctggtgccttgttcgagtcacttctttttctgggtctcagcttcctcgtccccaacaaaggagaacaacagagatattctgcaccccttgtttgcttctctctggatagccctcccttgcttgctcttcagaactactcaagccaccaatttaagcttttgatacttatatgttatcataatgatcaatacggggactgtaaatgtcactagggtgaaccttagaggtggcacaacagctgcatctagtgcctgacagaaatatgcacacggggaagggagacgggtcagcagttggcagcttctgaagccccaggagacttcacaattggggaccagcttatgggagagaggcagggcaggacagctttctttaccaagggagctctaaagcagaaacacattcaggagagaaaatagtgttaatgaatgtttcaagaaaataggcccccccacacagaaacccctcctttagccagaatggtttggggaagggtatgacagcaagttttctggttgagttaccatgtgcaaaggcaccactgttggtagttcaaagagaaatacacagaaaacctggaacataagtgacagttaagaggtacctctgtgaaatttcatgattctagataatgctgaagaactctttgaacaagtccatcttttggcactgatactgctaccctggactgctctcatttcagatcctggccctcccttgggcacgttcttcacatttctgacaggtgctgccccatgttccgggctgacatctttcctgctctgagtgctctcaactcagttgtccttgaagattttgcccgagtgcatgttttttcctcactttgtcatctctcctctcatccacctccaagggcttgcagaggactcttagatctatctatggtcctggggacctgtctgtgagaccccatcctttcatccagacggcctgccaggtcctggaactgaaaaagtcaaagtgcccttcctctacacaggaggccagttctttggactcagcttctctctctttctgctaataaaatagcttttattacagttatctagactcaaaactttagttctgtttctgagaccaccacctttgcccactcgcaaccagaggtgattagccctattggttctattttctaatcagcacctcccttccgagtcccctgcatcaacctttcactcaggccctcccttgatatgtgttgggagatgatggcaatggccttggttttcttggtttcccttgtgctctattctaaggcttttaatccatcagactgttggcaaaagcaaattaaacaggtatgagccagcctgctctgttggaggttgtgtgggaaaggggtgctcagagcactactactaattggctttccattctccctccccagtggcagcctccaagggggctccgtggattcccagggcttcctgagataatttgaaattgctgctgcaagctaccatagataccacagccagatgtatcttcctaaaattcagctctaatgatattatcctcctcaaaaatcaacaactggttggtgggaatgtaaattatggcagtactgacttaggtattgccattctagtcctaggtgtattcccaacagaaatgtgtacctattttcaccaaaagaccaggtattggaatgttcacagcagcactattcaaatggaaactgcccaaatgactaaaatgagaacacaatgagtcactcaatagaatattatatagcaaatggcaatgaacaacctttaaaaacacataatatggatgagtctcgcaaacataaaattgagtgaaagaagccaaatgtaaaagagtgaaaaaggagactgggtgtggtgacttacgcctgtaatcccagaactttacaaggtcaaggcaggcagattacatgaggccaggagtccgagaccagcctcgccaacatggcgaaactccatctctactaaaaatacaaaaaattagctgggcatggtggtgcacatctgtagttccagctactcgggaggctgaggcatgagaaaacacttgaacccaggaggaggcggaggttgcagtgagctgagatcatgccattgcactccagcctggtcaacagagcaagacgccaccccccaaccgcccccgcaccgacccccgccaaaaaaaggagtacataccatataagtctatttacattaggtactaaaaacgggcaaaactgatctatgctgttagaagttgggatattggtttcctttgaagggaaaggtgggaaaggaaatacaaagcagcttctaagtgctggctgtgtatttcacttatggttaaatcattatgatttgggtacttttctgtataatattttacttcaataaaaagcttaaaacaaacaattcatcaaatattcccaattaactgttgcactaaatgcaactttcactggggcccaggaacccttttcaatacggctgtaatctattgtttcagagtactttttctctttttactgtggggattctttacccctaaggggtccagatattcctatgaaatgttgtggtaatatacattttctggggagaggcattcatggtattccatagcattcatccagaacatctgtcagcttttcaaaggggccccgcaaaccaaaaaagtaaagagcaatcactctccttgctgctcctcaaatggtcactggaatttaactctgtgacttattcctattttgtttttattttttccccccagaaagccctcccctctctgacttccccctcttgagattctacccatgcttctagggcctgtcaggtcacctctaccaccaagtttctggattccccaaccaaaaattaccccttcgctccctgtcacagctatttatcagtggactgctatgatgctctggtaggccctgaggatgtacaaatactaatccccgctctcaaggagctttctatccagtagaaggaaaacaggtgtaactttaagcacacataaaatccacatgtaactttaagcagaaagaagagagagagataaggccaaggagagttcagaggagagtgattccttttggctgggggaaactccagcaggcttcacggaggaggtggaactgccctgcaggatctggagctagaaggaaagtgcattctaagtgagggacaaaggcaagtgttgtgaaagccatgagcatgtgcaggaaagggcaggcagtttggttcacccgaagcagaggcaccatgaagatctggaagggtgtagactggaatcagaaggttagctttcaggctctggattttgaattttatgctggaggcaactgaaagctactgaaaaatttaaagcggggcatgatatgatcagatatgtgccttagtatttcagagggattaagatgatctcttcctccttcgagggtgtaaaatgcattgttctgcctctgtggtatttcactgccttttgcttcataatacggttattttgtatgcttatttttttatattctccaccccaacttgacttggcctaatggaagacaaaaatggtttcagtgcgagcatgctgtcttacatgcggtggcattcaatagatatttacttaatgaatatgcaatgtccacttaaaatcatttatgaatgaataaggaaagaaggtgggaaggtgcaaaagaaaaaacacacaggagtaatataaataagctggatgaattcaggtattccgttcagcctttagattctatgtctatgcctaagtgttcactattctgaatgacagacatctagaggaaaaaaatgcagtcataaaggagaatgtttaaagttacttaagatgctatatgaagtgtacgtgaggaatattgtcccacatcctatgttctcaaaagaactgactatcgggggacccccagtataaagcgactattattatcaagagaggcctgtttaatgcttagcacctagaacatgaaatcagaaagtccagcctaacccttggccttgttccctgacttcccatgggatctggaaggtggggaaaagagacagaccattcaacctttcaggcccttgggtttcttattttaaaagaggggactaagtactttaaatactgcaaagaaaggggctctgcctccaaatcaagaaagaacaaaacactccattgggagggaagtcagttcaggaatcgagtggcaggtcccatagctcactacagctaataatgttcacactgcttgttttctttgtataacactgcctttgcttttgaagctctttcatgtctattatcacacctcatcactttgtctggctagcataagaggaaactgaggcaaaaggagatttaatgacttgcccaaggtcccccaggactagggaaaggagccgggttcctgaccctcagacgaggctctctccactcatctcaaggcctttgtaggggcagcaagtttccgcaggggtgaccagtgatagctactgccctcctggcagttgtgcttggggtgggcccctccatttggtccaggcctgagtgattaagcgctttatcatggccaagggcaatacatgggaagctgaaccttggaggatctgagcagctggtgtggcttacccgagggagggcgtgggaaaggaaaagcaaaacttagcaccacttgcaactgcacaggctcccaagccacacactgcacagcccagtttagtgtgcatggtgcagagctgactgtgactggaatcagcccattttctgatctgagtttccttccctcttactgcaaagccctccagtcagttaggcaacaacatgtatcacaagccaccagtatttaatctagccctatttttggagctggtttggggtgtttgccttttcttcttctttttttaaatgaaaaaaatgttgaaaattcaaactatatgcatgtgtatagaatacaaagttaaaactcttgccttcaaatttcactctaaaggggtaactattgtcaatatagtctttttctttcaaacttccatatcctcttctggcctttgcaaatatacaatcatatacacgtgcacgtatatgatgtgcatgcatcttttaaacaaatggaatcatatttgcatatggttctgcaattgcatttttcactcaataataaacatatcacaagtaaccacccttgcccatacagagggttagtgtatttttataattttaatttttcattttgaaattcttaaaatttataggaaaaaaaccaaaaagggcaacatgaaacaatacctaaagtcaattttgaaaatttgtaaatttctgcaatttctttccttctccccagtggacttcccccaaaccttcctgggagtcattgcaggaccaacttcagaacacacaggggaggggaaagagaaaaacccaaccaaatgttatctgcctgttgcaggactttccaacaaatagcccaggcaggctgtgtactgagagatcagcccagaagatgagcctgcagaatcgtaaggcccctcatacagcacccattctccttggaggatagtctcaggtgaaatggggcagtggcaagttcagtgagtgtgcaatgcttgaagatagttttgccttctggaaatctagggccaacggtttgcacaggcagctgccttgctcaaatgcaggaaacttgagttcctttctcaccagaatgttctttttgcagattctgccggggccacccacagtgtgtggctaaccctgatagctgtcctgtgtcccagcgggagtgtgtgttattcctgactcaagggcagggcagagacctactgcctagacctgagcccaggtctgggctgctatctagtacaagcagatggtgagaggcagagagagcacagggcagctagagagagtgctagaggaaaggagggtgagggcatgcttcttctttgataggttttctgaagactggggaaacagcattttggctgtgatctgaccccacagtggtaaatgttttgactccttctgctacatttagaacactgactacttctgtatgtgcacaacggtgttccaggtcctttagacgcactaatttacccctcacagtcaccctatgcaagagtgctatattttccccactacacagatgggggaagtgaagcacaggaagctaaataacttacctagggagtagcagatatgggacttgaacctacgtactctctggctccaaagcccttgtatctagccatcacattatgttgccttctttatgatttgtagagatggggccttgctctgtcacccaggctggagtacagttgcaggatcgtagcttactgcagccttgaactcctgagctccagcaatcctccagcttcagcctcctgagtagctaggactacaggcacactacagggtctggctctagttgctttcttagactagtatggtgtttcttaaaatgtattacaatttttatttatttattctttttattttcttttttgagacagcgtctcactctgtcacccaggttgtagtgcaatggcgtgatctcggctcactgtaacctctgcctcctgacttcaagcaattctcctgcttcagcctccagagtagctgggattacaggcatgcatcaccacgcctggctaattttgtattttttttagtagagatggggttccatcttgttggtcaggctggtctcaaactcctgacctcaggtgatccaccctccttggccttccaaaatgttgggattacaggcatgagccaccgcgcctggcctcagatgtattacaatttaataggtatatattgaaatgggttccatgccatgtattttggaaagccctagttcacacaatgataagcagacttctttcacgcaagacttctcagggtctttcctgcactaagatacatttatgatctggcaagaggcttgtggcttgcagcatttccccaaattatttgcacataaaaatattttccgaggaacatctcatgagatcattgttctgctgatcacactttgagtgaatgctggcaaagggagttattaggaacagggcttaagttctggttcttgccatttaactgtgtgacttttggagttgcttaattggagcctgcgtcctcatctgcaaaaatgggagtggcaacagtctctacatctcatggaactatctgaggatgaaatgcatatgtaaagtgcttaaaattgtgcctgcctccaaacattcaataaatgtgacctcttataatgattataaagaataccaaataatttaagaaaggaactatgagaattcaattaaaaggggcagagaatcactgtaaatactataatttctgagtgatcttcactaacaacagtgaagctcctgtgagaaaaacataaaaaaattcttccatgaaagaaaatcctaaaccatcacagagtacaatattattctaaagaaggaaaaaacaagggaaaatatttttttaaaaatagttcagacagaaagtatctttggcaaagaggatcttctgataacataacagatgcaaatgaaagacagggctgatttcctgggcgctaaaccaagtggaggagttctcacaagggaaagagccaggtgctgaccccctctgcactggggaaaggaggaagatacaaacacactttcttgcggggggtagattctcatcactgaactgaaaatggcttggcatcaacaggatgtcttcctgttcccatcttatgaagtgactcatacatctgccatttcacttgcaggaactgtgggagaagaactaggagtctgttcattaggaaccctggctccacaaaggcactccctcccagcctgacacaacgcccacctcttcttccggttgtgcctgccaagcgtgagagtgtacaacaaccaaagcaaaacaaaaatcccaacccccgaaccaagcagcaggcagggagaatgttgcagtagaaggctactgcttcctgatgctaacgtggacgccaaaggcacagcccacagttccagaacccacaccacagcacctgaaacaatttgctctcagtgggccagggcagctctaaacactagactgcttcctgttgtgcagctatgtaaatgaaccctgtgctggggccacggcccagctgcactgtgtggcagggatgcgtgagtaatggagtcaccagggcagcctctcagtggaacatacttgtgcagcctgcaggctcagcctcacgatgccaaccccaggagcagtgaccccctcacagggcacacctctgccaggaaaaccatccatgtggtggggacagacagttccttggtaagaaccgtctggatccaggaacctcagcagatagggactgagttgggggatgattaaaacctaggggagtgggctccagactgaactcggagtggtttccttgggtcatttctaatctgcttcagtttcctcacgtaagatgagagggacccacctcttaggacctcatttgtgcaagcaccaaatgtgtgtgcctgctaatgtccacagcaacactggaaaagaagtatctcattttgcagatgtgtaaactgagggttggaggagtgagtgagcatggccaacatcatataggtactaaagttgtgcagcctgaatataaaccaagaattgtggatattcagatgtgtccactcctgaaattccacgtaggctgctaagcttccttaaaatgatgtttgcaactaaaaccaagtcttaattttctatataagtagtactcattaggtaaattatctactgcaaattaaaaatcatactttcatcaacccttcttgggctacttagtcttttgcattgccaaatggcctgtgcttaggggattataaatggattttgaaactagctaaagcaaagtctaattataattctcataattaatcattataaaaataaatcattaatataattccatggccaaatataaatgatttctgttctaaggcaatacctcatttattggcctgaagaaagttggttctgaaagataaacagtcacatggatggtaagaagagctctgggcccagggtcaagaaaccgagggtctatctaggttcagctgttagttggttaactgtgtaatttatgcaagttactcaatccccttccctttccctttctgcatcagtaaaacaaagagcttggactagatcagtgtttcctcctcttttcaatatgaagactttcttttttttttttaaatgtataagcactagcttttccctgctccaaagatagctgtctttttggagcctactggttatgaaaatacataataacaagaaattaacaaaaatgttctctttattaattgcaacaacatcttcatatactttaacaagagtggtgccattacatttaagacattgttactcagtttattgtcaatatgtggcccctgtaaacaagggctcaccctttgcaataaactgtccactccccttaccattccttgcctgcacactttgaacctttgcattaaatggcctctaagattcttttcagtgtcaagctttattataaaagcttttcttttcctttttttttctgtcacccaggctggagttcagtggcacgatcatgtctcacttcagcctcaacctcccaggctcagatgatcctcccacctcagcctcctgggtagctgggacaggtgtgcgccaccatgtcaggctattttttgtttgttttttggtagatatggggtttcgtcatgttgcccaggctggtcttgaactcctgggcccacctcagcctctcaaagtgctgtgattacaggtatgcaccactgtgcccagccctattagcaaattatttctaagaaactacataccagatttcaattttttttgttttgaacaataaagcaaattatcagttagtgatttcgttttgtactaaatcacaatcactgtgcaacaatagccacagattaatttattgattagatatacataactgaatgcttgtcctaggtatatagaggtgaataaatagactcagtcactgtcctcactgagctttggtctatatcaagtctttaacaacgatcctgagccctcccctctgtttatctccagcttcaacctccccctggagctctggtctctaatctctacctgacctctcaacattccacttggatatctaaaatgcatctcaaagtttacacgtgtaggccaggcatggtagctcacacccacaatcccggcactctgggaggcgggaggatcacttgagaccaggagtttgagacatgcctgggcaacatacacagaacctgtcactacaaaaaattgaaaaggttagctgggcatgatggcatgtgcctgtggtcttagctactcctgaagctgggggcatgaggattgcttgagcctaagagttcaaggttatagtgaagtatgattgtatcactgcattccattctgggcaacacagcaacaccttggcttttaaaacaacagaaatgggactgggcatggtggctcatgcctgtaatcccagcactttgggaggccaaggtgggcaaatcacttgaggtcaggaggtcgagaccagcctggccaatatggtaaaactccatcatgactaaaaatacaaaaattagctgggcgtggtggcaggcgtctgtagtcccagctacttgggaggctgaggcaagagaatcgcttgaacctaggaggcggaggttgtggtgagccaagattgcaccattgcactctaggctgggcaacagagtgagaatctgtcaattaaaacaaacaaaaacaaaaaaaccccagcaacaacacacttaatatgtagaaatctctggatcccaccctgtatgcctgtcaaaatccttcctcctgtggcattcgccatctctaaaatggtaataccattcacccaaatgctcaggccccaaagattcttcctgttctgaaatcctctccctcaaggtgatatccgcagagagttgatcacaatgaccggtatgatcttcactcaatttaagtttattgaacgcctactatgtggtaggtcccatatagagacagaagacagagggcaggctgacatcacacaactgatgaaaagtattgggacagctacgttggaaaatcacagaataggggctctatcttgtcctgggatcagagatagctttttgaaagtggtgttcatgagctacatcttcaaaggaagagcctgcgtcaaagcagtgtacttgtaagttagaaatgtactcatgagtactcaaaatatctgacagatgaacttcagggttgagggaagagttatgttcttactcctacaaaccagagcagatcagagctgggcataaaccagacatagtgagttcagatatctgaagaccaaatgacctgcttaatttaaacctaacccagccaggaaagccactgtgaaactagaactccacaatgggccggaaaatatttacaactctgttttaaagctgcttttccatccttttcaaaaataatctgaacacagggaatttatcctaaggaaataatccaaagtatgtgtatagagatattcactacagtattatttaacgaaaaattaaaaatgaacaataaaaattcacaaaacacaggcatggataaattacggcacgccagctggataaatataccactgaaggcatgatttttcaagattgtattgctatataaaatatgtttaggatattacattaagtaaaaaatgtatagttttacccgtgctactcacagagtatataagattatatacaaagtgcataaagaatgagcagaacatacacaaatgaattaattcgctatacagggctatgaatactcttaccactgttgtttgaactataaaaacaattaaaaatagaacaagtctcctatatttcttccctgctgatctggggcaggggtctgtaaattacagccagtgggccaaatccagttggctgatgatttttgtaaataaagttgtatgagaacataggcatgctcacttgtttatgtattacccatggctgcttttgcccttcaatggcagagttaagcagttgtgataaagactgtgtagcccacaaagcctaaactatttactatttggccctttacagaacaagtttgccaatccctgatctggagtaaggaaagatcatgcttcattctaaaatttactacatatataattgctacggtttaaatgtttgtgtctccccaaaattcatatgttgaaatcctaaccccatggtgacagtattaggaggtggtgattagatcatgagggtggagcctccatgagtgggattaatgcccttataaagcaggttcaagggagctaattggccattcccaccttgtggtacatagcaagaaggcaccgtgtatgaggaagcaggacctcaccagacatcgaatctgctagagccttggtcttggatctccactgctccaaaactgtgagaaataaatgttgtttataagccatccaatttatggtatttttgctgttacaaccatgaatatgaatgaacagggaatcatctatgttttatatttttatccactagttcttaaaaaaaaacccaaactaaagaataaaactattccccaaaactattcttcccatttgtttctatttcagtgtatatataaaggtcatgcattaatcagacagcttattacctaatttgaacctcagttcatttttataaaatacagactggggacacgtgacagagaaatgcttcttaagttaaagattagtggcaagaactgaaaagcattttttacaacttaaggttttgtttgctttttaaagcttctctggcctttgggagaaataaacacgtcagagttcctggccattctgattgcacacctggacttcatggccaccgccttcttgtgtaaggtcactgacatgtgcagactacatggacttaattcctccaagctgttcctccttgtgctacaaaaatgcactgaccctggaagaaagttcaccatattctatccaaagtccctcaccagctaccagtgctattaactgcctggcatctgtttcctctgtttgccaagaggggaaggactgatggctatgtttagggttaacagctcattctcagattctggaggggctgggatcaccccaaacagaaactgatcatcaaaggtctttaattccaccatctttgagtctataacaattaagctagctgtttgatactagaataaattatttaaaaatactgtataacttgaaaaagctctagaattggatcaaggaagtaaagtctaagtcaaaagtcccaaattggcatttggaggactgaatttggcttgcagacctgttttatttggcctacagagaattattattatttttttcatggagctaacattcagaaattgggagttttcacataaaaatccagatttctggcttctttacataaagcacattcccatgtggctgctcagttggagctgagtagcagatgcacttggatatggcctggcctcacctgctgcattgctctacttgcctgggcccacaggtggctgaggctgtgaccgtggggtaagtcattttttggaaagttgtttcaatgtttcaagcaggcagtgggaccaacaccaagtttaggaatcaaaacctttaaagtgctgagactgaattttggttcttctgctttgctacttagagggggcatcaattagggtgaaccggcagattctctagcacccttttagaaatgatctaagtaaatgttcacaacattcacaaaaagactcatccaccacaatgtgcattaatcaatcaatatcaagaaatgttttattctcatgacccaagttctgtttatttcccctgacctactctaaaacaatctaatctttaataatttaataaatatatgttggtattttctagaggcaagttactacactatatactcacagagaattcaggaattctctggccctaaggatctggtaattcacctgggaagaaaactcccacatagaccaaagagaagcttatagctctaactctgtggcaggcactgtgctcaaagcattcgttctcacaattactctatgagataagtacgattattatctcaaaagaagaataaatttgggggcctgaaatgacaggtagggtccaaagaagctgaagaaaagtggcaaaaaacagtgtgtataaagcgatataagctatctgaaaaaagagaaagaaatatttttattataaataaagtcactaaatttcagtggaagatcactggcaaattataccacttgactgctttctacatcaaataatgcaattttccattcttggaaacatataatgatttctggtggtatatgggcatacatttattttaatagaaatagctcatgtttatttgaaaaagataattacacatcaaactagtggttttatggatgatattgacacaaggataagttaaaaagtgagttgatttaaaatggatttaaagaaaaacactaaacatctgatactagatggtatgcaggtctgataaatcctctgatggtggcatacaaaatactggtgtttagaatacactaccttattagaagagtaaagatacaagctatctacttactaatcaggaagaataaaggtttctttttgactgcttagtaaaaaattcagttacactgggttcactaagaataacatttctagagtgttaccatgaagccaccttccgggatctgcagcctaggagaataggagtaggggcagctgggtgagaatgaaatgctatctagtgttttaggaatttgaatcttgaaatctcagtgtcaagatttagtatgcactgaagctagtacctgaagcagaagcaaggttcttcatgctactgtcagctgggtaggcaaaataacataaaaacaacaaatataacaaaatgcaatacatctttggtaacaataaaaactgcatctaacctcatagcataaatgtctccatacagcaaatgacagagaatttttatctgctgctaataccgccaaatgcaacagaagagtgaaactcagaaaagcctagattagataaagaccgtgacaggccagaatgcctttgcatacagggattttgcaaagtaagacccagggaaacaagacagtttgggtttactcacacctgcctccatttgaatttgcttcctgactgccccctacctcccctgaaaaagccctatttatggcatatatttttaaaacttcagaaactcaaagagcaattaatttaggctgctgtaatgcttaagacacttctatatttctattcatcaataaactgaattctttgtgtttataagcaggaggtaagttatgaggcagaccagtcatccagctttttacaaggatattggtctttaagagattgagaatgttagttgcatgttaaacaattttctggaaatatatcacaatagagaaaatggtatttatttgtcagtgaagtgctgaaaacggttagtagaaataacatagtaagccacttgggtgtgttcctttgagtgagtttttgtgtgtgtgtgcgtggggaagagaatcctcaaagggcattgcttgagtgatgatgacagtacgaacaataaatgtaacagtatttactggatgcttcctatgtaccaggtactggtgctacacaagaattacctcatttaatcttcacactaaccctatgagggggtacttctatcattcccactttatgtatggagaaacaaaggcatgaagaaatcaagtaaattacagctagcaagtcatagagctgggatgtgatcctaggtagatcaactccaaacttttgctcttaaatgctggttccccgggtgcctactaagcaagattgttctgggttaaacagcagagtttttgtactgccaactgctgtccgcaactccagagcctgagatgaaattctcaggtgtccaaggaaaggcagaggctacccctggtgtttcctctccactgtgccctacactgtgctcgggcacttctttaaataactgattttcagatatacgaagaacatttgtaagaaggagcaccagtttatagtctgcagagagggcccacgtcttagtgcagcgccatggaaatggacagagacaaggcaccggttccagaatcacacatatgtgactgctactcatggggcaggagctaggaggactcaggtttttttgtgaaaggccatgcagatgctattaatatctcatttcatcctcactagaaccctacaaagtatgtaacatgtcccatgttacagatgggaagagcgagctttggtcatctgcaccaaattatacacttagcaaggggtagatccggcatttgaatctctacctccaaatcttctgtccctcccagcacatctcctaagagagaatgtgatcctatttaaaactacaaccaagagtagtggctaagttcacaggctggagccagaatgtctgggtttgaccagctctgccacctacttgctatatgactgagggcaagtcgcttattttctctgtacctctttctatatctgtaagatgcgaataataattgcacctatcctattggattgtattgaggaatgaatgtattagtatttgtaaagtgtttagcacagtgcttggcacatggtaaatatttacttaagtgtgtgaaataaataaaaatgtaaaactttctcttgtatgggtacttatacacagacgacaaataaaccagggtaatagatgtgtcatcacagaaaatttatataaatcaactttcacagttgccaatgtagcaagcccaccacaaacactgttgtgggacctgatagctttccatctgaattgttgatgtgaagaatacatttggaagagtcctgggctttagtctcagatctgacatgaattactgcgtgacttggagaaggcatttcactcttctgggccctgcttcttcccaggtggaaagctgccccggtgaccaggcagcatggcattgggaaggaaagtgcccagaaatggcatccaagccccacagggtctggttctcccacatacgaattttataactttggacaaaactgctttatttctttgcatctctatttcttctctctaaaatggagaaaatggtgtccgtccccttatttcacagggttgggggcaagtaagaaagggaacattagagcccctttgcaaacagggctctccacaggcatctcctttgctgggtaacaggtggatacttagtaagtatttgtggtttccaagtcagtgtaaaaatctaaaaaataaataaatacataaatagatgtttgtggaaatgacgtgtagcacctatcattgtctgatgtagttttccttgtttgttacttgtttctccatccccctagaagctaaggtttctgaaagcaaggacatctctgtctatatccctgcaactgttaaagagtcagtacttaataaatacttattgaccgaatttgtggaaagtatgaatacatgaaccaatgaataaatgactctgaagttacatgagaagcaaacaaacttacctaaagatattaatgaaagtccaaagtcctaagaaacaaggtatgcaggactaaagctcttggtgtattgtatcatctgactcctctaaattcttttctttggggaggtggtttgggtggagaaatggcagagttaagatactataaagttgttaaattaacatactcagcaggtccacagactttctaaagctgaataccaactgggataattaaaggccagagccttcttttttaattgactctccaataaactacctgctgacaaaggcatagttaagttgattcctgcaagaataaagaaacgtttctcttccattcttaattttttaaaaagtccccactttcccctctagctcgatgagcacttaaattcaccagaattaaaaagaaagttaccaaatacttttttttttaaactaagcaagcctgtaacatcccttcttctcagcaatcaactcatgaaggcacggaagtggcttgtgctgaggaaggcattcggagggagctatgggggcgggggaggtggtcacaccagctcttcaccaagggatggagaagtgcccaggagcctccctcattcctctccatccctgtggtctaaaataaaatctaccatctaaaaaatactgttctaaaaatagggagtttggcttaaatccaccagttggtgttttgatttttaaattatgtgcaaaaaattacgcttaagacccagagagtattagtaagtaattcaaggaggttgccattttattttgattccaaagttctaaaacatttattctctcagagtctaaggaaaggtgaaaagagacaacagaaagggggtaaaatgatgtagaaggcttaaattccagtttgaaagtgaaaggcagctaaacattcctaaagcaaataatatactttaaaagtgtgtgttttttttttcttttttggtggtggaggccatgctataattcactctaaataagtagaagaaaaactggtgagtttcaacttagttactcctatctttcctgataccattttgggatccaacttttatgcacacaaaactgcaaataattcctaacatgcagttttaaaagcataaagaatctttttgtttgtttgtttttgagacggactcttgctctgttgcccaggctggagtgcaatggtgcggtctcagctcactgcaacctctgcttcccgggttcaagtgattgtcctgcctcaatctcctgagtagctgggactacaggtgtgtgccaccatgcccagctaatttttatatttttagtggagatggggtttcaccatattggccaggctgatctcgaactcctgacctcaagtgatctgcccgcctcagcctctggaagtgctgggattacaggcgtgagccaccgcgcctagcccataaaaaatctattgagtgttcgatggcccaagactgtatcatctttggagtaagagttttaaagcctccctcatcagacaccaatcataaccagaatgtattttcagaaaggtgtgctattacagtatcttgattaatgaatattaattttacatgaaattgggctattttaaaaaagctttcacttaatgagagtgaggtgggcaagtagtgttataagaagcaaatattaatgctatctgcttctggacagaaagactgaagtacctaaaaagtctgattttacatgtgaactttagcaacacaattttcagctcatctctaaagatttgaacttgtgtgtgggtagcatcatgtgtggaccacaaaagtcaccatctctcctcctcttcccggaacaaacacccacaaactgatggggatgctctgaaggttaaactggatcttctaattgtccaggaacgtatgctatgcaaacaatgttggctccctgtaccaaggcagagctattgtgggacttgaggctgctggctatgaggagaaggatggtggggcacagttctattcactggggcaaagtgggaacccaaaagagggtggctgaaatgttttattatcctaatcttcagaggacaaataattacagaacattctatatcagaacaagagactgttagtctgcatgagggggcagggagagaaaggcagagggcagagataaagaactttcctttttgtgggggcagggaaaggagagaacctaaagggtggactacaattcacttttcgaaggagttttctgtttgtaatatgcttcctttgaagagtggaagttctgggcatttggaagtttggttacagatcaagaaagaaattcctggctttccagagtttggtggctaccaatcaaaggtcaatcagatacaaaaatcagagtagtcctgaaaccataccataggctactgggaagatgtaacatgctttataaaaaaataacaataatctcttgcatgcatttttctcttcagtgaaacacagggatatgagttctttaaaagaagtagcaagaagggcacaaaaaacagaaatcgtgcttggggggataagaagagagggtggaggaagaagtgcagcgtcttttgggatggcagctgttttattcgcaccctctaagagttcctgaaataattaacatgcactgccattcttgtttttccagtggtgatttcatctagtccctacagaaactgagaattaaatgtcatggttttgtgttttggaaagcaaaactctcccccaaacaagggagttctgaatactgctgagagcatgtgagatctgaaaagtctgcagagtgctaatcattaacatgctacttttggaggcaggactgcccctttctttgctatcacatttccttctatttgatcctgccctgtactggtttactttctgtttctcccactcattaccacgcattcttccataacacatgtgaagtccagaatagcctctccctttcggttggccaactcaacacttcccttacaaactctccttaaaaaaaaaaaaatcatctctgacttattttccaaggactttccctcttcccactcccctggaggggaggaggtggggaacaaccaaaccctccatttcttcctgaataatgcaggagaataaagcagaaggtctacagacattacttatagtaaccgcaaataaaaaggtgtctaagaagaatagtctgctaacttagtttggagggagacagatttgggttcgcatcctgcctttgtcatttgctcgtagtgagactatggataggtcgcttaacctttccctaaacctctgtttttttcacctgcaaaatggaactttacattagggtaaaattattattttaagataacagtattaggagttttaataataaaaaagcccttccaaggctgtaaagggaattaaatgagacaaagcatatggagtgcctggaacacagtaagcactcaataaatgtttgctgctactgatgatgatgtaaatcttttgaggaggaatgtcatcctttcccccactgcatatatagtaacacggattcagtgcttctcaaagctaaaatacagtaccaggaggaagggtctgggtacaactgtttgctgattgctgcccccaggaagcacgtctcagaggcagcctgcacgacagagcaaagggcttattttaggagcctccaatcaggacagactggttgatctggatgcctcacctggcaaggcagcctcagccacacgcccatctccacaggctatcggcattcccagtgggatgcaccacagccccagactgagaatttttatccacaacttgttcccctctcctgatctcccttctcccttttggagacctcaaggctggagagaaatgaaaagcaacagctctgcctgacaaataaggtaaggactctgcctctcaggtgctgagtcactggttaggaactgtcccatctacagactctcccagaaatttacacaaaaacacaaagttgggctccaaaccttgggcactctcagaaaggctatgattcaccagggtgtgcttcagaactgaaactctgggtacagaaggtacccactgcccagcctgccaacaacctatcttcctttaaacaacaaaaacggagcagaaagaggaaaaaagcctgaacctttcctaataaggtaataccacatgccatttgtagttttgaattgcttggcacgccaggatcatatgacattcaccgcagctactgcttcatgcttgtgtgaggctctccaggaaaaatgagagagtctttggtgtgcctctgggggattacaaacgaacagggaacatgttctcccagtggaacctcacattttcctgattaaccacacttgcctcacatccctctttcacactgctgcctgcaggcctcttgctttgtgggctcaggcattgtaaaagttctcaggttgctttgtatgcaggttttctctctccaacgaggtgcacgctttttgagggcagaaacactcctttatttcttttgtttcaccctgctatgctcatcacagcgtaattcacccagcagttactcaataaatgcttgatgacagactagtgctgagaattttacagatcagtaggtgatcattttatatcattagcccctaacttacaaatcggcagggtttcaaaagttggtttcaaagaaggtatttatgtagcatattttcccatagaaacagtgttataactggggcttaggtttccaggccctcttatttctcagaatatcctatatctacttacatgcagtcttattgagctctctcatttgcctcagactcacattagactgccagtatatgtgcaggataaactctagttctttcagttacagcaatgctgacttgcacaaatttcctttcccacttattagtcgtattttcatattttatgacactatatgtagcagcaggtaataaattactcatcatatactttaaaaataacactaacaggtaaggagttatttttgctcctcattaaaaaagatgcatgaacttttgtttttccttttacattaaaatatttttcaccagtttttaacctcagttattatttgggccactccagactttcccaaccatttacacacattcaccccctcacccacccacccacgcatccactcatagtctaccaggactgcccatttacatggatacacatacagacacacacacacacacacacacacacacgtgcatatacacacacgttttaaaatgcattctgggccactaaaaatatttattagccattatagaaatgaatgacattagttttcaaagtaaaagctatagttgttcaacagagaggcagagtctgtgagccacttctcactacagcatagggagaatgtttaatggcacctctgggaataatatagtatctgaagaaaaaagctttcaatggctcagggggcaggacagtcaccttcagttgactgtcccacagttagggtctctgtacccagtctcctccagagcctcaagagtggcagctctggggaaacactgtcccctgtccagggtggggtcttcaaacaggtcagggttgctgtgtttggggtcttgagtacaaaagtacatgcacacaaatgtcgactggcgtactgcttctgggatacttaggtaacctgaaaagccatacctcggcccttattcccattcaatagcatcctgaaaagaaatctaagtgattttccagcatggcttgtgagacatctcttgtgtctctatggctggtggaaagagttatcatgcagatgctctagaagagtcaaacccaaaccataagcaaacagaaacctctctcaagactaatgtgctgaacacgggtactgaatgaggtgagcctctccccattttctggagtccacagctgtctttctaagctaagtcggcatttaagtggcacaacagagatgccaggttaatggctgtgaaggatgacaaatatcagtatggtcgtattacatctgtctttcagcaagagttattaccaagacataagaaactgcagtcccttccctgccccatagcacctcatagttactcaatgtggcccatcctcaattgattacgctgaccctttaatgagaagttctgataaccatatgcttgttagcaggccttttctttgatcagctcttacaggaaatctaacgtatactccttcactctcccaccactgggagaaatataattgaatcaatgcagtaattaagtaccccatattcatctttccttggcgtttcaggatgttgctctggttccaggtctcactggagagaagagggcagctgtccagaagtagcaagtataagagactggtctgaatgtaccaggatcacaacagacattttgaaagtttactttgtttactttgtctctgaaaaatgccaagcatgtaggagtttggggttaacaggttgcatgcagtcagatcccagtaccttgagctgttattctaatttaaggaatgcagacatgtggcatggaggttgcctcttttcctcttgcactcacggtagacatccctaatggatcagcactcatggcagctatcactaatgagtcatggtgttctttcctgttgggcccagacatgagctagttaatacttcttttcaacacctcgccccaatcacataagttggaaacaatgaactatttttgttctaattgatttcatatactttaatttctttccttaaagtaactgacagttgactaaggtatcattactttattttagcaacattctctctatacttcttagctaattcctccactaatctgagctacaaataatatgggatatcatccattgccagacactgttagacactaagtgccaatttatgtccctgtgtccttacaaaaatctcaaggcagggaaaggtggctcgaatctgacctgtattatggcttccagtaacctttccaggtgactgctacgctgaattattggcctccctttgcttcctacagtgtcaccactgcattcactttgtcatactacaatggtctgtccatgtgccctcttccctacttagctccacaacagcaggacccatgtcttacttaacctttcaatgcccagcacatggaacactgctgaatatagagtgggtgtttggtaattatgttgaaagaatttttttttaagttcttgttttcaaatacaagttgagcatcccaaatctgaaaatccaaaatcctccaaaatctgaaactttttgggctctgacataacactcaaatgaaatgcttactgacgcatttcaaatttgggatgctcaactggtaagtatataatgtaaatattccaaaacctgaaaaaaaaaaaacctgaaatctgaaacacttctggatccaagcatttcagataagcgattctcaatctgtacttgctgagtttcaattcatgccctacagtgaacatcacccatgacaagtcctgcgactggaggaaatttacttcataaagtaaggagtggtgggcaggccagccagaactgaagcgggggccagggcagccccgataccttccatgaatcagctgttcgcatgcacctcccctccaagcatgaaaagcattcacagctcagcttctgcctccatgcttcactgctgggtttgcaatttgcctttctgtacctcccacactggactgtgctctgtatccctagcacttactaaagtgttcggtcagtggtgaataaagatctttgaaggggtctgtagtaaagacagcactggcctgagactggaaaacggggagctacttctagaactgccctgatccccttgggtggtttctgtctgagttgtttttgtggtgtcggtgagagaatgcctgcccagcaggacaggtggcgggcgttaagtgtggcagtgtatgtgagcactctgccagggtaaaggtaggcgctcccttctcctcttcatgaggctgccctacacgggctgctgttgtcattccagcatgccctgcccctttggccactctcctctgggccactttgtgcagctcagtgtaacaactttctgttcccggtcgtgcccggagagttgtgagctccccacctctgcgcatgttatttcttttccttcatctctcctcacctccaactctgtacagatttctgggcagctggagggcaagctcttggcctggcccacaggtgctgtgtgctatgactgccggtcacctcttcagcttggtcccaaccacgcctacctcccacacactaagccccggtcatacctgaactcatcattcctgtccccaccacaaacctccgcctattgttgtggtctccagctcagggagtggcactgtcatccaggcagctgccgaagccagacaccccagagtcgttctggactccccactcctccaccacaccccttcttctgtctccaagtcctgcttacgccacctcaatatttctcaaattagtatatttttaccccactgccccaccctagttgggagtataagcagctggcccctggatcactgtagcacagccatggctgtctagctggtctctctacctcccctcaatccactctgcacacccaaagtgatgtttctgtaaagaaaagttgactgtgaccctccccttttaaagttctgtccacagtttagatatcgcttcctgcaggaagcagtgctgatgcaggaagccacagcacctccgtctctcccatcaggataccgagcacacttgttggtcttctgcattagaggccactccgtgaggacttccttgctctcctctgagcagtggaaggtttttaatcactccttgtgtagcaggcactccagcctgctacctgacagccatctaactccctcctctctgctggtagaacaagttcactctttcctcatgtgatgaaggtaaatccagattggtctaggccacatggatggccccagaccacttctgagtgtttagtggtgggcatgtgccccagttctgaccagtgagacatgaggggaggttggcttgggaattttgaaaggtctcttcattcatagagagatgcataagaaacagttctttatctgtccgccttggcgttgttacaagaggatgggatgcctttgacctttctgtacctaggaggagagcttgctgatgctctgaggatagcagagtaggtggaaagagcttgatggtgttgagctgctgaattaccaaactggaagcagactacatgtggacttctttttatatgagatggtaagttccctttggtttaggccattttgaattgggttttctgttacttggagctcaaacagattacagattcttgggcacttttcacttcctattttgtcttagaggtacttattaggtacaaatcttgtttcttgttttagactgtggtctttttaagggcagcatttgcattttgatagatccttgtatctcccagaggctggtggcttgtcctactcttgagattgaatgaagagccagcatcgtcttccggcctcacactataaggtctcacaacctgtagatgggccttcttcaggggcttaatttcttcatttatttttacaaatgttcaatgtaggaagaaacatgaacaaaatataaaagctctacagtccactctaggaggcaaacctatcacatccatccttatatacctcactgtactgaacacatgctttgtgcaaagtggatactcaaaatgtttgctaaaggaataatttaatttgcctctgatgagtcaagagcacttaggacttttataatgtcctaaggtcataacgaacagtaattaccgacaaatagtgctaaatatatcctggttctaggagatcactggtagtaaggttttgtttgtttatatgacagccttgatccaccaagatgctaaagccttaaaatagaacaagcagaactaggctttgtacagtgaagcaaaaaaataaaagtttgagcagcagagctgcccactggatgtgtgctgaatgcccatcttacttgtgcctggccctggggctcagccaggtaagacgaacccattgtcctcaaggggcttagagtgtgggagtgggaggaagaaaaacagacaacttcaaaagagtgcagtaaatgttataataggtaaggtagagggtgcaatagagattccaaggccagacctggtgcattgagaaggtttctcagaagagtatctgaacacaaagggtaagtttatcatacaggaagggaccaaaaaaataataaataaaaagaagagtagcatgatcaggtctgtagtttataaaaagctaattctgactgtaatatgaggtaggagagacaaggctgaagtcagcaaggccagttgaggggctgctacagtaattcattgtggaataccacaggtttctcaggctggaaacaggttaatgacaaataatgtcaggcctgggttttcaagagcatgtggtgctatggctgctgctcaaaggatgatggctctggacaccagtttcccatcttctgggttcaggatggggagtgggtttgacttggaggccacaagatagggtgtgatggttttaacctggtgtgagcatgagtgcacgtgtgtgtgcatatgtgtgtgatgtgacgctccgcctcctcatttaccacatctcacagttaggtgagcacaggaatggctctggtcccagcatggccacagattcctctgtgatctagttcaaggggtcatacctctttgacccccagctttttcacaggtcctatcaagaagctgggccaatctctaaaaccaatcaactggtctgcccgggtcatctgcactgcaaggtttatgattctctgtaccagggcttctcagccggtgtaccctgctgaggttcaggtatgcctcagccccaggtggcctgacagggcctggaccatccagagcctccagctgtgggcatcttcctccatgctatagtacgacttttctaaatgtgccatttaagttgagtatcccttattcaaaatgcttgtcaccagaaatgttttaaatttttggatttttctcagatcttggagtatttgtatatacataatgagatatcttggggataagacccaagtctaaacttgaaattcatttatgttgcatataggccttatacacagagcctgaaggtaattttatatactttaaatattgtgtatgatacaaagtttgttcacactgaaccatcacaaagcaaaggtgtcagacagggaattttccacttctggtgtcatgtcagtgctcaaaaaatttctgaattttggaggatttcagattcctggattaggaatgatcagcctacatgaggaaacaggcaggaagcaccactctagacaagagaaagaaaaacattcgcatgagcccagaatctcctttggctcatcactcatgtctccttccgtcactcaagtgtccactagctctttaatgacaaagccaacaccaacctgcttccagctgcatactggaaaggcaaccaaagaccgacatggctggaagatgccaagcagtagggccaaagggactatcacaaatgggagcctttccactagggctttccacctcatgccctcctgccttccgggggaccttgctctatactgactgttgccttccctccagaagctccaaactccctctccatctcctttgatatgtgtgattttggtcacagtggaaaaaaatcttgtatttacagggagaaaaattcagaaggaaaagcactgctttctttgagaaggctgaactaggggtccccaaggacactggggagtgttgggaagttctgagaaagatttgagatggctcagctcacttaaaaagaaaacgcagcaatggacaggggttacataaacgagtctctgtgctcagaatcgcaggtctgaaaaggaggttttagtttggctttgggtttccttttttgtttttttgagacagagttttactcttgtcgcccagtctgcagtgcagtggcacggtctcggctcactgcagtgtctgcctcccaggttcaagcaattctcctgcctcagcctcccgaggagctgggattacaggcacccacgaccacacccctggctaatttttgtatttttagtaaagatggggtttcaccatgttggccaggctggtctcaaactcctgacctcagtcaatttgcctgcctaggcttcccaaagtattgggattacaggtgtgagccactgcgtccagccctagctttgggtttcctattgcagcaacacattagaataaacaaacaaccaaacccttgggactgaactaatacacctggagaaggattaatgtggcctgggtcctgctatccctcctcagacctagtatttcgccatgacgatgaaatactattggctggtagcagcggccagctcgctaacctgggcagcagacccctctctgctcttcacacagcttggcattggcctggtgtcaggattggggagcatgctggacaggggctgagtggctgctatatgcacactggagcacacattgatagtacagcagagagggctgggctcatccctggtaacctgtcagccctggcttttagatgcttgaaagatgaggttggatacaactatagaacaaacccacccaaaaaagtccttgagagaaaaacatgaagcaaataaaatcagctaagatgctccctgtggaagcgtgtcttaaaaacatttgccttttcctgattgctccaatggaggaataccttattaccaacaaaaagttaggagtgatgtatgggagctaaaaaagtagacctcatggaggtagagactagaatggtggttaccagaggctgggaagggaagggggggatgaaaagttggttaaggggtcccaaaatacagttagggagaaagaataagttttagtatctgacagtacagtagaaaaattagagtcaacaacaatttattgtatatttcaaaacagctaaaaaaatgtgcaatgttcccaacacaaacaaaagataaatgtctgaggtgatggacagcccaattaccctgatttgatcattatacattgtatacatgatcaaaataccacatgtatcccccaaatatgcacaactattatacaacaataaaaaatgttttaagaagttaggggtgaaatccagcacatggaacagcatatacatcccacagtactaatggaggccagagggcatgtggctttgggtgggaggagtgtcaagatctctatggttcctgcgtaggcagtcttctctgtgttggctaactatagtctgagaactattcacctcagtaaacactggtcaagtgcctaactgcatccaaagtactgtgggagacaatacagtgtagccattaagaaaacgaattctggaatcaggtaggcctgggtttgtgttcggactctttcacccattccctgtgtgacctgcgaatatctgttggctgtaattattataatcttggtgcacctcaatttcctcatctacaaaatggacataagaactatatgtacctcaaagagttgctgtgagagttaaatgaaatcatgcaagtatgatgttttgtataataccttatacatagtaagtgtgcaataaatactagtcattgttattcctagaagcttccccaaattattttaaaaagaaggcacctagatctaaatgacagtccatgtaacaaagaaaacccttacttgagcaatttcagtgaaggccatttttcaacaatgctcactcacttccctccactctgggtcccagtcatgtataaaacactctgctttgtgttgactaagctccacagtgacattccaaggagttctggtgtccctccaaatattctaggctgcccttttaacctgatactgataccctgtccactctactgtttaaggggctatttaaaaatttggctttgtaaagcagggagcaaggcagaaagccttcaaagctttagcagttggcgtggcaaggaacagaaaagcagcattttacagtatcaaataccagaagtagccctcataaccactaactttgtagtgctcttccttcactgtggcgaagtgctgagcatgttacatgcattacattactgaaaccaaggccctgtgacgttccagtgagtccaaggtgctagctggtgtgagtacagctgtgggctctaatctatgctttgcttcaaagtccacgcatgcaaatcctgggcaactccctgagtttccaaggcaactcagccaactcatccagaggtaactagcttccaataactgtataagctcactcccatcatttggtaggttggtaggtcaatcagttcaatttatttttatttttatttattttttgctttctctgatatttgaccaaccacgacacctagtggccagtggagcacaaacatgggttgcccgaaaaggctgatggacgggtgatgtgtgtctttagctttaagacacacgttgctcatgaccaggaaaaacctgatggatcgtgttcaaggcaaagaaaccaaggcacagagaaatgaagcgacttgcctaaagtcaaagctaatgtagaactgtgtggaaatactgaaccttagtgttagaactcgtattctgattcagacttggcctaaatttgatcctcagcaagatactttcttcagttattcaacaaacattgactgggcacctcctgagtaaggcactgtgccagatgccggggacatgacagtaagcaaggaggacacgtctcgatccttgcagtcaaataggaggggaagataaacagagaatccacaataacaataccagctaatatgtattaaggactctgcttcaagagtttcatgtacaccaactcgcttcatccttgacttgaaacaatcctataatgggggtgcgattattattcttgctttgaaaatgtgcaggagaacatttaagttgtgggtaacaaacagggctcctatgcctttctaggtctaagtttctgaaataaagttgtgctagatactggaagatttctaagacctctttccagatcagtttcccttcacttctaggattctggggtaaagctgggattagaccttggtcggttttcctgaccaagagtctagtgttccctctctatacactgtgctggtcaatatttatgaataacagctggaagttattgaatgcttactctgtgccacgccctgaatttctcagttcaggcaatcttcttcacaacctatgagacagctttaagatacaaataataactgagtgaaaaatcatgctctaaaatagtttaaaagatttccaagataaacagagaggcttccaacctcactcagctgtagcatcctgaatctctgttctgtctgattttgttgaatggtggatttaaaccttatgtattggtgtcctcaggctctcatgaagggaatggataatgggtccaggcaaatggttcaatgatgagttactgtctagggaaacagggggcatcttgttcaataacaacattgctttggggtaattctgggtccctagaagtatctacaaagcctgcaaggtcaagtgcaggtcgacttggctctttggttttatgattccaaataaataaaacacatttccaacagttcagcagggtatatccgagatcggcaaactctccaacgaggtattcccgttaacccttagtcccttaccctccctgagggtatgtgcacaccatccgctttctgtcgggtgagggagggtgcagggagagaggcaggggcaatcaggaaaactctctcagtgatcctgcaaatgggaaatggggacattgagtttaatcacggctccactccaggaccaaagaaagcaactcctgccacctgcagtcagaccactctctcccacacccaggaaagcagacccagtgggacctagagcttcccaggtcttgtaagactctggcctctttgttcagggcctccagaatgatactccagtgggtcttggtgagaacatacattagatatgctgcaatgtttagcctagaatgctctgctagcttttccaaatggcaagctctcactgaactttctagggctacagatcaataccttcttttgcctgaccaccaccaccgcccccaacccaaggctgtccacagtaggaactgccacatttgcccagtacctaacacaagattgtaatcactgacttgtttatctgcctaccccatggacttgaaacatctctaaaagatgaagtggggtggcttaaccatccttacgtactcagtacctagctagcacagcctctggattgaggaggtgctgattcccaaagagctggaaaggaaggcaaggaactgtaaggctagaagaggcttaagaggtcatctcatttataatcctgcccaatacaggatttccctcaaaatacaagaaattattttgagggaaaataatacaaaaagtaaagaaaaacaagagaaaagtttaaaagagtatgtatttatgtacatatataccttctacatgcatacatacatatatggcatccttctactggaatggggtatgtggtggtaaagacgcagagtaagattcactcagatttttgagcattagcgtttatctctttttaaagtttttttccctaatttttttcccctaatttttcacaaaatacatgcaatttagtgaaaaatttgtaaaatataattaaagtgaacagaaggtaaaagttaacatgctgttatatttccttctaatattttcttgggagtttttgttcttccttttttaaaaaatcaaaggaaaccttgatcagattgagtttttaaggtagtctaaattatactctgctgcacaactttatattttgctccgttctagcaaaagcatttccctatgtgattataaagtctttataagcatcatgttttaacttttattttgatataagttcagacttagagaatagtcgcaaagcacccagatttgggttcctcaaatgtaaacattttactatatttaacaccctaccctcccaggagagagagagagagagagagagagagagaatcaatatgaagttttactcctaaatatttcagtgtatacttcctatgaataagaataaggaattctcatatataaccacaccaattagtcaaatcaggaaattaactctgatattttactattatctgatctacaaccttattcagattttggtgattatcccaataatgtcctttacaggaaaagaaaatacaaaattatacattatgttcaactgtcatgtctctttagtcttcttgactctggcatgcttcctgagtatgtcttggtttttaatgttattaatatttaagagtaagtgctggttattttgtggaatgtccctcaatttgggtttgcacatgttttttcctgattcgatgcaggttatgcacgtttggtagggataccacagaaataaatatccatcactttttttttttttggtaagagacagggtctcactctgtcacccaagttagagtgcagtggtgcaatcacatagctctacagcctcaaactcctgggctcaaacaaccctcctgcctcagcctccagggtagctgggactacaaattccattttacacaagcatgtccttattagagaattttaggttgtttttataattttgctataattccaaatccacccccctcccaccctatgaattactgattggctttccaccattaatttttatattaataatttatccatttaaaagaatatgttaagattgttactatattaacaacttttgtctaagaagctctgtcaatttgcagtctaacaaaggatggagtgtgaactccatgtcaggctaacaagccttgagcactgacatgctagtattgcactgctgttttagtggctttcaccttaaattgtggttataaacggcattgctcctgtcatgcctctgaatatattcctttgtttgtttgctttctcattcgttcactccttcacattcactcagtaaatactgagtgtatattctgggccagtagtttaggtgtgagatcaaggtctcaagtaaagaaataaacaagaaaatatggattgtggtaagggatatgaaatacacaggctggtgcaacaatgagtacctggaggcagtgctccaggtagacagggaatagtctggtgcgtagagaaagacaaatgagccagtgagctgcagctgggggaccaggagaaagaggtggggcatctcttggcatttaccataaaattctatcaaaatgtctccaaaacattgctcttactaaaaatacgaacccttattctgacctatcccaagtacccacttccaaagcctacccttctcctctgtctgtcctagtcagcagagtctaaacttcagcgtattataatttgtgaataataatgaaagcctgaaaatgctctgaaattagagggaacttagataccatcctgatgttgctcagcattgcaattacctgactttgagggaccattaatgaatgagactgtctcaacactagattaatggccactttcaacagtggaaagggaacagatgtccaagaagacagaaaggtactaacagctgtgtgtatatgcgtgtgtgtatatgtgtgtgtgttctccttcaataaccggggtggtggctatggccacaagcaaggaagatgggtgttcatgcaaaaacaatcaatctgcttgtgctttggagttactctggtctagcagaaactgcagctccccagggctcactatcacctctggactttgtcagagtgagtcaagtagcaagaacacagaggaatcgtccaggaactagacctgggaaaaatatatccgtctttctccaaacaaagcctgtttggtatttcaggcaattagtttccaaacacttgggtcaaaaagcaacagattatattgtcaaaaaattatttccttgcatgagatgaaaaattagacaaaatatataagaatacataaaaattaaagtagacaaaatatataagaatattatcaatagtcattagatgcccctgtcaagcactgaaaaaataacttataataatctataaaatgtatgcacactcttttcttttcacatccttctaagggaaacagcccccagtaggcgattaagctgatgcacgagtaacgatctcttaacaatgccatgccatcaaatactgaagtacagttcagtgtttctaagagcagagaaagaaaaaaaacattaaaattattactaatataaacactatgattgtatattgcacttgagggatgaagatctagaacaatgaagatgataaacatatttacctacagacaaaagatggtagataagatttttattataaaggctttgtttataaagggaacacattagaagctaagtaattgggtcagatttggtaattaaaagcagctgaataatcaacaaacgcttaacaaaggtgttagaacaagatcatattttaacagaagatgaaatacatagaaaggtttgtatatttcaacccttattcttctgcctgttttgcatttttcttttaaaaatacacaaaaagtataggaagcagtagtgaaataactactacctagtcaacctgtgactgaatctggcagttgttagtagcaggtgtaaatgaaacgatgcgaataaactagcaggactaaatcaaaaagatttcaatgtgggtgacatagctaaagtctataatttaggatctctaatacatatccagtttgtggttgaaaattcctgctttctagtgggctttacgtctgccacaaccccaaggagtgaaaggaaactcaagactaacaatgatttgttgtaactagacgtagtggtgaaaatctggccaaaaaaaagtccactataaatgtaacagctgtgagccttaagcctggtggcatttaaaccattttattctttatagctataagagtattcaaccctaagtttacaataatatctcaaggcaaaaactcaaacaaaacaaggcacacacgcacacacacacacacacacacacacacacacacacacacacacccctaaacaatgccctcatagacaagcccctttcaaagtcccacctaattacaggctgacaatctttccaaattatcaatcagaacaataaaaatgcccttgagggctcattttaaacaattctctggtcctcctctagggggcgaagttggctcgcatttcaccgaaaggggaaattattttcaaaccctgattttcgcacagtgctagaaagatattcacatacaaaggggtctttccgcgctcctgcttcttctcaatacatttcacttcggctgatgagcaaagcagcccagcccttcggcacagtaagagggagggaatgtgattacggcggagcataagcagggcttaatcagcacaaccctgaaggccggccagctcattctcctcaaacttgagatcacagctatggttttgccaaagatgatacactttcaagaatatatgttggtgttttttttttttttttccaggagaattttccactggggaaattctgaagccaggtgaagcctcacacggggctccctcccacccggtctcctctgtagggcctccctctgagaaaccacaaagcaagctgctggaggtctgagtgcctgccctcccttcctgcacaaacggggccctttctaccctgaggatggcatctggtggtcaggaagatgcctggacagcagttcctcgctgggcctcgcttccccctcacggaaagggttaggtgtcctcttagggaatgcaggtctagctacagaaggggcatacacaggcaatgcctattcccaagggagaatcaaatgtgagttttagcaccctagcaaccatacaaggcagaaggctcagagtgtgtgtgtccctgacccatggatagatcgtttttgtgggttctaagccttatacaattttgggggtcctctttagaaaaatcatacaaaattaggaatatcacattagctacagggcattggaatgggatgttgccagtgaaagatcctgaaccttagggctctttaactgctgggccatgcagttatcttgtccagcctgccaccactggactctcccctgcagtaaaaccccatgtcacgtgtgctggctctgggtctcttcttggcctcttgaacatggtgccatctctaatgagactgacaggggttcagcacgacagggcctgagctcctcccgcttaggactgtccattgcctggagacagataccgaggtggagctattgaaagaaacacttgcgctgccctgtgaaagggaacaaactcctctgccacgggtcagctctccacacctacctgaccaagtctcagtaaccagtttgggtcatctcactagttcagactctgcctcctcctccttttccacccatgggaaggttatgcaaccctccttccagacctccttgggctgcacaaaggtgccaactatactagtctttactgaaagacagcaaaataaagtgacctcaattgagagcatttatctaaacatagtttgtttgcatattttcagtccttgtaaaaataatacacaattttctccttatctgatggcaatatcacttacctaaatcttaacaataaaatgaggcaaggcctaaaaaaatagaaagttaagtttagttgatgtagcttgttttcacatgtgctacagtttggaatttataagcaaaccagatataaattttcttctttttgaacaaaacagtaagaacaacttcttacatatagaaatgtcttcataaaatccatttatcacaaaaaacagtgttctgcaaatttgatttaaaagctttttttggagatgggctcttgctacgttgcggaggctggactcgaattcttaggctcaagggaatccttggcttcagcctaccaatgagctgggactataggcacatgccactgtgcttggtcttctgcaaattcttatttgtaaaacggaatgtgctgggaaaataacagccaccattatttgcatcctgtgaaccacacatagtctaaacatttcatatagactatttcacttaatcacctcaataaccctatgcagtattatccctattttattgatgcagaaattgaggctttaagaggtaagcgacttgtccaaggttacaaaggtattttgtatagatttgaggctgggcaggttgagccttattgttagtccctgtgccatgctgcctcagcagccaaaaatcacttttgatactataaagaactagtgagtttcacaagatagttattttttaaaagcagatcattgcacatatttagattttttcccaaattcctatttgattaaaaaaaaacaggctgaggaatggggctagttttttccaaggctttaaaggtttttagaaatcatcataatagttaaatgcaaacaatgtaatagctaccatttattgaacatgtattatgtgatgggccactggctaagttcactatgtgcagtgtttcctttaatatagctatcttgtgaggcaaatgatatgatgcccatttaacagatgaggaaactgagactcagaaaggttaaccgtaaccatgttcaaagtgtctcaatagataaggaaagtttgaactctagtctatctgcccacactaagccacttccctactataaaatgtatacatataaaaagtatgctttagctaagagcctgttagttatttcaaatatatatctagatctttgaatggccagtgcaaatcaccatatgcttttaggccaagagaatatagatgaacagtcccaggggagttgagttctgctatctgagcttctgtctctaatatcacctcatatgatgggtctgggggaggaaaggagggagctgtatcttgccatctttgtaagcagccagtaaaaatgaggacataaatcaggtccacatctggatatataatgttcagtcttgccaagagactagtacatgatggaactacccaaaatgcatttaatacattcttaggccactgcacccagagagactccaactttagctgacccaagcatcttcccagcatgtgtcacttgctcatttgagacgctggcttcaccatgggttggggggtctatactcagcgagtgacctaattgttacaggacccaacatcacagtggtccaaccacacatgaaaaaggagggcacgttggcagggaggctgagttcacagtgctggcgccagagaaggcagagaaatatgctgactccaaatgtcacatgagcatgaaagaaaacctacataagtgagggtgggtctttggagggaggtaggatacattctgcaaggcttgaatttgcagagttcataaactctgcatggagccctgatcaaaatgcttccatgaagcacagcaaatacgttctcagatcaagagaaactatgttagggtcatgagcatgagaaatggcatgagcacagtttccaaatactagctttctgctggagttatacaggtgcacgttggtatgcaggtagaggaaacccacccagatacacaggtcaaaagtttccctgtgggcttagataacagggtgtctaagcttcgctttggaatctctgaggcccaggaaagaattccaattttcccaaacatttcccatttttccaatgtccaattctcccagacaaggcacgcacacacacactcacactcacactcactctcactctctctctctcctgagatcccattagagagaaagaacgtcacaggaagctaggtttggctcagagggagcagcatctttccaacaactccaacttagctgaaaatctgaatgggatgatatgggagggaaggaggggagatggaggtaggaagctcctcaccagatgaaggaccacttttagagtgttaaaagaagggaagtgtctcacactgggtctgaggttaagatgcgaaagtgaaggtttccaccacctcaagatgtaacagatgggaaattccaaagcaagggatctgatcattatgcagaaatttctaagaagatggctctaagacccagaaggaggacacaaacaggtcaggacggtggaaagcaatggaggattctgtgagtaagattctttggtaatgctctgattcctacggtttccaaggtgggtggaatggagagggctcagcctttcttctccagcccagagaaaagggtttcaaaagctgtatgtggtgagtttgatatgcatctccctcaggaaccaaaatgtgagagggagctgacgctggctaaaccagcagggtggatgccacatcagaaagtgagtactgtccccttgccccatggtggaggggagggtgaaaggaatatgaaccctggacacccagagtggcagcctgggtgtctttgcaacaggttctccccgagagggctttggcatgagagtgagaggaccccaaagagagtccgactggaaaccagaagatgctgagggatggcaacagcagcaggaggagagaaccacccaaatcccggggggcccagagcaaggcccctcagaggagtcctggagaaggccatggaggcagccaggagagaaaaaagtcccctttccctgtctgccaggctcagataacttagcatcagatgtgacagtcacagtcaggtaacgacttgctgcacactccccctgaccccacaacctggagagacctgagcagtgggcagctggaggccactggagggggaagtggcccttggtggctggatggagggaagtcctcccttggaatgaatactgactgtttatagaccaaaaagggcatttcaaatttccaaaatgaacctgtgtgcatgtgtgtgtgcgtgctgagagagagtgagtgagagacagagatacagagagagagagagagaggcaggctgacttcaagtggccttagaacttctcattaccagaaaagtaaccagaaaagtcatgggcctgatcaagttattatcaggaaatagggtacaacatacctccctgaataaactttaaatgaacagtgggagacaagaatgaagctgagtcttaactatgactggtgagtcacattgtacaatatattagttacatacagttaacctttgctaagtcctgactaagtgccaggcactgggccatggacttcacagacactacctcattcagtccctctaacaactccttgaggcggatatttgacagataagaaaactgtggctcagagaagttaggcaacttgcccagggtcacgcaggtaagtaagtaaagtagtaggaacctgtattcaacctcaagcctgacatctatctgtgagctcttgtattgtcccggatgagtggttttcagcaaaacttttgcgactgaagcaggaaagggacttgggtcctatccatccttcctcctcgcgagtccctgagctagaaaaccaaaaagcagagtttgaaagccactgacgagcatgatcttatgggtcctgtacaacactctgattttatgatgctatcatctgtgggcgggaaggtggagagaggtggacccaccacagcagacacaggcgacaggaaaaactcagaatttgtatccagtgttccaggagaggcagctggaaggagctggttccagcaggtggatctgaggttcacagaattataatcatgtgtataaatatagagttcagagaatgcatgtaaagcacttagcacagagcctggcattaggtaaatggcaactatgattgtggaaagtttacatatgtgcctaaaaacctcaacatataatttaatgcaacatgctcagccactgatgtcactgtgtctgttccataaggagctatgcttatcatggacactacactttactaattgagccaagacaagaaaggaatgtgtaagattaagctagccaagtctaaaacaattagagtaagtctgaagcaacggtttttaagcaagaggggcccagggaagggggtaggcatggagtcctgtgacataatgatggaaaacataatcctttctccaacaaaaaaagtgcatatgtacaattttgcaaataatgacagaagttcacagatctgttgaagtctattcatagtctccagattaagaactactcctgtagatcctggggattcaacatgaggtcctcaggccaagagctgcccaccagatcccaaagtggtgctacccatccttgtcctctccacatgttccttattggtagtctggatcatgacaccaaacctgaagtaggtagtcaatgtaactgtgcagaatctaatttccaacctttcaagtttaatagactccaaatgaagaatgtctaaactagtggattctggtacctagaaaatttatctgcttggcattctcattctttccttccctccttctggtaccaacacctctcctttttattattttttcatttttaaaatttattacataatgtggggagtcttccagtgaaaagaggaaacctgctagacaaattctaaaagagctgtaacactacccctcctttttccatggggaacccgttctgtgtaattctggtgggatttaccctctctcatgggacacatgaacaggccttagccaaagtgatgctgcttattgtctactgcatatttctggccatgctgattcaggcaggcaatccaatctgggctggtcaaggtccctccttggtactcactactgctagaagtatggcaaaagaggcacccatagctgtgagaatgacagaaacccagtactgatagctacctctgccaccatggtgagggagagcatgtctgagaatgaagctgagagagctaagcaaagtcaagacagagtgaaagataatggcctgatgatatctttggaactcctgaatacagctgtgcctgaagcccttactagcatggccatcctaatcatataagtcaagagactagtttaaattatatttctgttgcttgcaaccaaaatactcctaataaacttgatccaaagcaaaacaaagtcccaaaggaaattctccttcacgggtagttcttgtggaattctgggctcctctctgacaacgatcctgaatgaattaaaactttttcttcctacgacattgttgcaaaaaagtctaggcttaacattattccctatcattctcggcaccaatggttcatcttaccagtgctgccagtcagcaaatatctcattctccccacccttgatcctgcactcctgctcaccttccctatactattggatatttcctcttgtaataaatattaaggttactcattagaagaggagggacccagaaatggacaatggtggcctagtttatagttcgctaccatcaaatacttggagtcaagtctcatgagcctctcaaactgcccccaaaaggcactgaatgttccagtataagaaatgaacctagaaccatggggctcaaaagagaaggagagagacatggagcaagggaagaggatcatgcagggtcaatgtaaattctgtgtatcaaaaaccacaacacagactgagtcatagtgtagaatgacttgagagttgagagaaataacattcacagagcactatcaggaagttatttttcttttagaacagggatggtaagtagatttcaactcgcgtgcccaatctggtccacaactaaaatgccaaggctcagcatcaagacggtcatgacaatctgaagtccattacaaggtggggaggggaggagggttgtgaatatatttatttgttatttcagctgaaacaattacatttcatccttggactaagcaagaccaacagagaaatgcacacctgaacctagaagggtttctcttggactgcactcagctgtcacatcattcacctgcaccgaggcagtcgtcattgttttacctacagagatgttgtcggccactctgtgtggcattatctttatgagtactctgaagacatttctctgagtcttgaatcatgatcaaccctgcttcttctaagtaactggtgtgcttttatcttccagccaccgtaagtcatcaacggagcatgttttccttctggtactgattgctcagaagctcagaggtaagtctgtgggaactgccagcaaatgaatagcctctctcccatgaactggggacttattttatctctgacttcaccccacttttccttccccacagatttcctcccttacttatttttcttaattgcattattttacacctatgtttaaaggccatctcaaaaatctttgaagacagctacatacatcagatcaacagtaattaacataagaggaaacaaaccagatggtgagtggaggaaagttttacaaatgctgccatgcagtggcagccacagggtgatggccttgaaccaggaatagccctgggccaacccatcaagtcagcaaatatctcattctccccaccctggatcctgtgttcctgctcaccttccctacgctccattctccatgggcagccattccccctgggccatttctgagcatccacacctactctctctttagtactactggttgctctccctccctcaactcttcccaccaaatcaaaatgccttcctcctctctctagaaccttgggcttgactgtatgttgtcaacagttgataatagcatagtgtcttttctctttcaaggacaggtacattttaaccaggcattttgaagaggaaaaaaaagcccatagaagtaattcactaatggtggaatatactacaaaagtagtacaaaagcaattgaaaaggagattttttcttgtaaatctcaagtaattctatgtaaggtagcacagtacgtggcacacagtgctcaatacacagtagctactcattattactattgttgctgttattgttaatcccaccactaccatttgatcactcactgtctattccttttacctctaccacgcaggctactgcccttttcggaacactggccgactggagatccacaatcaattaatccattttaatcatatttatgatttataatgtatttttacacacattagccttttttgatcttcctagcaattgtctagttaaacattcttctcattttatagatgggcaaactgaggctcaggaagactgagttagtaaggttccagagccaggctcaaactcaggttttgtataaatttcttgttcttcccataacaagtggttgccaactagagtgcaatcacatcagaatcatcagaattttgaatgtcatgaagatattgtaaaagcaaaaaaataaagaatcatttggggtgctttaaggttcctggggtctaccccagacctaatgaatatagatggcccagtggaagggactgtatgagtttgtatttcaacaggtgccttgtgtgattctgatgagctgctggtggatggacaagtccaatgcccatgcttcttcttggttgattaagtacctgctgtaccctcagccctgtgctaagtactacaaggcaggcatatatcgcctttagctctcaaagagctaagtgaataagaagctgggaagtgagtaggagctaggaggtaagactaaacaagtgaaaaagagtgagccaaagaaggcactgtttggctttgaaggaagtcagagcaggcaagatcacagatggcaggaatagaaaggaaggccatgtcatggagaagggaaaattccagtaggtcttgcaaaatgggaaggatttccaggtagagaaggggtaagtggaatgaaatatcttcaagagagatactgaacagattgtctggcaagaataaagggaatagcaggacttgaacaagagagaatggggccagaaaatgagtggagaagctagagaagagcctaggctggtgtaggggatggcaggtagggagggaggtggtttttgaggagtaacgtcctgaaagataaactgaagaatgactagtgtagtggtgctgtgtagaatggagggagggctggagggtagaaaacctggtatttgcaagactgcctaggaacttgttgaactgactgagatgccagacggctagaagtaagactaagatttgacagtgctggcagtcagaatggggtgaaggaatgggactataagatgggaatctaagtcctctcacactccatgctcttctcattcaccacagctgtttccatgtgccccataaacactatagcagattgccaaaaatggctacatttcttcccctccctgtatccatgctccttgaaatgggaccctgtagctcctctgtcatatatttcttgaatccaggctaaccatatagcttgctttaacaatcagaatgtactggaaacaatgttgtgtgaattctgagtctcagtgtcaagatgcttctgctctctcctggaaccctgcccaatcaccatatgaacaaacttggggtaacttgcaggatgatgagatacatggcttagtcatcattatctctccacctgacagccagtgacccccagaaacaaagcctagctgacatggaactgcagctacctgtagatacatgaatagtcccaggtgaaaggagaaggatcacgtagctgagcctagcccaaatcaccaacccacagaatggcaagataaataaaggattgttattttgagccagtaaattttgactcaaaatgctggcagtaaattttggggtggtttgttatgcagcataatataactgatacacactgcaaataactgtatagccacaatattagggagtgatgctatatgaagccccggaagctttctcacttttaaaaagtacattattttcctagctcttaaggaagttttctaccatggcagaactattacctcacaataatcacatttaggtgagatgagagatgagagaaaaaaaatagagcaataataaagagtagagccccagtatgttttatgttgtagctgtgagacaattttcattacaacacactacaagaaactgtctgaattccctggctgaaataacactctgttgttttggatactcccatcaacaggggcctggaaatagtttcattacccaaaaaagtttttattttagtagtatttggcatgtaatcatggatctttatcctgcccatggtcttacaaaggaacatgggttgctctgtttttttaaggcatggaaacatcataaattatagagattaaagaaaagtacaaataaatagacatctcatcatagcactggtagggaagcatctaacttagaagtgtgaatatcatctcaaaaataaagtcaaacagtcactttgtttaagaaatgaagaacttaccagtaagactttgtgtggtccaatgttttcaggttttaagtggaatgaatctgaaatagaattaaataaacattccataagtaaatcacatttggaaagggtgtgctttcgatcccaagtgactgccataacgttgagcatttattcatgtatttaaagatgaaaaaagctttttctggctcctgatggaagagggaacattttttgccaacacagtttaacttcctgaatagagagagcatgctctcatctactttggggagtgttcaaagtctgaggccagcgtaactataaatggtagtgttttttccaaacctctccaagtcaggggaagcctctctagccgttgcccttgccttggtctcaatctctttatgctagggcccagccatggccctctctaagacaccacctaaaatactggtggtccaacataacttgaagggcagaggaggagtgtataagactttctaacagtggctttctgatcatatacataaacacagatttttgtcttaattgataatgatgagcctaaggtagtgttgttcaatagaaatataacccaagccacatactattaaaacataatattgaatatatttaataatagattaacaatatataattatgtatattatatattaattataactatacataattataataaaatacatttaatcataatgttaaatgttctagtagccacatttaaaaagcaaaaaagaaattaattttaatatttaatttaacctaatttatctagaatattattaacacataatacagaaatcattaacaagatattttactttttttagaccaaatcttcaagattcagtacgtctcaacttgagctagccacatttcaagtagtccatggccacacatggctagtggctaccatactagacagcacaggtctagggaacctattcttggccttcaggtattggtaaggcttcaagaagtccgacgcatatgaagatcttattcacctattttccttctctcagtcatctatcattagtcccatttcatgatgtcattttaacagaaatcagacataatgacagcaaatacttatatatagcacttactatgtgccaggaactgttcttggcatgcccccatcttaccccaattaaacgtcacaataactttacgaggtaaatatattattctcattttgtaatgaggcaactgaggcacagaggggttacattatttacacaagactgtgagacggtgacagggatgggattcaaatctaagtcgtttgcctccagagtccatgcttttacccaccaccctctcaattaaatttgaacagctcaaaataagataattactttcagttttaattataaccatcaaatgatccaagtctgctctcatgataacatggttagataatagcagtgatggcagatggaacagttattggatgcaccagcaaattaaatttaaaacaatttgggatccgagcacaaaaaccacagcaggtggggtcgaaaaggctgcaccgggtctggaggtttgtctggatgaccaaagtggtggtggctggggaggttaatgtgaggtccatggaaaatcttcttttggtgatttttctgagggaagggcctaatgctttcatcagatgctgaaagatttctcaaatgggtcttttagatagatatccctatatctgtctcagcaggggtagggagttagaaagaatcaagtaaaagaattaagaaaacacatctttttcactttattaatccacaggccgcaaaagaatcacactcagtgagcaaaatcagacccccacatgtgagctttctgccaaatcacagagacggaggctggtcagtgacaccgtagggctgaggccactcaaagtgctgccacccagtctcctatggagagccctgaacctgctgaaaatccttccgtggcttcctctaggttttaggatcaaggccaagctcctcagactactctaaaaagcccctgtggcctcatgcctggactctccctcaggcgcctcactgacaggtcccaaaatgcacacccccttatgcctttgtggattctgttctttctgcccaacatgtcctttccctacagtatcagtgggtcttcacatctcagttcaaaagtcaccacctctgggaagcctgtgtgaacatccttgactgcctcagcaacaacttctctgcagtagcgccaataaggtagtattcattcaattcaaatggcaattatacactactatagttatgtgtccctgaaggagggggatgcgttctgagaaatgaattgttaggggacttcatcgtgtgaatatcgtagggtgtacttacacaaacctagagggtacagcctaccacacacctaggctacatggtagagcctattgtgtctaggctataaacctggacagcatgttactgttgtgaatactgtaggcaactataacacaatgctatttgtgtatctaaacatagaaaaggtatagtaaaaacatggtattatcatctttaaaataggttgttttgtttaaaaaacattcagtcagtaccaatggtattatagtcttatgggaccactgccacagatgcagcctatagttgactgaaatttcattatgcgcatatgactgtactattggtaatattaaaagctggttttttatgtgctaggcactgttcaagtgctttacatgctcctttaatccccttggtaatcctatgaggaaggttcttttcattattccatttagtaggacagcaaattgaggcacagaggttaagccagtagtctaaggttacatggcttgtaagtggcagagtcaaattgtaaacccagacaatttggttctagacttcacactccatgcctgcctccaactagggtccacttccctctgctctcattgcccttgcacttactttactctggtgtctcctatattttagatttccatttattggtttctcccccaacaggtttgcagaatccctgaaggttaataatgtgtctagctcatttttgtctctccaggacctagtaaggtacttggtatatcgtagatactcagtaaagacacacacaggaaaacactggaatagcattgaaaggataggagccaaggctatcaacccaggcctgataaaaacgcaccagtataaagaatcttcaaatacacactttaacaaagcaagttttgacttcatcttttaaatccagccagttccaaggagatggtcacttcctaggcctgttcaataccagagggagaagaagcaactcggagcaactcggagcttggcagacttgctcacacctccaagttcatcagttttatttgactttgcatgtagaactaagtaataacatgcttaagcaatagcatacccagtgtcttggctggccattatcaaggactgccagaaaagacacatgctgaaaaatctcctttggctgcctggacatggcttggatatttctaccctggagttccaggatatatttctttccattactatctaaactcccctcagatggctatggaatttgaacttgtagaagaatactttcctctaacagtgagaaaggcaaaaagttttaagatctagaacatatacagatctctaggaagagaaggagctctctctagcctggtcagagattgtattaggattgtggcccagcctacccacttgcagataaatgcagtcagccataacatccaccctttatactgcatctagaatgtaaaagaatccactagcttcccatgtgcatggacggatgtcagcatcacttgttcttaacaaccaaaccataaatctgtattctgactcttgccatatcatctccttacatgataagaaataatgacattaatttatttattattgagaggtatactgaatgtaaatcatgtgctagggatggttgtaggtgctggagatgcagtggtgaatgaagtatattacattcttgacttgaggcctttacattgtaatcggggacagcaaacaaacacgtatacaaataagtaaataagatcattttaaacaataagttctacaatttttttcatacatgcaaggagtgaagtgacctaatgaagagtttaacaaggtctcttcagcagctgtagggaggagtattgaagaggcaatagtgaacaaatggtgaccaagtatgaggccatttgattgttcaggtgagatatggtacctcagatggagagaagtagatgaattcagtataggttctggaggtaaaacaattaagacttgctgatgaagtggatacagggagtcaagcaacttggtcaatgatggtttcatttactcagggagaaaacagattgacggaagaaaaaaatcaagaattctgatgtgatctagttaactttgagacatccaaggggggatgtcaagaaagcattaagaagtctagaaccatactgtccaataataggtacatgtgggtctttaaatttaaatacaattaaaaactcacttccccagttgtatgagccacatttcaagtggccaagcagccacagaggcagctactctatgcaacagcacaggtactatatggtttcacttgcaaattctgatatgatgttatctcaaaaggcaaaacagatgtaaaagggcttttgacacacataaaggacactactgtagggataaaaggtaaattctccacaaaattggggcatagttgagggaaatatatcctatgctttaagtctatcctacaaatttgtctttattagatgtttggagggctaccaactttgtaaagtaatactatatgtgtcaaagaattataaattcattcttgagctccaaaggttaaaaacagtgggttaaaatgctggcattttgccccattgtacaacggcttctgtcccagagaatggtacaccccgaaaggttgaactggcctattttaaccaaatggtaccaccccattatctccaccttgggactggctcctggctggaagagctggtctaagctgttcatcaggagaaattctttttacctggttactgtcctaatccacagagagcttctgaagacaaagttttgtttttaattgaggaactggtggtatatgtactcaactaacttgcagataagttgggggaaaagtattctgataatgccaaagacagtataaattttaaaaaaatacacatagattcctatttcatcacactttaagagaataagtgaaaaagagtaaacaagaaattgaaatgttacactcaacataattttttccccatttttgtactgaaaggacaatggcagttttaaaaggatggcaagcttctttggaatttacccatatttccagcagtctagtgctgctatttatttttgcatgttacctttgatagaaacatgtgtttttatgttactatggccatagtttatatgctattagtagtaaaggctttgaaattggacagatctaggtttgaatgtcggatcctcaactaatgagatgcaagtccttgaacaatttatctctagtcctcaatttcctaaagtgtaaaatagggctaatattaccttttgtatatacttgctgtaaggataaaaaaagaaaatcttagcacagtgccactaggacgaactccatgaattatggctactatttctttctaaaatttcatttcaaatatttcagtatttctacacatagacataagtgtttcatgttgaaaagccacaatttcctaaatcaatcccctaatgctggatagttaagttactgccagtttttattatcacaaacatgattacaatggacatcttcatggcttagctttttcattcttttatcttatttctctggcttctctaaattcctaacggtgaaattactggtttttgcttttaaaagggtttttattagcatacaataatatcaccagcaaaataatgcacagttcctgagatcttcatattttatacataaaatagtattaagactgaagagcttctgcacagcaaaagaaactaccatcagagtgaacaggcaacctacaaaatgggagaaaatttttgcaacctactcatctgacaaagggctaatatccagaatctacaatgaactcaaacaaatttactagaaaaaaacaaccccatcaaaaagtgggcgaaggacatgaacagacacttctcaaaagaagacatttatgcagccaaaaatcacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgtgcatgtatgtttactgcggcactattcacaatagcaaagacttggaaccaacccaaatgtccaacaatgatagactggattaagaaaatgtggcacatatacaccatggaatactatgcagccataaaaaatgaagagttcatgtcctttgtagggacatggatgaaattggaaatcatcattctcagtaaactatcacaagaacaaaaaaccaaacaccacatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaataataaaaaaattaaaaaaataaaaataaataataaaagcagtttgccaatttctattaaaaaaaaagacttttattttgtatttgtaagatcattaggatcaacatttttacatgtttgtttattaatggtgtgtcacctcgaaaaacaattaattttatattttttggttattcgtatactatgatcctgatgtttttcttgtaagtttgaataagttctttatagcgcacagtaatcaacaggtaatatatgcatttgctacaaatagattcccaaaacttacgcaattttaagataagtatcttttcacttatatagcatttcataaataatgtgtcacagctatattttgtataaacttactcaagagctatgatattgcttcttggcaaaatgtttggcttttgattgtgtctcaaagtcaatttatatccacgctgatcatcatagcaaccctgtgaatgagctggggagtataacaatgttgcctgtacggcagagaaaacagatccaaacaggccaggtgactgagacaggatcactgaatcctgcagctggccacaaccagactctgaatccctctttctctgagtcacaggaccccttgtgaaaggaagcttgcaaggtaaaagtgaagagaagtattttgtgcaaaatggattattatcacagcaccaattctatattgtttcctataagaaagcctttacacacagcatcagagaaccatgtttacttcactggaggatctcaagaaatgttagcattatttcagcaaatttactataacaatggctcacaaaacggatccaccctcacacagttttttatacaggcaaaataatttaaataatttaaacctaaattaagttttacttgattattattattattttttacctggcaaaaataccacttcttctcccaagtattcccttattctttggctcaatgaaaccactcttctcttagaatttctacaaccttttctacctcctactttttatcacagatatttgggaatgtgttgcacttctctgactgggtggtaaggtaccagtggtccatattttagttgtatctcctaaatcacctggcatctttctctgcatggaggagcactcgttcgatgttttacagagatatgggagaagaattttacatagttaagagacaacagttttttaaaaaatgtaattaaaataagagcattaaagtacaggttgcactaactgtattctctttgctacaccattccttactttggcaagcatactatcatgagacacttctaatgcattcttaggctggaagtctgcattagccaaacgatactaaactacattaaacagaatgtctaagaatgtttccaaccatgtacaaatctgtataaatatgtaactatatctgtgatgcttttatttgcaaattcagataaaacttatttctcaaaaattctctgtgtacacaacacagacacacacacagcacacaagtactaaagtcttggtcagcatttgggaaaaactcagataaaaatatgggacatctgtttcctaatactaggaaaattcacaggaaatgattaatgttaactagggagaaaaataatctggatcaaattatgaaatgaaaacatccaaaattcagaatttaatacagtatagcctgtgagccatgagatcttcaaaagtggggatgatttaacattttattgaaatatgttaccagtagaaatatttttattccatgtatataccaataaacaaaactgaataccccagcctatacaatactttcagattctgtgtctccccactgatatttatgtaacccttggcagttgaggttagctgtttcgtgtctatttccataacatgcccagtgccttgtgggacaaattaagacctaacactaaattggacggtggtccccagatagagaggatggggctcttttgagaaagatctagcatagctgtgtctcccaaggagaactggagggacaatgacagacagccacagagcaaggccaaagaaaactgtagaggaagagggtttgtagcttgttggctcttccaccatcctgctgcttgtgagtgtctctgaacctactatgtgtttggcaatgtggaaggtggtagagacaaaacagagaacaaaatttagtccctctctgggccagatgcagtagctcacgcctgtaataccagcactctgggaggctaagtgggtggatcacttgaggtcaggggttcgagaccagcctgggcaacatagtgaaaccccatctctactaaaaatacaaaaacaacaacaaaaaaaactagccaggcatgatggcacgtgcctgtactcccagctacttgggaggctgaagcaggagaactgcttgaacctgggaggtggaggttgcagtgagcagatattgagccactgcactccagcctaggtaacagagacttatatatatatgtgtgtgtgtgtgtgtgtgtgtgtgtgtgtgtgtgtgtgtgtgtgtgtgtatgtatatatatgtgtatatctgtgtgtgtgtatatatgtatgtgtataagtgtgtgtgtgtgtgtgtgtgtgtgtgtgtgtgtatagtccccctcctcaaggaacccacagtaagtcatataaacaactcacgaggccaccatagctccagtggcacataatctaatcgcagtaagtacaactaactctgagaacacaggggacacttatgccagtctggaatgatcatagaaggcttccaggaggaagcagtgtggaagctaaactgtacagaatgaccagggtttaccacaagaggaaaggagggaggtacaagtaaggtagagggaacagcttgtgccaaggcctgagaggaagtgagtccctaaggatgcaaagagcttggtgcactggggcaaagagttctctagtggagtcctattaaactaacaggcaatagtcaagcaaagagttctcaagtggagtccttattaacaaataggcaatagtcaggcaaaacctaaaggaggtaactgtagtgaaaaccacaggaccaacggaaatgacccagaatctctagcatcttcacatcagaaagagcactgacaggggggacagccaaggcccttttaggtaatagacctctagagagagggcaagaagataaattgtaccatggctacaacctcatcagagtcaatgctggtttccaattcacaggaaaaaccaatagccagctacccaacccaacagaaaggaagagtgagcaggccttattcacaaccctaagaggacggcagaattatttccattttacaggtaagttgctgtttttagaagacagtatttatcaatattcctttctattgattgatccagcttctgactaggaaaaaccaactcatcttgctttgcctgggacttcccagtttttgtactgaaagtctcatgtcccaggaatcccctcagtgccatgcaagccaagatggttggtcagcctactcagagtttgtgaggcacatgaagtgggcaatgggatttatgacacaggtttttgtataggaactggtgcaaagttacatgtgactgacctccccaagctaacttgaatcctttgaaccacggaaccttttggaatagcttagtggcttctcaaaggctcctatataatttgccataatttacactgaataatatttgcaaagcaaaagcctagctgagggcttagtgattactatctgtgtgctaacgtcaaataattgcatacttcacagcaactagccagaagagtggtctgaaattagttgttgttgttgttaactgaaagttaaccaaatatctttcagctttaacttttttgatttgttttgttttgttttgttttgagacagtgtctgattctgtcactcaggctggagtatagtggtgcgatcaggtcacagttccctgcagcccctacctcctgggctcacacaatcctcttgagtttccctggtagctgggactacaggggcacttcaccacacccagctagtttttgtatttttttttttttaaggagatagtgtcttgctacgttttccaggctggtcttaatctcctggcctcaagccattcttctgccttggcctcccgaagcataaggatttaaggcatgaaccactgtgcctggccagctttaacttttgacattgaaaatcttcctaaaataaattagtttacttacacacgaagagtagtatacacattttcatgtatctttgttaactaggaattctaccatgccttacttattgcaatggcttacattcttactgttcgacagatttaagaaggtttagaagacaacaagaatgcactatagtttccaataaatacagtcacaaaaggatattactttgtggcaatatctgacaggcagagagtggctgacaaatctttatagaatgaatgatggtgggaccatacagaactacgaaaaagaaaatgatgaggacagtgaatgagataaaggctatacttgtgcttttgctacagtgctgttgactaaagcagcgggagctcagagctgaggcacacagttcttgtccaataaaaggaaggaaaagctcttcaagagcagtcctttccttacaagggtggtaatgaataaaataggcgacatggccttcggtctgcagaagatgcagaaagacttcaatggtaagaccaagggcccgctattaagtcccgattcaaaaggcatccccccaggaagctcaggaaacgtcatccaggctaatgctctttggtgagaatcctgacataggaatggatgaggacatgtgccttagaatctttttcagaaaaaaacaatgatttctaacacatttttggttagctttcgatgaaaagatatttctaacatctaattgtatttgaatggaactatattaaaaacacttttcattagccttagaaaactaaaaaaaaattaagagtaaaatttagcagtattttttactgatgatataactatgattcctctaaaagttccggttttattggagtagtcaaggtaactgagattttgctatatgttgacaataaacattttgcccatgaggcttagttctctaaagctattactctttttgccgacacctttgcatcagacatagatagaatcacagcagacatattcaggttatgtctgctacagagtcaggcggcacaatcgggcaggatgcagccaagggcactgccctgagcctggatcagaaaaacaagagccggaagggtttgtttccactctgccagacctttggtgtagatgagcgcacttccccaggccttggactcagaggaagaaaatgagaagtgctcctcaggtgaggctgtgagcctccctccaagacctgcacattcacagatgtgtgaggtgggtgtgctataaagtatcccatgctagttttggggctttgactccgcagaatagtttagtcttaaactctagctaccaaaatatggattagcaaagaaatttttctgtcatcgaaaaccaaagaagtaagatatacagattctaaggacttgctcatcttttcctgtatcatcaagagatcaacagcttattaaaaaacaaaaacaaaacactcaaatgtgttcaacacagtccactcaaagccacaactcaacaggaagacaattctgaagaaaaccagcatatccagtacaacccacctgttcttatacctaccacctgcttcctgggtaaagccacctttgctgcctctattgtaatattagtttgcacccccgcctccaccaggcatccttacagatctttccattttacatacatttttacatacattctgaactacacaaacaatctgctgcccagcgtttagggaaatatacaagcatataatcattgtactagccaaaaaaacccagagccaagaaaaaaaatctgtcatccactataccacagcagggagatttaaaggcagctcagggcattcaataacgttctatctgtcaaatcagccacttctgtgcctatcccttttcctcagatcccctgttggtgatgtatttatgtatctgcatcgacaacttgatcgtaaggtcccctgactgcataggccatagtttattcctttttttttttttttttgagatggaatctcgctctgttgctcaggctggaatgcagtggcactatctcggctctctgtaacctctgcctcccgggttcaagcaattctcctgcctcagcctcctgagtagctgggattacaggcgtgtgccgccaccaccacgtctggctaatttttgtatttttagtagagacaaggtttcaccatgtttgtcaggctgatctccaactcctgacctcgtgatctacccgccttggcctctcaaagtgctgggattacaggtgtgaggcaccatgcccagcccatactttattcctatatgtatttgttttccttcccacaaggattatttctttacttgaagcgccctagatttttcataaatgaaaaacacactctggatgtacttatttatatctaattttctaaaactgaaatgttcatagtggctcaggggaagggtaacacaagagttaattctgaaattcagttctatttatcttatttgtcaaagccagcttttactcctgtgaacatgtatctcctaattccaggaacaattgtggatatgatgatgtaaatacagtttttcttaatcttttaaaattcacactcatttctgataaccttatgttccctaatcagattctgatatacccatccttaggtgtcttagcaaactgtgatatgtattttcagtctcctttgctgaattctctcctcttcctcaaatctgatgactctcaaatctctatctccagtctcagcttgctctttgaacgtcagacttacttgtctgactgatttcttaacatctcccctaggatgcttagtaaggcatcacaaacaattgtgccttggccacaatcatctcccacactgctctcccttcttggggctcccaggggacatcaatggtaccagtaggactccatcattcatgcccttgttcaagtcaaaatcttcattcatttttggctcctttctcaccaactgcatatcccatcaatcagcaaatcctgtcagccctaccttcaaaatacctccagaatccaatcatgcgttggcatctcctctgctcccatctgggcaaactagcagcatctctcgcctggatgacttaaagagttccctctgctgatctgggcttcacacttgcttccctcctcaaccccccatctagtttccatcagtcattattccctagctcaaaactctccaacagattctcagcatacttaacacacttactcacgtccactccttggcccatcagcagctatgagaactggccttggctcactctatccagccacactaacccctcttctccttaaatctgccaagcaatgctctgtcttggggccttgacacaggttcttccttctgcttaaacttctcacagacactgcaggcctgcacatctcactgcctcacttctttcaggtctctgggtcaagcgttatctcctcagaaaggccctactctctcttcccagactctgctttgcttttcttcttggtacgtaccccttcccccttcctggcactctattttctatctattgaattattccctctccttcactggaatgtcaatgccgtaagaaaaggatgttgtttgtttaccgttgcactcccagtgcctgaggcaatgcctgacacaggctaggcattcaagaaaaaatacacattttttggttactgaatgaatgcatattctcaactggccagaaatattttattgaacttgatttttctgatgttcgtattataaaaataaacatttcctctttccccaagtgaatcataagataaggcatgatttttaaactacgtatgccttaccccctagattctggtatctgcccattggggtgttttgatatataaaacctcatggctacattctgaatttttactaagcatctggcatgttctgtagtcttttgcctctaactaaagcctcaaggctttattacctttaaaaaatgcttgcagaattaagctaataaagacattgtctgccttatttgtggtagtggcagtttttctcccctccagttgtatctgaataaggctggctcagatttcaatgccaagtagtttgccacacaacttttgttgtatggttccatgcagtttgggcctagcagccacagaaaacactgtggaatattaagacaactccttggaagagactagaagggagttcaggccccttctgccaggagtctccaatatatttgggttttctggctgcctggccagtattggtgcttttcagaagagcagtgtttccttcatgaatgaaacccatttatcatgacacactcagtggacagagttagctcccaggggacagtcgttctcccagcctctgacattttcccagtgtgacagtgaataccaccccacagagaccaatgtcactctgtgaattccaccttggactcttagcaaacctcagcttcagagagttcagtcaactggaaattgtctcctgtgtcttttctccttttcttgaagcataatctttctggatcttttatatataagactttggaatcattgtgtaaaaataggatattcttaatcctgactcatttgagaaataagtcagactcagcttagttcaaagatctggtcaaattctaacattagtgataacataaatagaaaacacagatgggtatcagttctgcccttttacctctttaataaataaaatgcaataaatcatctgcaagtcttggtgaactttgatttccatgtatttctttaaagcttaaaaattttgatctttgtgatgtgaaatcctattcaattgtttgggaatttaacttgttaggtggtttgtccaaaagaagaaaacggtagatatcaaatactaagtatttggtcattcaagtcaagcactttgattttttttttttttaaactacaaatctggcctcctagaatgttgtgcttgtgcagtttaactctggacttaattccactgcagtctgcatccctctcgggctgtgcaagtggctttcttccgctgttctctgaataatgaacttgggaagagccaacataaaccccacactggtgacattctgaatgacccccaaattcctgcactcttttgcaaagcttcactgccagccctcctccctgtcccctccttcctcaaacactgtttcacatgtttttctcttcactcactttgttggggaagtattttgttaacagttctttgaccagtttcagcacacagtttctggcattagtcactgttgcagctttttagaggcccaccacttgactccagaaaatatttctcttttgaattcgtttactcttttcttttgccatccaaaacggaggaggggggataaactctcatagagagacataacaggcacaaaaacctttctcctcagcataaacagaatcttaaggcaccaaatgggggctcgcaaatcctgaatcccttaacccagataataaagtcttacaagtaaaccatatccactaaactttaatgtctgcttttgcttcccgcttattacttttgtgaaaatgtggccaacctaaggttgtccatccaccagagagtcctcaacatctccttgctagcagaacctgggcttgttggaatagagaccctgtgagctcaggagagatgggagctgtagtttaagggtgggtctttgccctgctcactccaatgaggcctgaggggagatgacaggagaatgctggggaaggattctgcttcctcacaaaagccaggggtagtgtgatccatgcctccttgattcccaactttgaaactggtcatgaggcacagaactgtgacggccacttgctgaccacgagaaagcatgtctcaatttaaaaaacttaatacaataaagacggtggatcacagagatgaaaagagcataggtctttcatggcaaacagcagaagcagctgcctcctctaagctttatgaagatgtggagaaacaactccctacttgttagggccaaattagttcagcttttctgttacttatagtcttgatatatataagatgacaaaagaaaggcttaaggcttcttaatttggtctcctctaacgtagaattgagaaaatttttgtttagcaaacttcaagcttatagggcaagtatgacttgctccagctatatttatatcatttagcacagaggcccttcggctttctcaatccagagtggtcgctccatccatctatccaaccaaccaaccatccaaccatccacccacctacctgccaacccattttttctttttttctaacaacaaccaactgctgaggcaggcatttcactaagcactgtggatacaaacaacccaaagtacagaaaatacgatacccattttagagataaggacacaggggtacagggtttcaatgtttttcctagaacctagtctacaagtgtagagttaggattcaaatctaggacgtgtgaattcaaaggccttgcgctttttactatcccatgcagcttcaaacagtaatctctttgttggcctgatttggaaacaacaaaaactgcactgctttttaatatcctgcaattttgacggttcccaaccctgccatccgcagttagttacactgcaccttttcttgacatttgatgtacccagaccaaaggtccactttccacctagaagtctgacggacaccatgcctgcaagatggcagcccaccatgatgatctctttttcaaccgcacgcaccttgcctctgcaggctgctgtctgaactgcgagtcagagaccttttctatcttgcttacctgtgttgagtacactctgtggcactcactaggtcgtccatacatatctgctgattaaatgtatgagaaaaaataagccaaagaataagatgctgtctcaggaaatcctgaatgccagttctcaggactcttaatttaatgagttggtatcacttcaaaaaccttggcagagagtcccattccagaaggtgtttaataagctgctgactaagctctctggatacaaggtttatagcaaatatgttctcatctgtgaaacgctggaaacaacccaaatatccagtatttggatgaaaagttgaaccaatggccacttatcagcacaggagtttcctttattgccattacaagaaaaaggatgtggagtgtgaggacacaggaaaagggcaacatgaaccaaggtcagatgcaaaggcaggcagaccaacagagaataaatacactaactccagctatgcaaaaatatgcacatggaaactaaatggtatgagaatgtgaagctgaactcacaagaatactttctcctacgggtacaattaaaattcagaatttaataattgaaaactggctcttctgtttaatctccatacccttcttatgatcgatgttattgaattcttatgaaatgcaggctcacaatttaacatgtgaccgatttagaaaaccatgccttctatgtgcctatgatgaaaataaatgccctactgacaaaagacatccatttatttggcaggctaaacatatctatttatttggattcatttatttgtcaggctaaacatatactacattatccccagtgtctgaatgctgtgtatgtgaaaagcccgacacacatactcttttcacattgcacattcagataacccagtctttccttttcaaggacaaccattccctgctgagactggcacactcaggatgctttctgcttgaggcctgcatttccatacctttcttttagctaactctggttcgttaaagaattcctgaacttgagtgtacctttctcaaataataacaacgagtacgactattttactacatactaggtatgtctgtaagcactttcctatgagctcatgtcaatcatgttttccagtatgacctcaatacagagtgtatgacagatagtaggcactcaataaatatgtatttactagttgggttatgctttagttcatgtaactctcatgtccacattataaaataagtattataattatcagtgtttcataggtggggtgcagataggtaaagtcaattacttaatggccaatattttgctaaggtcaatagaaatggggtagtgttgtttattttgtgttgctataaagtaatacttgaggctggataatttagataaaaaaagaggtttattgggctcacagttctgcagactgtataagaagcatagtgctggcatctgcttctggttagggcctcaggaggcttccactcatggtgaaaggcaaagggggaacaggtgtgtcacttggtgagccagacagcaagagagatgtcaggttcttttaaacaatcagctcttgcgtgaactaataaagtgagaactcactcattaccatgcggagggcaccaagttatttatgagggatctgctgccatgacccaaacatctccctctaggccccacctccaacattggggatcacattttaacatgagatttggaggggacaaacatccaaactaaatcagatagtcagcttcctacctcagctaaccacatttcaatccctggctcattctcaatgggattataccatcatgagttaaaaattaagtgataaaacacagacaatcatgctcatcagaataagttccaaaattatttttctactcatacctaacttgtcctgccattaagatacaggttcttgaaaggcagagaccccctgccctttgtatgtcaatggaaggtggaaatactctcccaaaatgcttcaccaagtaccacacaagaccattcagaagcaagaagtcccatggcttgttgaacactgagattcaaagtcaggcagcacaaaaccataaattaaatcacctgtgaaagccaaacaactcaagtatgaactacacaaaaataaaatgtaaccctccacactcactccatagaagacaactagcagtgtgcagcttagggaaaacagtcccttgctgtgatagttctgacttttgaaaaatcccaacttatttcactcaaatgattcccagttaaactctctacactttgccagaagaggttctgacctagaaaataggatgggaaatggaaaaaataaccatcagtccaattccagtcaaccagggcacgacatacccatatcatggcgggcacatagcatttaacgagagaaccatcccctcggagccaagatcttcctcaggtgactgcaccggccaggcttatcaatttctactgtaaacagggctgaggtgacacgcgtctccactggcaccactggatgaccacggtggtcttgaaaccagcctctttggctcaaatgccctttcctcagatccatcctactaattaaactagcccacccttgcccaaactccatttttgctcccatgttcaagaacttataggaggttcctttcactttctgcctcagtctgccctctcctgtttgctttccaatgccctacaccaagggtccccaactcccaggcatggactggtctgtttgtggcctgttaggaactgggctgcacagcatgaggtgagcggcaggaagcgagcagtaccacctgaactctgcttcctgtggactcagcggcagcatcaatttcttaggaagcacgaaccctatggtgaactgtgcatgcgcagaatctaggttgtacactccttatgagaatctaacttaactcctgatgatctgaggtggaacagtttcatccccaacccctctgtgaccactggccatggaaaaaccgtcttccacgaaactggtccctggtgccaaaaaggttggggaccactgctgtattgaaatatttttagagaaatggaagagaaaaaggtcagacagaaattatgatgtatttccataaagttaccctgtcttcctgcctccccatccccctctgccaccccgagacagcgagacaaacccctccccttcctccttctcctcagcctacccagtgtgaatatgatgaggaggaagacctttatgatgatccacttccacttaataaatagtaaatctggctgggcacggtgacccacgcctgtaatcccagcacttcggttggctgaggtgggtggatcacaaggtcaggagatcgagaccatcctggccaacatagtgaaagcccgtctctactaaaatacaaaaaattagctgggtgtggtggcacaagcctgtagtcccagctactcgggaggctgaggcagaggaatcgcttgaacccgggaggtggaggttgcagtgagccgagatcatgccactgcactccagcctggcggcagagcaaggctgtctcacaaaaaaaatataaataaataaataaataaataaatagtcaatatattttctcctcatgcttttcttaatacgtttctctagcttactttagtctaagaatgcattatgtaatatatataacatacaaaatgtgtgttaagtgactgtatatgttattaataaggcttgtcaacagcaggctattaatagtaatgtttttgaagagccaaaagttatacatacattttcgattgcatgggggttgtaaccactaaactctgtgttgttcgagggtcaactatagttaggaacatggctacccatttttaccaaatagtctgagtctgcttcccttagcagaaactgggccttttaagaaggggctataaggcatggcagacacgtttatttgtctctccagggaactgctcttcttcacatctttactgtacttaggataataaatccccaggcttggccataaacagcagagcattgtatagtattctacaatcatttcatgtttatttgtcctgactttgtatctagttaggtactgccaatgaacccagaccacagtgacgttcatggataaactttgctagaggacttagttttcatgtgtataccagcaactagaactgtttacagatagttctattatagtacttctcaaactttttggtctcaggaccctaaaaaattgataatcccaaaaagctttcaattactagcttaatctgatatatactgttagaaattgaaactgagaaattaaaaaatacttattaatccattaaaatataatagtaataaattcattagatcttggcaaaaacatttataaaaacaatgttttccaaaacagaagaaattttagtgaaaattgttttacagttttgtaaatctctttaatttcaattctctttgcacacctttttaataggagacagctggttttttttggtttctgcttctaaatccaatttttgtgacatgtttttgtagttttagtgtatgaagagtctggcctcacacagatacagatgaaaagtcttttaaggtatgtgtggatattcttctttgaaactaaaccaaaacttgataagtagtggcttcttacaggctggctgaaatcctttcaatgaacttcccgtattctgctatattaaaattgattagtctctcttgcattggaacagaactttaacccatgcagagtttttaacatcacacattgttcactgaaaaatattggttcactgaattatacaggttttccaaatgttgacacattacattatacaatattgaaaatgtactcattaacgtcatccctgatctcatcagcaaagtcgaaatatggggaagtggtcaagctcatggtggcagatacaagtattccaaaattccaagtttggcttgaatttttattattttagcaataaatataatcatttttcttgaagtgacagactattcttttttgagaaaatgtctgccaaatatccaagtctgaataatcagagcttgtcagacattctttcaagcaaaagcagtgtcaggtgaaaagatggcaggttcaacttgcaattgaaataatcacacaagcatttttccttgagacatactttattaccagcagaagagctttagtttccttattatgtcacagagaattttttaaatgtgctctcaaaattatgagacttaatttttactgcttcaaggacattcttaagtgaaaatggcattttggtttttttgagtgtgtgatgataagggatattactactgccttgtttaattagcagttttatccacctctgtttttgtaacatcattccaaatgtcaacacaatgaaaacgtcaaataatatcttaatatgattttaaacttgaccttgtgaactccttgaaaggatcatggagacccctagggtctatgtaccacacactgaaaacagttttaaaaagtatttaataaatgttcttgaatatctcaataaacaaatgtaacttcatattatggagggaggttctggaaaggtctaggagaccttttcgtttgagccaccaagactacactggatgtttaaaggtaaaggaggttaggaggagcacaagacaaagcaaagagccagaaatgggcaggaaactttcctagagcagaacagagaagcacaacctcagttgagtagcgtcttccatacagccaggtgtactatgtgcaaattacctgtcgcttcctcaaaacggtcccagaagatgggtcttatcatcctcacctatgcatccctgccaaggaaggcagggatcatgcccattttcttcactcatgaatatgtggaactctcacacagtggtcagcacatggaaagcacacaataaatattcactgaatgaatatatgaatgaggctcagagaaatgaattatctgttcaaggtcacatagctaggaagtggtggccacaggattgaacccaggtctttgggcaccaaatcccatgcgcttccctacatgctgatttcttcaaagtgatagaaactcaggccatacagtgggaggcttggatgttggtgcagttagtctatgaaccaagaagtttttataaagacggtaacatgagtacattcgtgctgtcgaaagattatacccagcgatacctgggatggcttggagtggagaacaaaaggaagaggagagagcaatttgtgtcctatttcagcattctcagtgaaaaagcctaatttggtggggagtgtcagacctcacaggtttccccaaattctcgcttaacggtgtgaatttggagaaattacctttcctgtatgattattacgttccgtatctgcagaatgggatgataataatctataatttcatagagttgctgtgaggtttaaatgaaaaaatgtatacaagacaaccagcatcgttcttcgctcaataaattttgcctataaaaaagtggaagaaaagggaggaaggaagggaagggggaaggaaaaaagaaggaaggggggtgaggaagaaaaaggagggaggtacaggggaggaaatatggctgagggaaggaaatatctgtggaatgcctgggtgaacctgggcagtgccagagggagagcaaatctataagccctgcttgtggtttcttgaccagagaatgagaaaaaggcattagatcatttcatgatttcaagcctgggtgaccagaggaatgaactcatatgaaggggccaaggaggctggtactgtagctaccaaagggcaaagacctggaggttctctaaagggaaggaatggatgaaggaagaagggcacagggtgaaagatcaatattgtttgcaggacatgtgatattgtaaattagggcaaatggaaaaatgagagaaaacaggatctgagagacaaaaaggacgcacctacttaaaaccatttaattggttccaaacccttgtcggccaggcacatattggctctacagccccatctccagccagccactcctgctgctctgccatgagatttcatgctttcaggctccagacttctgcatgctctgctctcactgcctctttcccagaagcaaagtttctcaaaaagtggcacttgttatttttaaggtcatatattaagattatgggaaaacaaaacaaaaaatcattagggagagcatcatttaaggcccgggctctctcaccatcccgaggcagtagtgtcccaggctacctctctttgccctgctgctgcatcctctatgccccagcacacacacactaccctctgcccctgtctagacagcctcagttcattcctttctcagggctcccactggactttactcctgcccaccactccctggttggtttcctgctatagcaaagctgggtgtctctctctctccctacacatgacccttgtcctggacatctctgcacacagcagacgctcagtccctgttgtatggttgatgaagccaggaaagcagacatgaagctataacagaagcagcagcaagaggagctaagaggtgttaagagagaccaagaatgatgaagtccagaaaaagctagtgcatttcgcaaagaaaacactggtgggggtctaacgtgggcattctccttggagggacattgcccccactagggagtagaagctggttctcaggggatacaagtaaaacatttcttagattacattggtctatggccctccaaagctcaatcctacatccccaaaattttattccttgatatttatcccattagggagaaaattttaatttaaagttagttggttgggcacagtggctcatgcctataatcccagcactttggaagcctgagacaggaggattgcttgaggctgggagttcaagaccagcctagacaacatagtgagacctcatctctataaattaaaaaaaaaattttttttaagttaatttatcttaatgtttctccttatatggtgacaatgaaaaaaaggttgagaagcactgatctggaggaaggtgattcggtaaaaggagtgagagaacagcagcctggaaggactgactgcagaagcaaatcacgaggaaacagtggtgacaatgacttttctccctttcttcatgggtgagcctcctgtgccatatctataatgagtgtgtacaacatatcaggccctgtgttaagtgctttgcgagcattattttacttttatcttcacaacaaccttacgaagttatgttccctttttagagatgcttagaaaatgtagatagcatatccaatgtcccataactagtcagtggtaaatgatgcaagatgaatacttagcacaagtctgacacagggtaagggtttaattatcataaccatgagcagaggaggcaggcctgaacacatctgttagaggagggaatgatgtttctgctacacagcaagtgtaccaacaaaacaaaacaaaacaaaacaagcccacgttatttgaatgaaacagcagtgaagcaaaaaacacgcaactggagaggagatgatggtgggtaaggaatctagacaacaggatggatggagtccaggcagaacggctggctttggcaaacaagagagaaagaagagggataggcagaagctgagaaagcaggttaaaggttgtggtcaagagatgagggcagggcctcagtagagagcaggagggaagaaatcctgttcccactggggccctgcagctgaggtcacatggcatgaattcctggtggaattaagcaacatgatactattactttctccagtaacctcttcaaataaaaatcagttaattaatattatgccttcttacttcccactgaccctagacttagaaaaggcaaccaaagtgctttagtgaaataattccccatcttttctagttatgaagacaacttcgtgccattagaaacaaaaaccaaaaactttccaagcactcagctggagaagctgtactttcagcgtgcactgagaaaatgctaggtgcacattaactctgtccagttgagacaactgatatgactccatagtgtctttatcataaaaatgcatttgaaaaataaacatttagccagttgggcaagcaaggagtttagttgttgtcactcgctcctaacaactaaaaagctgaacaaatggaaaaaccaacaattcttcttggatgcagtagagaagtaaagtgacagggcaaaccactgccccaaaagttggagagataggcaggtagacacagaaaatcatagtatacaggaatagaaaccttcaagcagaagcctgcgtaggaaccagcaccaagatggaaaaacctgagctgtaaccaacaaattgctagagacttcgtgtggacaagtcagggagttaaaaacttcaggggaatctagtaatgggggaaggggaagcatgtttgtgagttttacctctagaagctctctcaggtcctcactgaatggggaagaaaaatcccctcatgcttccagcagggggagggtgaaaaaagcattctgaaatataccagaacattctattcttcttaatatggactgccctcagaggaaactatttttccagagcctaatctgtttgggttttatcagagcctaacttatctggggaaaagaaatacccaactccagtactctcctgttaccctgtcccacctaagggaagaaaaaatactgggcagcacttgtgagttcatagtcctggatgcaagactcatctaaagcctcagatctaaccacagaggtacagaacacttctgttatcccacacttcacctccatgttcctaaaagcctatttatcacatttccttcatctgggacatcatgtctgcctttcattcaaattacaaggcatactaaaagacaaaaaacactgaaggaaccaaacaagcatcagaaccagaatcagaaattgcaggaatgctgaataatcagaccaggaattttttaaatttaagattaataagctaagggctttaatggaaaaagtaggcaacatgcaagaacagatgaataatgtaagtagaaatatggaaattctaagaattttaaaagacagaaataaagaatgcctttgataagttcattagtagactgaacagggctgaggaaagaatctctaggcttgaagatatgacaacagaaactcaaaatatgaaaagcaaagagaaaaaacatgaaaagaagcaaaacagaataaggattatggcatgtctacaaaaggtgtaacatacatgtaacaagaatgctagaaaaataaggacagaagaaacagaagcactatctgaggcaataatgactgaaaattcccccaaattaatgtcagacaccaaaccacagaattcagaaagctcagaaacaccaatcagaataaatacttaaaaaaaaaaacctaggcataacatattccaacctcagaaaatcaaagataaaaacttttgaaagacaaaagaaaaaaaaaaaatcttacccatccaggaccaaggataagtacattgacttctcagaattcatgtaagcaagagagtggaatgaatcatataaagtattgagagaaaaaaaacgaacctagaattacataccctgaaaaattatccttcaaaaataaaagagaaataaaaatgttctcagattaaaaaaaaactgagggaatctggtgccagtagacctgccttgtaagaaatgttaaaagaagttcttcagagtgagggaaaatgatataggtcagaaactcagatctacataaagaaagaaagcaagcatcagagaatgcataagtgaagaatgcataagtgaattttaattgatttaacagataatactttgattaaaaaatagcaacaatatatccaatgatatatgtttatgtgcatacatacaattgatcctggaacaacacaggtttgaactgagaaggtccacttctacttggatttttttcaaacaaggatgaaaaatacaatatttaatatttacgggatgtgaaacccacatatatggagggccaactttccatatgtgtgcgttccacagggccaactgtgggacttaagtatgtacagattttggttacatgcagggcagaggggatggtcctggaaccaatcccctgtgtataccacaggatgactgtaaagggatagagaaagacataccatgctaaaactaacagagaaaacaggagtagctataaatttcagacagagctgacaaggaaagttactaggaataaagacaggcatcacataatgataaaggggtcaattctccaatacaacataacaatatttgtcatgtatgcacctaagaacagagtatcaaaataagctaggtaaaaaactaatagaacttaaaagacaaatagatcaatccaccattataattggagatttcaatgcccttctatcagaaatggacagatctattaggcagacaatcattaaagccaacagttgaacttaatggcactacccatcaattggatataattgacttctatagactacttcatccaacaacaacaacagaatatacattcttttcaagttcacatggaacagtcactaacagagaccacacactgggccataaaaaaaaccttaacaaatttaaaaggatataaaccatacaatgtctgcttttagacaacaatgaaattaagctagaattcaataacagaaagataacttgaaaatctcaaaatacctagagattaaacaacacacttctataaaatacatgagtcaaggaagaaatctgaaatttaaaaatattttgaactaaataaaaatgaaaatacacctaatcaaaacttatgggatgaagcaaaagcagtgcttagagggaaatttacagcattaaatacatatatcagaaaaaaagaaagatctaaaaccagtaatttaagcttccaccttaagaaactagaaaaaataaattaaattcaaattaagcatgggcaaagattaatatacaaagaaaaataaaataaaaaaattcaaattaaagaaaaaaatcaaagcaaaaaaaatcaatgaaattaaacagaaaaaaaaattgagaaaaatcaatgaaaccaaaagctgtttctctgacaaggtcaataaaattgataagcatctagtgagtctgagaaaaaaagaaagaagacaaattaccaatattagatataaaggaggggacactactacagatcccatatacattaaaaggctaataagggaataaatgcacaatctatgtacacaaatttgataacccagatgaaatggacatactccttgaaagatacaatctgccaacattcacaaaagaaaacagataatctcaaaaggcctatttatattaatgaaattgaatcaataattaataactgttcaaaacagaaagcaccaagttcagatggattcacttgtgaattcttctaaacacttaaggatgaaattataacaattctctagaatctcttgcagaagacagaagcagacagaatacatcctaactcattctatgaggctaacactaccctaagaccaaaagcagataaagacattacgagaaaacttaagagtatctctcatgaatgaagatgcaaaaatcctcaataaagtattaacaaactgaatccaacaatgtaaaaaagaattacacactgctaccaaagcggatttacctcagggtaagtaaggctggttcaatatttgaaaatcaattaatggaatccatcccatcaacaggctaaaaaagaaaagtcacatgatcgtatcaacagatgcagaaaaagcacttgacaaaatccaacatctattcatgatttttttttaaaaaaactatgtaaactaaaaatagaggggaacttcctcaacttgataaagaacatctacaaaatagcccatatttaatagtgagtaacttggagctttcctgctctatgactaggaaaaaggccaagatgtccctctcatcactgcttttcaactttttgctgcaattcccaggtaatgcaatagtaaataaaagaaataaaagacacacagataggggaagaggaaataaaactgcctttttcaaagatgacatgaacatctatgtaaaaaatctgaaaaaactgacaaaaagattcctggaactagtgagaaataatagcaaggctgtaaaatacaaggttaacacagaaaagtcaactgctttcctatagaccagtcatgaacaagtggaatttgaaattagaaacacattactatttatattagcactcccaaaatgaaatgcttaggtatcaatctaacaacatgtataagatctgtataaggaaaactataaaatgctgatgaaatatatctaagaagatctaaatgaaagagagtccatgttcacagacaggaaaacacaatattgtcaagatgtcagttctccctaacttgacctatagattcagtgcaatcacaatcaaaatctcagaaaattattttatggatataaacaaactgaatctaaagtattacgaagaagcaaaaggcctagaatagccaactcaatattgaagaacaaagttggaggactgacaccacttgatttcaagacttattataaagctagagaaattaaggcagtgtggtattagtaaagaaacagactaacaggtgaacgaaacagaacagatcctagaaacagacccacatagtcacctggtctttgacaaagaagcaaaggtaatacagtggagcaaaaatagtattttcaacaaatagtgccagaactggacatccacattccctgcccccaccaaaaaagaaagaatctagacacagacctatagccttcacaagaattaagtcaaaattgatcacagaactaaatgtaaaatacaaaactagaaaactcctagaagaaaacataggagaaaatgtagatgaccaagggtatggcaatggctttttacatacaacaccaaaggcatgaaccacaaaagagagaataagctacacttcattaaaatgaaaaccttcttctctgccaaagacaatgtcaagagaatgagaagccacagactgggagaaaatatttgcagaagacacttctgataaaggactgttatccaaaatatatataaagaactcttaaaactcaagaataagaaaataatttgattgaaaaatgatcaaaagtgacctgaacatatacctcaccaaagaaaacatacagatggcaagtaagtgtctgaaaataggttcaatattacgtcactggggaattacaaacgaaaacaacgagataccaccacacacctaccagaatagccaaaatccaaaacactgatggcaccaaatgctggtgaagatgtggagcaacagaaactctcattcactgtgggaacgcaaaatggtacatccactttggaagacagtttggcagttaaaaaaaaaattagacatagttttaaccatataatccagtaatcgtacaactttatatttaccaaaataaactgaagacatatgcccgaaaatttgcacatggatgtttacagctttgtacataattgccaaaactcgaaagaaaccaaaatgtcctttagtaagtcagtgggtaaataaactttgatacatccatacaatagaatattactcagtgctaaaaggaaatgagctatcaagccattaaaagacacagaggaaacttaaatgcgtattactaagtgaaagaagccaatatgaaaaggctacatactatatgattctgactatttgacattccactatggagacagtgaaaatatcagtggttgtcaaagggttaggagggagagaggaatgaataggcagagcacacaggacttttaggacagcgaaactattttgtataatactacactggtgaatacatgtcatcatgtattagtcaaaatccatagaatgtagaacaccaagagtgaatcctaatgtaaactatgaaccttggctgataatgatgtgtcaacttaggttcattgattacaataaatgtaccactctggtgtgggatgtggatagtggaggaggctatgcataggcacagtgggtatacaggaactctctgtactttctgctcaattctgctgtgaacctaaaactgctataaaatttaaagtttattaaaactaaaaaaagattgatttgtgagacatttagtctgccgcaatgtctgctttacatctggatttgcaaaccaatacaataaattctccctcctcctccccaccttggaccacaggttgggaatgacaggtctacaaggaaggtgagtggcattttggatatggaagggatctggccttacccagacctggttctaactccagttctgtgatgaccgcaatgatgactgatgagttactgaaactcactatgtctcagttttattctttgtacatggggacggaaatactctaaaaggtttttagcaccaaatgacactgaatttattacatgtaatacaacaggtagttagtgttaacatttctgtttgctagaatcagtggttcgaccccctggaccggcagcatcagcatcacctggaaactggttaaaaatgcaaattttcaagctgcaactcaggcacattgaatcctctggtggtgggcccagcaatctgtgttttaacagccctccaagtgattctgatgctcatcaaaatttgagaactgctgctctgaagtcatagttttcaactttctttttttctttataagcagaggaatcctttcttcaaaagggatcttattcagaaagctgatccgtggaacacatacagttgaactggttctgattgaactgggtagggagagctcgatgtgtgccttcgaggtctcacctggttccctgcagccatccccaagggacctctggggcagggaaatgctctttggccattagagatactacaatttttggtggcaccattgacagaattaaaggactaacacaacactaagcgattcaaccataattacaaggcaaaccctgctgcggtaaaataatacttcctggggtttccaggggcatccacaactaagccactctgcactgggtcaccctccagtaccacatcactggcctgacttggctatcttacatgcttgggacaaaaattttcagaagtgacatctggctctctttgcaacatctctttgttacatctttgcaacatctagcctcaacttgatgttacactgcctgttgcccagagcaagctgtaccctattcacatcaggtcaaaagacctacttactctgtggtgtcaaaaacacattttatgtttcaatcaaagtttggtggcatactcctgaagagagctgaggctcagcagtaagcagtagacatgtcagttgagaatcactgtctaggaattaagtttgaaaactattgatgtagaggctataaccaaggagacaatcatgggagggtttttgctgtatttgtttacggaagaacatgcagtgccaagtattcaaatgaaacttacataggctgacaataagtaaaggagccaaagaaggaaaatcaagatagacagtcacagttctcaggaaaagggatgtgctttgggtttccagataaacagctgactatggagtaatggcttagggaatgccaagttaagcaagttattataaaagctagcacccactgatcaaatcagtcatctttcattagtaccatgtctcccagctcatatttcatatgggctgtgggttattattttctctactctggcaatgaggatctgctgcagcttattggaaaaaaaaatctgtatcaaaaccaaaaatatttccagataccatagattattaaaaaataaaggttgcaaatggagctcatctcattgattttctactttgagcctctcctaatctgagagagggtagaacgggtgttaatttcagctgacagataaggacactgaggtatgggcagactatgtgccctgctaaaggtcactgataatcactagagagccaggtctaaagtcataatgcttcagaatggaagaggcctcaatgagccatctactccactcatgtcaattttacagaggagctaactttcatcttgagaggtaggaggggaggagataagacttagagtgattctcttggtttggcacaaagcagctgcacaggagccattcgaaaagaaggcctctcacttggtgagaatgaggtaggagataaggataaggcctttcctcctcctaaatgtctataaaagctgagctacccaaaatggtagctatatattaacaagtttaattaaaactaaataaagcaaaatttaactcctaagttacagtagtcatatttcatatgctcaagaggcacaagtggctggtggctatgacaccagacagactgaacctgtccttcattgcagaacgttttgcacagagatgctcttaagtacactcttcatgacaaggatatagttgctggaatgggcagctggaatcaggaatcctggagctgccaccaattagctatgtgaacttggcaaatctctgggcatccatttcttcatttgtaaaaagaagttaggctccataatgacgatggcccctttctgttgtaacatcccataattctgtccccaaagctccagatggcaagctcctgactctggccactcttctttccaaactgggccctttatcaaattagatcaagagaacatgctcttggacttatttcccgtagaaatgcagttgctgaatacgaatagcatcctctaattatttcaagggtcatcataagaaatagccacaagaaaaatttctctaaatatttaccaggaagaaccacttaagatggtgaagaacctatccccaaagcccctctcgtaagaacctacacctacatgataaatctggtgcagtttagggccagaaaaaaagtatatttctccagaagaattggtatgcttccttttaaccacagaatgaaaacaacattgttcattatgatttttaggcatcagttagggcctaagcatgggaggcccctgttccaaggaaactggaacaattctgtctccagcacagagctcctgtcttccttgaccccactgaaagtacattttcagcagaggccacatttaacactttttaaaagtagagttaaaatgttaagtttttaaaaattaaatagttcactgatcccgctataccatactgtagaatataaacatggaatacgatgagaataaaaaaaaatgaacctcaaatcactgagctaaacagaattaattatactggaagaatttgcagaaggctgaattgtggcaacttttgcatcttttcctcccccattatctctatcacctcctccaattaaattaagttccaattaattaaaatggcaagcatttattgagtatctaatctattcagtgtcaggcatagttgtaagtattcatatatatatgtgtatatatatatgtatatagtagtatatacacacatatatatgtaattaaaacttatgcctcacagtaaccccaggaggaagataaggtaacttgttcaagtttacataggtagcaagtgtcagagctgggatttaaaccctgccagtcaggctcctgctctctaatactacatgagccccctttttaatactgacaatgaaccttttcccacctttaaaagtaaaaatttaaaacatcattagaaaacattacagaaacacataaagtaaacaaaaaaaaattgtgcttgcttagcaaacagctttcagatttgtcccttagcactcttctacactgccagccatgagcccttcctgtttagaaattttagagaatgccaactctttaattctgtcatttttccaacattcactctgaacttcttccgcattgttttctggtgaaataactaaaaatcctgcatgtagtgtaacagtcaactaaaggcataataaccattagcaaaactgttcctacctattaattccttgcttaacaagggtgggtcacaataataaaaagacaatgaagctgggaactgacaattccagtctttgcagctgtcatgagacagtttaaaaatgaatttacataagtgattgctgggctttttataaacatggtacctgccaggaaacagttccactttctcttccctggactttctgtcctcttgtagattctgattctcgagctttacaatgctttatatgctttcatgttttatatgcttatcaggacaatcttctgtggacagtaaaaggaaacacgtctcttaaagctattagaaaattaacacttgagttatgtgtttctttagtcctaggggtagtgtactcaaacaggcacaggtttcaattctggctctgcagccttgtacaagttactgaagctctcttgagttgtactgtcttctgtaaaatgaactaattatattgccctaatggagttgtaatgccaggtcaacaacagacacacaacaaagttacttcccataatcaaagttgtaaaaagttagtttcaaaaccaagctgcacttttgagattccatttttcatttttatccagtttgtggccattcccaaaggactcctttcaggtgcttctggaaagtgttaccatacaaaagacttctagttctcaagggggaatggagaaatacatgtggattggaaattcaatccaaacaaaacctctctaaaaattttttaaatggtatttgtatccaggaaatcaaggccacaaatcgtttctatgaatgagaactttacaggttgccttccctcacaatttttccttcacttatatccctgataaaaataagaaatgctgctggatataaagcaaaattaatgttgaccactaaagccatttctagtcaaaattcaatagcctacatacacctcttgaaaaaacaatttgctcccaggctccgtatgatgacgctggccatgagtaacactcatgtcccagaatcctcagatttagctttctcaagaaaactttccatgaaacacgacttgccaggacaaggccttgcggaggctccttgtgtacctgtggccctcatccccagagtgctgtgctgttaccctgtgggttactgtgtcgaaatggaagcggtgacgttcttccttcagggacattccttttgtttttacctagcagcatacaccaataatttgtaagtaggaagagttttctgttcatttttttcttaatggacagatttagacagcccaaaggtagggctcggtatgtgctgcggggaggggctcagagggccggcatgagggaggatttgtgcccaaaggcttctcacagactccgtaactagatgaggaaatgagccaggatccacaagactcctcagcggccaaatcccgagttctccttctgtcaatcatctgcactgcagagacttagagtacactccggcagcaagaaggctgctctcccagtgctcctgccttgaccatgccctggagttacctggaagctttattagagactgtaccctctgggccccatgccagggctgggtgcggccggggctccatgattttcagtcactcctcagctgatcctaacatgcacataagtttatgaaccgctgccctggtcccttctgccttcagtgaggctgcggaagctgctagagcctattatcttgagacttttttttcttttcttctaatgaaagaaaaagataatgtacgaaatcatacattttgagctttcctcaagtcaagaaagtttaggtcagagtccttagtgtgagtttatccctttgccccacccaccctaatgaagattacagccgaccgtagtaactggagcatagagcgtgctcctgggcagagtgcaaagggcaccctttcaaagaaggtggaagggaaatgtattgggaagtttatgaaggggagtaaagaaatttaagaaacagattcactgctctttggatatgcgtgcaagggctttcacgactttccaagcccctgccttcatctggactcctgttcctcctggacacactcaccctccagtctagttacaaattattcactcttaggacagggccctctgcctccagctcaagccagctggagacctctgccctcatccccaccccaggtttccaggtgggccctgccacttacggtgtgactcctaaatacctgtggggcagcagtgagccagaggggtggggaagagtatagatggggctctctccaggactgactcctgcgtactcagccgtcctcccaggacaggtagggcccggtgacaagacgtcctgagcctggccagcacccgacaactcccagctcactagatttaatgaggcagcacaaaagcaggagaacaagaggtgtggggctctaactccacctttgccctctgctagcccatgaccttgtgcaagtaacagaagctttctagaaagtgcctcagtgtccccatctgtaaagtggaaattaatgtttgactagactcctcagaaagctttttgaaaagtgcaaagtgctttaagttattttgatacaatacaacttctctagacattaattgaatcttctatgcatgggacactgcctatcactgacaatataaagatgaaaaaaaggccactgaattcaacgggtacaatatattccacagagcaaacagaaatgtggtagataaagctacataattcaatgtaataattagtatgatggctgaatagcatgctactgggaacccagacagcagaaaatttacatatgtccagagatgggggagagaagaggacaagaaggtgacatcaggtaaacactgatggtcaggtactcatctgagcactttatgtatacaatctcaagtgagcctcaaaacaaccttgtgaagtaggtaagtactgctttccccattttacagataaggaaagcaatacctacctacctggcaagttcagagaggcagtctctcaaagtcacatggctagtgaatggcagagctgggctttggctgtgggcccaaaacctggatcataatctttccacacactgtctccaccctaactatgaccccattcctgatctccccagtgccttgccctggctcaggcatagcccggcacacccctcctctgtgcttccatacttctgtattcacactgccatataacatgcctattattctgtcattatttgtttttgtgtctgtcttcctcattagcttactggtccttagggaagaaagggaaggcagcaggtgcttagtaaacagttggtgtttggtgtctggtgtttaataaatgttaataaatgttttcttttgtttctttctttcttttttttttttttttttttgcgatgtctcattctgctgcccaggctggagtgcagtggtgcaatcatggctcactgcagcctcaaactcctgggcccagaaaatcctcccacctcagcctcctgagtagctaggactacaggcacataccactgcacccagctaatttttaaaatttttgtagcgatagggtttcactaggttgcccaggctagtctcaaactcctgggctcaagcaatcctcttacctcagcctcccaaagtgctgggattacaggtgtgagccactgcacctggtcaataaatgttttctcaatggatgaaggaaaaaatgaaactatactaggcttcgacagactggtaggaatttactaggtggtttgaaggaaacattttcaaaagcaaaggcagacccttattcatccttatgtccccagagtcttgtacttattacaggtacttaataaatgtctaacaaattctaggcagaggaaacagtgtgaggaaatccagagagatttaaggttacacagtgagtttggacaacttggccaatgtgaatcacatagtgggtgtgtggggacacagaagtgcttctcaaattattcatggggaaagaccaggggttttttttttttttttttttttttttttacttccaattcaatatggaccaattctttcataaaaattcagcgaaaaggaactgccaaaaatgggacaaaatacaagtccagttcctaatcagattcaacagatgtaaaatgatggtcaaattgctataaaaattaccaaatatggacttatctagctgcagattgctaacaaagaggtctgtctgctgatcaagctttgcctggcactgagaaaggtggaggtaggagctattgtggagagccacaagaaagatgagcttgttctacaaaggaaagagagatcaagaataatgttcactgaggatttctgtgtggccggcatggttatgagtgcttcacacctattaactcatttacatttcataacttatctgtgaggtaagtgctattatcacacccgtttcagagatgagtaaactgagacacagccgttaaaaacattcccaagccagaggtggtaagaagcatcacgaggccttgaacctgggcagtgtgaatcttcattactagactgcgatgcctttggggaactcatagacaattttctattgtctatgagttcaggaagtgacccactgaaatttatgttttcaagaaatcatgctggtggcagtgtgcagggtaaaggtcagttaggaagccacaacaacaatccaggtgagaggcatgggggtagggagaagcagacatgcgggcgctttaggaggtggacccaggctttagttgggggcagggtgtccaagctagggagagatgaaggggagggaggcgttcctgatgactcaagggttcagagcttagcaacctgggtggatggaaatgtcttacagaaaacaggcaggaaagcaggttttaaggggacgatgatgagatcagttttcagcaaatgtctatctgaatttgaagagcctgagacaatctacagttgtgtcttaggaaaattctacagactgtgatcttcgtttactgaattcaggtagtcactatttttaccctagttctgccaaaccactttcctcctcctctttcccctttgcactggttacacttaaaatagtttaaaaagcagcagttccaaaaccctaaactttcctcccttcaaaaataacacagtgtgtatgcaaaatgccacactcattacagcttatttctgaacaaaaagcagatttccctgcaaattcttatttgcattttcattaaattcagattctttataatggcttatgtgatctgttctctgtctacttctccaaacttatctcctaccatgcattcactcattcattgttctttacactcctaccacaggagccttctttttgtgctcaaacatgcgaagcttattcccagctcagtgcctttgcactggctgttccctctacctggaatgctcttctccagatttaacctggctgcctcctgctcattcagctctcagctcaaatgtcccctccaaagagtggtctttcctggtcacctccatccccagtccatctctctgtctcagtcccctgctttgctaccttcacagcacttacccctttctgaattgacctcgtcatgtgatttttactcaaggaattttgtgtatcttgttcacagttgtatcccccaagtagacaatcaataaacatttgctgaattaaaaaaaaaaaaaaagatcagccaggcacagcggctcacgcctgtaatcccagcactttgggaggccgaggtgggcggatcatctgaggtcaggagttcaagaccagcctgaccaatatggtgaaactctgtctctactaaaaatacaaaaattagctgggtgtggtggcatatgcctatagtcccagttactcaggaggctgagacaggagaattgcttgaacccggatggcggaggttgccaagattgtgccattatactccagcctggatgacagagtgagactccatctcaaaaaaaaaaaaaagatcaacttggagcttattaacaactgaaaaacagatgaagagacagggcctttgtccacaaaaaatagcaaagaaacatccaagtacgagagagacaacacagggcagtgtctcctccctgtgtcccttccactcccagaagcccattcctccagaccacctggcggatgcctcacctgtcacacttttcaatgtggtattaccagaggctgttggacagcaaaacggtgccatgaaaagagtactgatttcagagtcagaccactcactactgtgcctataaccttccaagcacagtattcaacctctcagaacctgcttcctcacttgtaaatggagccagtattccctagctcagctactataaggagtgagaaagtgtatgtgaagttcctagcatatgctgatactcaaagggtaactatcatcagcttcatccagtttactgccgggacactatactctctcaattagggtttaataaatgcatttaactgtagaaataagtttaattgatattaaagatgatggatattacgtgaccactatgataatgatgtcaattataacaacagttaacatctgagcacttactagtaacaccctaagtactttaaatatatcagtagctgttttattcctaagccaaatatggtgtttcatcaattctaagaagcatattttgttcacattttaagatccctgataattggaatgattcttcatggtaggcagaaagctccaaggatgtctgtgtcttaatccctgcaacatgtgaatatattacattacatggcaaaagggactttgcattatgcaattaaggttactgaccttaatatatggagagtaccctataggtgggcccgatctaatcaaaggagcccttaaaaacagaattttctctggctggaggcaaagagatgcagcaaaaacaaaaacaaaaaaaaacatcagagagatcccaagcacgagaaggatttgtcataatgttgctagttctgatatgggctcaagggcaaggaccagagggagatctctaggagtcgaggatgcctcccagctaagaggcagcaaagagccggaggccctcatcctgtaattgcagggaactggagtctacccacaacctaaatgagcctagaaatgaattcttcccaaagcctcccaataagaggccaacaccttgattgtggccttgtaaaacccagatgagagaaatcagccaagcccaccctcactttcaatgtacagaactgtgagataattcatatttgttgtgttaggctgctaaatttgtggtaatttgttatagcggccatagaaaaactaacacactcttacagctgatgtgcattataatttaatcagcagctttttttttttcttagtggcacatagaatagtggcacatagaataatggcacatagaataccggcacatctaatcaatgacatctgaaatctgttgaaatacggtgttattatctctgttttgcaaacgggaaaacaggatctgagaagtcaggtgatttgcccaggagactgaaaccgcaaactcaagctctaaaccaggggtgtccaatcttttggcttccctgggccacactggaaggggaagaattgtcttgggccacaaacaaaatacactaacgatagctgatgagctgaaaaaaaaaatcgcaaaaaaaatctcataatgttttaagcaagtttatgaatttgtattgggccgcattcaaagtcgtcctgggccgcatgcgccctgcattatgagattattttgcaatttgtctgtaagctcataagctgtcattagtattagtgtattttatgtgtggcccaagacaattcttccactgtggcccaggaaagtcaaaagattggacacccctgggctagggtatcttgtcaaaaggccaaggaatggctgacatgacctccttcaggcccatgtctgatacaggaccacagagacccagctagctccagaagcagtcaaccccttttgattaggcacccaaaggtgctaggtaccccttctaggtactggaccaagatcctgtccttatgaagctgacactgcagtgaggtaggttaatataacaattgattgagataagtgctagaaggaaaacaaaacatccagagagctttaaaccaaccttcataaaagtcagaatgtacatattcaggagctaaaaagaaacagagcactgggcctggaagataaaatttttcctttgggatttttcatgggccactcattgctagtgtaggtactcccagagacagagttttttgttgtgagtttaaaaattatttttgtttttttgctttttttttgttttttgatggagatataggctaactttatactcaaattcataagactgcctcttgtgaatttccaaaaacaaagccactgccatcttcccatcaaatcataatttccctctctttcaatggcatttagtttttgaaagatgaaaattaattttatattaaaatagcatcccaagagctgactgaaagagcacttcaaaaagaaagatgattccatgcaactccgatcccacatcctttgtagagtcctgagctctggtttgacttcttacattgtgcttttactttcatcttctctttcaccctggaaatacagtagacagagctctgatggtgaaattaaagggagaacaggagcccaattcagacagtaaacaacaacaacaaaatacggcatgtataaccttccttcaggagatacagtgcaagtggaaaattctaggcttcttaaaaggaagtttttaagttttgcaggaaatgctattgaaatgtatatattctcaatctctctcttttgtttttgtttgagagggagaaattctaggctagaagatcatcttcatcatgttttttggagaagccccagtttagtaataccattagctgaaaactatttttaattcagacattagcaactggcataaaaccctactttccacttctcttgattttgcactgacaatttggcagcccactctacccttaggcccaaaagagccatcacatttgtaagtctgtatttaggagattctgacagagatgtatgcaagaggaaaggtcaacaaatgcccacaggaggatcaacattctagaaaagatgtaagaaccgccccaaaccgccatctcactcataatcaaaaatatttcaatggctctaaattaccgttgtgcagaaaccagcttagcaaaaataagaagagctgacacttttatggccattggctgtacggaaccgggacatccaatacattcctgatgggagggcaaaatggttcaatctttccggaggggtactacagagcactgtgattcagcagtcccacttctgggaatcaatccttaagtacaccttcacaaagcaaaatgatttattacatctttattcatcacagcactgtttgtaatagcaaaagactgggaaacagcccaaaggtccagcagtagagattggtcaaataaaccatggtacatccacatgatggaaaacttgttattctgtgtgtgtgtgagaaagagatacttgcagagacagatgtctaaaacataccactaattttaaaaggtaaggtaaagaagagtatatacaccacctttaatgagagaaggggggagaattaaaataccatatattcttatttgcttgtgtttacaagttgctacttgcagagaatatgggaaaggcatggatggggataagatgggagcaaggtttttgaatttgaaaacttttgatttttgtgaatttgctatttaaagaaatcctggggctgggcacggtggatcaggcctgtaatcctagcactttgggaggctgaggctggcagattgcttgagtctaggagttcgagaccagcctgggcaacatggtaaaaccccatttctacaaaaaacacaaaagtttgccaggtgtggtggcaggcacctatagtccaagctattcaggaggctgaggtgggaggatcacctgagccagggaagtcgatgctgcagtgagccatgattgtgccactgcactccagccaggatgacagactgagatcctgtctcaaaaaaaaaaaaaaaaaaaggaagcaagaaaagaaaagaaatcttgtagggaattcttgtaagaaattgtcaaaaatgtttacctttgtatatggttataatgtttcttgaggatcatatattatatattttcaaaaatattgaagttgtataagcaattttcccagaagtgtgaagaacaggacaagattggcatggaagagataaagctaaggtggagttcaacagctcaggaggaggagtcgaagaaacctgggtttaggcaggtaggttctcatgtgaaagtcagtcagagaaatctcagtccagaattcaggaggtaagcacagtgagtgtggagagggtaatttctgccctgtgttatattacctgctggatgtgggtggctctgagcccccggatatttattacagccataggaagtcagagaactgtaggtgaatgggaggcaaagataggaacactaggattaccttctaggcagcctgccaggagcattgatttgctcttggataaagcatgctgctcatcaaatatttatgttaaaaaagagggcaaggcatgtgctggaatattctgctgaatttgacagagatattccttgaaaacttgagactcctggaattttgtgtaatcaaatcatactataaacacaacaggtgaatttgctatttaaagaaattctgtaagaaattcttaggaattgtcatcttctgctctttctgctttgggaatctgagtatgtctgaagatagctgcatttaaccaggttaaatgtgaaaggcattcacgtttctgcatcttttagtttttttcacaaggtgtattgtctccagaaaacagcagatggcctaggtccgaagtatgaaccagcaccttgatcctcaggaccactgccttagcagttagattcactaaacatggctgatcctacaggctgtgcaaatgcctcccagaagaggagccaggagaaggaagttgattctggctacaggctttctaaaggatcaacttaaaaaagcaagaaagtagtaccagttggtactaaggggaacacagacaaactctctgagtttgtggtacctttgataacaagactccgcaccttttaacctaaactagaagcctttttccagaagcagcagctactcataggtaagttccaaaggctcctgcaaccactgttacttgcatcctgtccccaaggaaaaaggcctacggctggtcaataaataacatgaatccctctccacgttcccaggagttactactactccattccctgcaccaggccaactacacaacgggtgctggtgaccctggcaagtattaggcaatactgagcatgctggtgtttaagtagcaataaacaatgtcaacagcacccaaagtgctggtctttacctacccctcagaaataatgaattgaagagaaagaaactcatcataggcaatgtgtaccactgaatgtttgtttcctagcatatataatcagtattacttttttacatgtaccttgctgacataccacagaaaacatggttttattccttcattccactgacattcatgaagtttatatgtttcccaataaagcctgacatgataaaccaaatggttaagtgacagactctgccagctgatggcatctagaggactactgtggctacaggggctttgagaagcagagctgctggtagccatattgtgcctttgtgtgtgttaaaaaaaggcattccttccatgtacacctagacttttgcaggcttgatagcatcagaaagaagttcccttttctcctagcagaggcaatcctactccaggatgcatgtggttttgtttgtttagcagatgtgagcctcccatttgcctccttgcccaggcacttttgtgcagtgaacaacctgtataacagttcaaggtatccctgtcaagaagtcacaatccattccttctgcttcttggccagacatccaaccctcccatgacaacttatctgcacagccaatcatgaccttatatacccacatgaagccccatggtctaatgtgcaggccatggtctaataattcagaagatttcattagtctaggcacagctcaggcacctagtctaaaggttacacctttctaatttgcctgagattctggttaaacttggtatgatgatgttatctcaataaggtcttcaataagcctcaataaagtccaagaggcttttagattttgattcctctttccacccttagatttagctcatgttgggatttaatggatttcagtttgagtcttcatttgagaaaaaaccttatgtttttcctctgcaataatttatccccccaaaacaacacaaaatttgaggtaactgcaagcttggggtctgagtcaaagggtcccagtggggagttaagggtttagtgtccagtggtcaaggacgtcttggctagtgccatctgaagctaaataaaagcctgattatttcacatcaatgaagttaagattctgcctccaatgggctcatgtgagtttgcacaaagccattctgaatcaagacaattctctacacacaatgcaagtgcagagatggcaactgattcagacttcactccagtgagcatgtgtgatcacgcaaactcaagttcaaccagagcttatacttctctcttcggtcaactaaaggggatcctatgtcaattacatgaccttgcctgcaaggggagtggtggcctactgtgtcagaaagcatacagaatacaaagccttctgactctctgggcccaaagtcacccacttattatacaatcaatgaaactgaaaattacagaagattttagcaaccaatctcttagaacttctagatactaaccctctggcagaactgaaagtattaattcttaacagtctccaacactccagtttttttttttatttttttaagatggcatcttgctctgttgcccaggcttgagtacagtggcacgatctcggctcactgcaagctctgcctcccaggttcacgccattttcctgcctcagccttccaagtagctgggactacaggcgaccgccaccacgcccggctaattttttgtatttttagtagagacggggtttcatcatgttagccaggatggtctcgctctcctgaccttgtgatccacccgcctcggcctcccaaagtgctgggattacaggcgtgagcgactgcacccagccaacactccagtttttattatacagtaattctctgaaatgcagacccattaaaagaagacaaaaaccctccttgtcacaggatggtaaccagacacttcacaactgagcacttttacgacacccaataaagactaacatgataaaccaaacacttaagtgacatcagatatgattttcaagagagactctccaataaatggaataatctagctacaagttatcttaagtcaagtcacctccaccatctgccctggatccatgctacctgttaactactctcctgtcattcctaagggaggaaagtggggaggtcaggatctgtgggtatgtgctggttctagaacaggatttagcgagtcagttccttcatctgtactatccagaccccctttggaagtccagggatgaaagaggtaggcttcacagggtcaccaaggactgggcctttgtgtgcgcttcaggcctgctgggtctcagcagccatttggaagtgttaactgctatggctaaagagtggcaagcctgatggagaggcactgatgattctcctcaggaaggtcacctaaaaggagtctcctcctcatgtttctcttgattagttttatagtttttaagcaaaactgactccataaagcccacttcactctcacctctggctggatgcacctccatctccgtgcagagggcatgagatgtggagttaagatgcttctgggtcaaattctgtccttgcaacttgagcaaggttcagacctttaaggaacctcagcttcctcctctgggctgttgtgacaactgagcaagactgtatacgggaagagtttagaaagggctcaggatatataatatatacaattgtgctgtaattagtttttatctatccaaccttcctgttaaactaagtgcaccaatatctgcctcattactgtcttccaggtgtctgatatactgaaggtgctgtaaaaacgcagctcatcaaggcaggcctggatctgggaagtcacaacttccataaagtcaaggttggtggactaggtctatatgcagatcctaaaaacccactggtagacttttcaaatattcttcatgaagatcaaactacaagcttctgaaaggccttctcttttaccgctaaacaattctcactgcaaaggttttgacatttaaccgaaggacattcaactgccataaagttggtgctttttccaaaacaacaataaaatcctgctatttgtagttaacaagccagatttgttttttagtaactattacgcaaattttttttagtatttgtagttaataaaccagatttgtttagtaactattacacaaatgaattatattttagtatatatataggcgcattgtggaaaataggggaaaagcaggttgggggtgggagagcaccataatcccatcaccaatttgtctgtattttcttctaggcttttcttatggtttaaaaataatttttaagctagctgtaattgtaataacacaatgtaactgtgcatactgcttttccccattttaaactgtaacagacttcatgtattactgattttttaaagtctctaataaaaaagaaaatggaattgagatttggaagaattaacttgtttaacaaattaatattgcaaaccatttcacatttaaaagacaaaatgatgattgtctaattctcttactttttaagtactatttggcaggactatttaaattactgagctttttttagatttgggggaaatattaaaattttgtatagctgttttcctgttacaaaaataatgcatgctcattatacaacatttagagaaaatttcaataatttaatgttaacatttattgaatgtggactatgcaccaggcactattccaaatgctatatacatagattagctcatttattcctcacaacacttattgaagcatagattaagtaacttgctcacagtctactcacctagaagtatgagccagaaatcattatgttatgttctaggagtgaaacgaatcaataatttactcaatcaaatgcttcagttgtttcagagcataatgtcataggcaagaaacaattaataatcacactgtaccctttatagttatttaaaattattataaaccacatctctgtgtcccagtggagcaattagtaaaatgagaaatcatctgtggcatgagctaagatcctggttcagcccaattctgtgcacctgacgtgcattaggacaaaaacaagaagctttaaagggtttgttttaaagatggaggctttttttttttttttttttgagacagagtttttgctcttgttgcccaggctggagtgcaatggcacgatctcgattcaccgcaacctccgcctcctgggttcaagtgattctcctgcctcagcatcccgagtagctgggacttcaggcatgcgccatcacgcctggtttattttgtatttttagtagagatggggtttctccatgtgggtcaggctggtcttgaactcccgacctcaggtgatccgcccaccttggcctcccaaagtgctgggattataggtgtgagccacagcgcctggcaagatgaaggcatttaaaaaattttttagattttaggaaatgagtcaacaatgtgatgagtagatttcctgaattaactgaacacccaatctcatgaaagtttacaaataaaacaacgactcacaatcagcctaacacttcttatggcttatctgttggccttggacatcagcacatgcaaaagtaaataaccggatacccttgggtcacatgttttcatactttgattaagaattacacttggttaaagatgaatacttctgttcctggcttaatttcttacctagggctaataaacacaactatttgaaatataaattctctttaaatgtaaaggataatgcaatgtttctgactgtcaaaattactatgcaactgtaactttagcactaaaagcatattaaaactattaatcctttaatcataattattcatattgctgtggtagaaacatcacacatacacacacacaaacacacacacaccagttactttctgtagaatttgaaattgctctatctagcatttccggaaggttcaagctgccaccctgcaatttatccagtagcctgctgcttgaacaagctagataaatatctaataattttgaccatgtactgcgtgttaagtccagtttaagtgttttccaaagacaaagttttcatatactttctgtaaagccctacagatagagaccattattatccccatcttataaatcagactgaaaaaggttaaatagctaatattttcatctaagtctgtctgactccaaagccaacaccccaaatcactgttaaacaagcttctcttccaagttagggctcagaaaaatttacttgctttcacaacttgccttcctaggttaagcttaagctgacataaaactccaaaacaaagcaaaacacaataaatcacataattctaattttaaaaaaaactaatttgatattggctaaccacttcctcaagttttctgaccatgaagccctttgctctcacactttaataaaccaccgatattctctaacaagtgacaacacaaatccacaaatctaattgttagagagctttcaagtaagactggagctttctggacaggaaatttttataattctatttttttcaggctcttgtgaaacacagattcacattttcatatatttctacacaaatctaagtgctgtgtgccctgttgggggttcgatatctagtaaattacatgagttaaatacagcaaaaataggactgcattatttataaggtctaacgacgcagtagacttttcagcattttttggacttaaaccagggctttacggcgctggttaactattagagaaggcaaagggactgaacattttatctgaaagtccttttatcacttaagactctgtaaaatttttgattactttaaaaattgtgtgtgtgaataacgttagtttactagaaaaggggcttgctagtatatataatttggttaaaaaaacaaaaacaaaacaaaacagctccttacttgaatgtgattgttttggcaatagtaaaattcaatcccgtcgttctagcgctgcctgccttcctggttctcctaggtgagggccgccatcctgcgataatttacttcgagagctgcgaagcgctggcaagggtgcagtctggtgactagcacttttaaaaacaaagccaaactccgcttttaaaatagagaaggcacagacgcagaccctgcctctgacgacatccaaaagattcattatacacagcctattcaggcgaagctacaaccgccccaggaaatataaactgtgtcggcaaagacagcaggggggagaggaagtaactgatgggaaggaagctaatcatgtgaagtttgtccaactccacacggtctaataaattcccgtttgtttccgctgggagcagccattaaacgcgccctgacacgtgggcgcaggaacctcccttctacctctggtgttcagagatttccttctcgacccacttgtttgtatacaaccacgcccggcaggatgaccaccagatgaccggccgcagcaatgcctccactcagtcccagttgggcaaagtttcactccactgcggcgacgtgaacaagaatcacggcttccttatcgtgagttatgaatgatttaagccaagtttacaggacacacaaagcgagggacgagtgagtgacgggaggtgctaagtgacagcgttttaaagttagctttaattgatatgccctaattaaaatgaaaaacagaattcaccctgccccacgggataactgtcggggcaataattaaaaaaaaaaaaatcacccaagactaagcctcaacctcccccttaccacttgcaaatacagtctgcagaaaagcagcctcgggtccccactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactgggggcctcccaacccggcgcggggcgcacggccgcaggctggcgaggaggcaagcgagctcaaggggagacctttccttccacccccagccctagccccagccacagccgtgggggcggcttcccgcaacctcgggcggccgcccgtcgagggcgcgcgcgccgtttctgcctctgggtctcggtgtcccttggccccttcctccccctccccccggtctccggcgcccagcgcccagaccagtccccgccctccagcaggacactcttccctccttccttccttcctccgctccctccctccatctcgcttcccagcacccgggactcggaggcggcccccgaactcgctggccgacgccccgcgccgcgccccgaccccgcggggacccgactcaccacccgcgcccgccgcttggtactcacccgcctgccggtgcgctgccccgccgtcgccgccgggactcggtctctaagggctcctggagacggctccgacctctcctcctcctcctcctcttgctcctccgggcgccggctccgcctcgctggggtgggcggggcggcggcggccccgggctccttcctccgcgccgggccctgcctcccgcccggacgccctggctgtgctgtcccgggccggggagcccgcgttgtggccccgcaggaggaggggcgaggcctggcctgtggaagctcggtggacgtctggtcgtctttggccatcccccttcctctaattctcatggaggacctgaagttctaggacttgagggcccccactctacgacccgcccccgcgcggggccgccctgactcctcgcaagtttccttcgcgtgcgaacgcctcgcttgcccctgtgccagcggtccccagggctgtgaggatgagcgctgccaaacccctacacgaaagtttggttctgttccagaaactatggaggaaaacacgcatagtaacatttaaagggccctggggccacggagagaagtttcccagaaagtggaggtataactgcggattatagaatttgtagtacatccacccaccatgagcttcccgtccatctgccccgaccccctgaaatttgtttccgaatgtccagtacctggcagagttctgcctaatgaattaatgggatttggttggtcttttctggaagggttcaaggtcgggtaaatggaggagccatttccgcttccacagattttgtactattcctttggccattcgacagacattaccaagcacccgctgtgtaccaactgcgatgctaaaggtgatgggagaggtacaaagatgaatcagacaaggggcttgccttcttggagtccagaaagagtaaagaagctggatgttcagaaaaccactcagcggacttctagagtattcctaggtagccgctttcttgtttgacagggtggagagaaaagaggtgaggccaaagtaggtcacttagaaccagtgtgggcagagtccacacttgaaatggagtctgaaagcattggtgagggatgtctgtgtattgagtttcaccaactgaggacaagtgggccctggggaatctgggaactagggactgcagtcagggcattatattccctcttgctttccttctgacccctaagcaagtttcaggtttagtgaaatcatttgcacatgtagaagaggtgtcacaggtagagtaggtgtatgaatgcatgccttgccccaggagtgtggtcttagcaagctgcggatggcggtggtttgtgggatgcaagccacagactgccagaggggtctttatttcctgttctgttcagcattaggaaatgcttgactgattcacaagtactaacagttcaaatgatacacctgaaacagaacagcttgacaccacagggactgagagggtggcatactggagtttgtattttttggccacagaccacagaatagactcctctaagctatgctactaattttccttcctgggacactttatagtttaataagtgctttcatgtacttactcttacttttctctcattagtctcttgaaaaaacctggaagctggaacaccacatattgccaccagtaacttaagcggcttgtcgaaggtttttctagttgagtgctgttcaaagtgtggttcatggaatagtgacagtctgcaaaccgttacccatctacaaagggatgagcatagaaattgaagatgagcatgtagaaacttacagcaatttgacagagtaattttatgtctgttaaatcgtttaaaatgcagctttgtattttatgtctatttcatttttcttttatgtggaaaggcatcagcctgcaacagattgaaaataaaatatcacagatagtttgagaagcactgatcgagatagtattaggttagtacagaagttattaccgcaattacttttgcatcaacctaatagcaaggcaggaatgataagagctaatacttaaccagcactttctgcgtagcagatgttgctttaagtgctttacatatattaaaccttttaatcctcctaacaacctaaggacgtagtcacaggaaggttaggtcttacagagcaaaactggcagagccaggattcaaaccttggctggctgacccaatactttgtgcttttatcgatgcccttgatccagtgtcctttctactctgctgatgtttcccaaacttaaaggattcacattccattttcatacaactgtaattcctattttttatttatatttcttattgactcacttttgttattttgtacatatattaccctggcagttagtaactccaagcatgtaatcatgggtttgaaaagcaagcatcaatcttctactctagtttatattaaagtacatgcctaattccagcacttgctgccagtgcttggccataccccctccagtccttttccagtttcgtgcacactggttccaggcgtgctttcattccctcctgccagcacccacatcatattctcagagtaccagctccagctgcaggatttgctttgcctgggcacagggcagctggaaatgtgtagaattaatgtcctccacctccatccctagcctttagccagtgtggaggaataaatatttcagctcctttgctcatatttgtgataactgggtggatctacattgtctacagagttccctatgctgttgggccaaattccatgagcctgtttggtttcttatttttttttttctttctctagccttcttttaacttttttttttccttttttttatgttcttgctataaaatagttaatgaactattttctaccccctcacccagtggcattcaaaacaaataaatcagtttcctatgaaagagtgtcagtggagtggagtgaaatttatgctttatgagataaggtctttgggattaagtcctggctttgccgttaacaagctgtgtaaatttgagacagtcacttaactttgctgggtctctgcttgtctttaaaataaagggattgtaagagaatggctctaaagtcccaattctatggaaattagattttagttttaaaaagtggctttcttggccatttaatccctcacgagacaagcaagagaagtggttttataattcaggacagttgtttttttttaacgaattgcaattcatatgtcaatctactgtgaatttctatttaatattcaataacaacactgtagctaaaggatgagtcagaaagagatggtgaagaaatgaaaaagtgaggcaaatcagtcagtctctcggtgatcaggtctccacagacttcagaacaattttttattttatttttttagagatggagatctcacttcagaacaacatttttgggatatcagctttgctccctgtggattttattggtcctattgcacatggcttcactctttgtctggacctgccctggaaggcagggagagctccctccttttgagtaggtcacctgggaataagtgtcttccaaactggtttttctgctcagtcggagactgccatatttccatgtagaagttaggtcagggagaagcacccacagtcttggaaatccccaagtaacctgttgaaacgtgtattgccataggcaggagctatgaccaaaactgtggctacagatcagaaggcaatttagcatagttccacacttacatgggtggaaaccttcagaggcctgggtgggagtgacccaaaatggaggcacccatgcaagttagttgattactaactcaatatgagctctctggcttattactgcaataggccctctagctctagggagtggaagtccccagatactgttgtctagaaataaaacatatgggctcaagagttaatgaatttcctgtcattggaggagttcaagcagtggtctcttagaaagtagagatttagaggatatcagcgatgcaacccaaatgcccatcacaagagataagatacctccctctaaagcactctgaaaaaaagatatagatctaaatatgttcacatgaaaagatgccctcaatgcattcttgaacatagatagcagattataaaccatcatgtggagacgcttccattcatgtataaaaaagcatacatacacacgaatctcttctgtaagtgtatctgcaatgatgtttgtcaaaatagtaacagtgactttctcagggtggtgagatttcaggtaacctaccttttttatactgcatgaattttttcacagtgaatgtgtagcttttctataaatcatgtctttttgcatattgtaaatgtatctttctttcataatataaaaagacaaaaggcattgtgcagaccaggagttggcaaattatggccagaggaccaaaggaccacatcttttgtaaataaagtttaattggaacacaaccacactcattcatttccctgttgtctacggttgcttttgtttttacaaaggttaagagctgaatagctgtaacagagcttatggcttgcaaagcctaaagtgttttatctgcccctttaggaaagaagtgtagcaacctctggtgtagacaattggactggaaaacgttttcagcatggcaaattgcaacctagattttactttttcagatttcaatttatctgaatttctattaaaaatatgtataggctgtatattttaaagtatatcccagttctgagtagtgattataacagagcaaagtgacagtattagtatttgggtagctaaggtctgtatattctccttcttcttcctcttccttattcttttcctcctcctcttcctcttccttctcattctcctgataagatcatcatcttattctacagtttgccctcagatgctgttccacttgagaaagtaccaggaggagaactgaggtttctctttcctggcttggatctctccaagacagaataattgaggaagtccttgacaaaataaattgtcctggcagaagagaggcaaagttctaaagaatagacgtagacctggaggagaaaaaacagggacgctgaaggagcccagctgaggaggaggggagggtgtccagctccagaggaaaggctgggaattagatggagtaaatctctctcttttccccttccctcatcacacccttcccacacgatccatctagcctccagatatacagaggaggtttggggatttttctccttcacagtcagcagtatccagcatcaaagctcccatttgcagaactcacatgagcaaggctaactaatggcagtctgagcaatgccaggcccttgctcatttccagaactcagccagaaaagctggatattggccttgatatggaatgtactcagataccaagtaattaaatgattcagcagaaacacgctctttgtcagccactcaccttagaccttccctgaagaaaacataggcccctgcggtgtcagaaagaaaagcagcctgtgatatgattagattattggttcacctatagcctatgctattgggttttgactcctacacaggcaactctgtggacctgtaagctaagttaaaaagggcatggaaagtatttactctggcatgttgataacaaacctgttaatttcatctagctttagatactggtgagaatggaaagtgccaagcctgcaacctcagtgactccaatttacacggttcccaaaataaataaaatattttttcagaatatgggggaatctcagaaaatgtaataaaaatgctattttctttcagtgttccagtattacatattttagagtactgaaatcctggcattattgttggtattattcatttatctcagtattttttgagaataaaaatatgaacgatttctgtcttgagactacccagagaattacataccacattaaaattttaaaggtaatagaagtgcattagtttaaagagtgttctgaccacattccttgcctgtttaaatcctccacaggtgtcttattgttattttatttcctatttcctggattactagggaggttgagcacattttcttctatttattagtcatctgcagtcccaataccaatttgggcatggatctacttgcagaggtctttgatagattgtgctggatatttctgtattcctataaatatccttgagctttattctggaatatagttaagttatttggaaacagatttgtcctttcagttctgcttttaagatttgtttagcaggattggagcagttaccactctaggttttttgcctctattgaagcaaaaggggattgtgtgtctattcaatgctccatagatcttgagatttttttcaacctggatggtggaaggagggactcttcttggccctgtatgagcatcaggtactgttccctctaataccttgcacatggttcttctctcagccttgggtagttacttcacctgcaagagcccatcatcactcaccatactcatgctagtttctggattttctttctgtacactctcttctctctggttctctgtcttaggaattctagttgccttaatctcttcttgtctccatcaccttaactcaaggagtccaccagattcttcctgaattccccctctctgctgtggcctggaaactccctcaggggagggtgctgggggagtggtaggatacacctcatctgtttcccatctctcagggatcactgtcctcttgtcacctgatgcacagtgttttgcaaactgtggtttcatttattttacctgtttttaggttgctacgggtaggacggcaaaactagttctttactccatcttgactaaaagtagaagttgcccctgtcactctaaaacatgtgttattcttctttttaacttagtgttatctaatattattgcctgcccccctcatcatgctgtaagctccatgagggaaagtactatgtctgttttgttttctgttgcctccccagcacctataacattgcctgacacatagtagtactcattaaatattgaatgactgcatgaaagctagaccaggatggagatcatgagaaaacttgaatgatgaacaggaaaattgaacagattttgctgagagtggaggctcctattctgaaaccagaagaatgtaggccaagttctattcaattgcaaagtgaggatcttgagcactgcaatgctggtgactttactcaagctagtctgtctgtaaatctgccaaagctcttggcagattaggtcacatttttggaatctgcttggaattcaggaacatggcggtcataatgaatcatgattttgacccttcctcttaatctgattggctctaagcccttaacaaatattaattatgtctcacaatggaattgccaccctgacctcttttcttagactgctaacactggatactgcagtgttcagccctcctatcccataataacgtgcctactcctccttcccaaaaaaggaaaggatagggtactgtttctatcaacatccttaaattatttagtcagtatcctaaagatggacttgacaattgaacaattttcttaaaaacctcacttggtaattgcaaaagcctgtctactgttttttctgactctagtctccaagacagtcctctgaggtacaggaaaaaattttagaaatcacagctacatttaatttttgtcttttccttttgttattatggtaagtcaggtatataatttacaaagacacatatattaggactacatgctcgaagtccttaccgatgaagtatacaataaaaaatgtttggacatcacagatctcatctctgaattccctgtagttaaggctggcttactcttcctgtgaggcacctctaattgtgcctctttcttctgcaaaacaaacaaaacctcaacacctctgaggcttaagtataagaaaacttttgcagcaagctgaagttgaaaagaagggagtttttctatgtagattcaaaatccagtctgcaattgtttgttagtccccacatttatgtagcacattgtaattgtgtactgcactgaatatggctacagggcttccgatttcagaagaacatgagtctgctctcagccaagatttgtatatatttagttctctgtgaagcctctcaggtccactaaattatggacccagaacaagtacgaggccatgaatatttcctaggtgccatgttagcagactgaattgctaaagagattatagaaataacaaactttaaatatatgaagttatttaccatcaaagtagtttacagaagtagcaatagagtaaaaatgaatctacaatacactgtgtggggtgtgtctgtgtgtaggggttggggcagggaacaccaaagtgccagacacatgaatgaagaagatattttggaagaggaacctttggccctggcctccccatctgacaccaagtagactagaaatgaactgctcagttgagcctttactgaattcctaacacacacacacacatgcacatgcaacacacactcatgaacaaagtaaaaaggttattttacttctgtaagttttgggatagcagacctgagagttgtacacattatctgaatacctggctccaactctacctgcagcaggactacccctgggtttttcagtaagccagtccattgctttcagtgtgctcaggctagcacaagtggagtttctgtcctttgcatccaaaagaattgggaataatgcaatagcactctctcttttaactcaggtgcaaaagcttcagctaatcatttttctcagttggtgacttatgctcatttttgatctgtgcaatggccatctcttatttgattgattgattgatggttttcttttttttttttttttttcaaggcttagatctgctatttctctcccaaggatgtttatgctgatggttttcattcatatcctttttatgctgttcctaccccattcctttcctgctcatagacattctaagtctaatgtatatctaatttttatatacatctttttatttgcatgtgtccttacaaaacatataaaatttatttttgtgttattttaatggtactgtatactctatgtaggaagaatacttatgaattcttcaaattaaatgtcatggtggtctacaattttcttcctaagttatagatttcttctctaagaaatatacatcctaatagtgtctatttttcttgacaattgttttgtcttcttggcattttaaaaaagaacttttattctctgaatacctacttcttcagccccactgattgattccacatatatactttattttttaatagtaaatattctggttatatgggtatggtatcttctcatctctttgaaagtattaattatatattggacttttttcctgttctttctattgtctttattgtttcttttgcatttcctttcttctgtgtgttttaaaaccttctttttatctgtgtctttcatgttagcagctttgcttaaatgttgactgattcttggctgattctaattggaacccctttgtgtgtccagatcttacggagtggtgacaataggtaatagagcagagatttggctattttgtcttcagaactctattggtttctacagatttcttctctagggctagtcagatacccccaaaaggagatcagataccccacttggggttaaggggaggatttaagcctggctgccagccttccaggagtctggatgtctcatcatggtttttgcttgtttttaaggcagatattcacttaatcttcttgttttcagtacagtactctgtattctactgtttgatcattcacttattcattaaatatgtattgagtgtccccttaatactttgtgccaggaacagttctaggtgcttggggatacactagcaatcaaaacagatgaaactccctgtcctcatggagcttacattctaataggatacatgtccagtgttctgccagggttaagagagggatgagtggctggctgcaaaaggaagtagcagaaatctggagttccaaggggccc

SEQ ID NO: 512 - DNA, 223394 bp, Homo sapiens
aattcaaattaggagagattctttgaaaagtttaaatgacttccaacaacttttgggtaacattaattatttaagacctactttaggcattccgaactatgcgctgtctaacttgttttctacgctgtggggagattccaatctctgcagtcccaggacattgacccctaaggcttcactagaactggaatttgtagaggaaagaatccagaccgcccagttatctagagtacagcaatctcagccttttcagcttctagtttttgcttcattgctttcccctactgggctaatagttaaacataatgacttagtagagtggtgttttcttcctcattctgtcgaaaactttgtctgtttatctggaccaaatagccatcttaattggacaggcttggtgtagaatacttaaaatttacggatttgatctgaatttaattgtagttcctttaagtcggcttgaagttcaagccacctttcagcattccatactgtggcaaattcacttggctgatttgattggcgttattgacaatcattatccaaagaacaaattgtttgattttataaaaatgacgtcttgggtggtcccttgattaaccaaagatcagcctattcctgaggccgttagagtgttcactgatggctcctgtaatgtaaatgctggttatgtaggtcctacagacaagcttccccaaacctttaaatattgtctgattctacttaatgtggggaagaggatatgcttgtgtttcaccaggagatcctcaaatgaaaaccacagggaaaagatgtccgcttcacaaaccactcccagatgtggtgagatctgtgccaactcctcagaagctggcatgccaaatcaaaatgggtctgattcaatcctccctgatggcaatggagacccatctaactaatcccacttctcctgattacctttctttttctccttacaaacctaaaaatctcaccatttctattagcctcaaaataacatccctctgttcttctcttccttcttcagcactgaatctctcttatactaggttttatttaatgaactctcctccttatactttctatctcaccagtttcctctcacactgatttacctgctacacaaaattattcttattgggcttatgtaccttttcctccacttattcgacctcttacctggatggaagctcctgcagaaatctacactaacgatagtgtgtggatgcctggagctacagatgaccgttgccccactcaaccaggagaagaaggcactgcatttaatgttaccatgggttatagatgtccccctctgtgcctcggacatgcacctggttgtatccatatagaaacccaagtctgggctgcttatcttctggagagattagctacagaaaaaccaggacatttggtctccagcctctccctttctcctttaaaacaaatgaaagagggagtaatgggagatactccatactttcaatataaaacctgcaggaaagccatgccctaaaagttttgagggcccatctaaaactttaatttgggaagactgtcttaactcacatgcagtaatattaaaaaataactcatatggtttagtaatagactgggcaacaaagagctatttaaaacacaattgctcctctggcagaagggaatgcctggaggctatttattttatttcttatcaggagaatgagaatcatcattctactttgcataggaggttcagctcgttctatcccttaaaatgggaagataaaggcattaccccccccaccctcccgaggcctcatatgatattccccattctgagcccagaacacccagaactttggaaattggctattgccacgtctggactgtgagtatgggaaggggaaactattctgtctgttgtccccactacccttcccctctctcagtgtcaacgtagatccacacattctgctttacttatctccaacctgactgttcccatacagagttgtgttaagtctccttacatgctgttagtggaaaatatcaaaatttggatgaacaatcaaactgtccaatgtattaattgtcatttatacacttgtattaactcccattttcactccaggaaaagtgtaatgttggttcgagctcgagaaggaatctggattctggtaactttgcccagaccttgggaatcctccccctcgatacactgaattaatgaagtgttacagcaaattctaaaaagatctaagagatttgttttcactttaatcgctgtgatcatgggcctaattacagtcactgcaatggccaccactgccagaatggcgttacatcaatctattcaaacagctcattttgttaatgattggcaagccaattccacctaaatgaggaattctcaacaaggctttggtcaaaaattggctaatcaaattaatgatttcagtctgttatttggcttggagattgggtagtgagtcttcagcatcgcatgcaaatgcagtgcgattggaatacctctaatttctaaatcaccctgtattcctataatgagactgatcattcatgggaaatggtcaaaggacaccttctggatagggaagataatttatcattggacataactaaattaaagaaacaaatttttgaagtctctcaagctcatttatccattgtgcctggagctgaggcattagatcaggtggcagaaaatctttctggactaaaccccataacttggattaagtctactgggggctccactgtagtaaattttggaattatgtttctctgtttaatcggcttgtctttagtgtgccagaccagtcaaagaatcctgcgtcaaaatcgagagaatgaacaagccttcaacaccatggcacatttacatataaagaaagggagagatgttgtgggaaatcagggaccccgaacggagggacctgctgaagccatgacagaagaacataaattgggaagatttcatggacatttatcacttccccaatcactactcttataatttcctatgcctgtctttaatctcttaatcccgtcatctttgtaagctgaggatgtatgtcgcctaaggaccctgtgatgattgcattaactgcacacattggttataaagcatctgtgtttgaacaatatgaaatctgggcaccttgaaaaaagaacaggataacagtgatgttcagggaacaagagagataaacattaggtctgactgcctgggagccaggcagaacagagccatatttctcttattaccgaaaatgggtaagagaaatatcgctgaattctttccctggtaaggaatattaataagtaacagccctgggaaaagaatgcattcccagggggggcctctaaaatggctgctcttggtgtgtctgtcttatgcagttgcagataagggatgaaacatgccctggcctcctgcagcgcccgcaggcttgctaggattgggaaattctagcttggtaaattctagtcagaccagtactctgctcttgaaccctgttaagatgtttatcaatgacaatgtgtgcacagcaggacatggaacttcattagtaattctagtttctccctgaccttgtgatctcaccttgaccttctgccttgtgatcttttattgccctatgaagcatgtgatctctgtgacccacaccctttttgtacactcccttccctttgaaaattgctaataaaaacttgctggttttatggctcagggggcatcatggaacctgccgacatgtgatgtctcccccagacacccagctttaaaagttctctcttttgtactctctccctttatttctcagaccagccgacacttagggaaaatagaaaagaacctatgttgaaatattgggggctggttcccccaatacaccatgacaacagagtcctcagtctggagactcactgtcccagcacttcctcagtcacttggattcctgatcaaagacaaagtgatccacttattactttttaaattaattcaaatcaaccttcccataaccaggctgtgatgcattacagttggaattcacacttaccctcttgcttgtgcctggcctgggagatggacagaggtggtattggcagtctcattttgcaaatgagcagaggggtgagtggagtcaggagacagagctggagggtgtcctgccaggggtgtttaggttggcaagagggagaggtggcgacacacagtccctttgctgttacctggccataggtttaatgtgactttgaaggccactattaggttctgcaaaggatgattcagtgcagacctcagctgcaaggagagaggatggagggtactgggagaaacccagccaggccagtgggagaccaggtgctggcctggctttgcatgaaacagctgtgtaaacctagacatgccaaatcgaccagcttcctttccctttggtgagcagcaggtgctggtgggccttgggcagggagtgagactgagacaatggggggctgcactgcctccagccctgtgcatcatctacagcaccctggggaaaaatggagcctaccagtgggtggtgctgagctggaagctgcccgtgtcctgcctggggcctgagtcctccatgggccttttccagtgatgcccactctgagttcactggcacatcccctgagggcagctttgggcactttagaatttaatcgtcaacctttccgcccacactaccaacaccactacatttagaaactaaaatctctgatggtttggggagggatgaagatgaagcaaattcataaatcataagttactggagctcatggaaagttggagatgatctcattcacctgtggtggtatgtgagaaagcactttaattgccaagtcaaaggtttttactccacaggcctgaggaaggcccagagatctgtgggtttgcacagccctccaggtggctgatgagcgggcagatcagagtctgttgctgtgaccaagtggcatcctgttccagctgtgttgaggattccccaagtcacgctgctatcgtgtggcagaggaagccacaggcctgactccttggcatctgctaaaattccctttcccagtgggggatgcacggaatcacaggggaggcctggtacaaaggcaccattctgtcccttgctcaacctactgaatcagaatctctgggcctgaggccaggaatgtgtctgcactgatcatattgaaggtactcattttggagggaaagaaccagaaaagcaggtttgatatagcctgaggagtcccatgttatagccggctgagctataaaaccagcactgaaaatgcagaatgatccctgttttaagtgtcatcgcctaggacaaaacggtctgtctcttgagaagtcctgcacagacaattcttagtcctgcaagaactaagaaaaaggcagctgtgtcttcagacaagcaccagatgaacttgttgcttacatttcacactttatacttaaacaataaaactatactccgctttccagggagatgctcaaatgacagtatgctcacagtaatggtgactaacttgggaaatagaaaatgtacacattctacctctggatcactccaggacatctgcttattgagtagggtgatacccacttgggatgccatcattttcctagggaggttgtggaggtggaggctacacagacacatttgagttttgtatacagcacacatttatgactcgaagccgtgggcattcagttacaattggaaagcaagcagaagtgggtggttgctcactggttgtgaggtgagtgtgtcttatctgtggatgagacagaggagccactcaagtggaaggaccctcagcctggaatctggagttgggctccaccaattcagcgcatcccccagacgcaaagaccagttctcacatgactccctcctcattccgatcatcagtaaccacctttgtaatttaggctatcatggccgctcacctaggccggaattctccaatggaacttcccttgatgatggacctgttctagatcagcacgctccaacacagtagccaccagccacgtgtggctactgataactagaaatgtgggcttgtgcaaccaaggactacacttctcattttactttataattaaaattaaagtttaaatagtcccgtgtgactagtattatattggacagaacacacctatgtaggctgcatcgtctcttcctgcctgtggtcaaatcaccctcacgttcatccacacacaccttccagacgaatctcccatgggactcaggctcacctctgtgctcccaatagagatctctgccacagctctcacaggatctgtgtgcacatccgtaagtatacagctacagcagaggggatctgtgtccacatgtgagtatacagctacagcagagtggatctgtgtattcaggtgtgagtatacagctatagcagagtggatccttgtccacatgtgagtacacagctacagcagagtggatccttgtccatgtgtaagtacacagctacagcagagtggatccttgtccacgtgtgagtacacagctacagcagagtggatctgtgtattcaggtgtgagtatacagctacagcagaggggatctgtatccacatgtgaatatacagctacagcagagtggatctgtgtccacatgtgagtatatagctatagcagagtggatctgtgtatccaggtgtgaatatacagctacagcagagtagatccttgtccacatgtgagtatacagctacagcagagtggatctctgtattcaggtgtgagtatacagctacagcagggtggatccttgtccacgtgtgagtacacagctacggcagagtggatctgcacccacgtgtgagtacacagctacagcagagtggatctgcacccacgtgtgagtacacagctacggcagagtggatctgcgtccacgtgtgagtacacagccacggcagagtggatctgcgcccacgtgtgagtacacagctacggcagagtggatctgtgtccacgtgtgagtatacagctatggcagagtggatccgcttgcccacgtgtgagtacacagccacggcagagtggatctgcgtccacgtgtgagtatacagctacggcagagtggatccatttgcccacatgtgaatatacagctatggcagagtggatccgtttgcccacgtgtgagtatacagctacagcagagtggatctgtgtacccaggtgtgagtatacagttacggcataatggatccgtgtgcccaggtgtgagtatacagagcagagtggatctgtgtgcctacgtatgaatatacagtgatgaccaatgagaaaatgtggttctattataaatttaccagctgtcatttctggagtttcatctggaagtggtgtaagggctggacgtgaaggtggggtgaccacaggaagtgagaggagttagttggttggccatcttaatggcttacgttgtcaagttcttgaaactctcatactcagccttacttttgttttgtcctggtagcatccaacacagcccttgtggacttccctgcctaaacttcctgtctattggctagtccaagaagagctcatctcctttaaagaaccagcactgatcttctatgtagataccccaagataaaagaaaataataggagaaaaatggtagcaagagcattctgtagaaaaacattgctgtgagtagattaaaattgcaaccaaacataatgtcacgaacttaaaagaacaaaacaagaaacaagaaagcaatcacatcaccgaaggtcaaagcggagctgtaaaagctcaggcactagataaagaaagctggcagagctctgaagagaaacgtcagagaaaagtgaagccagcctagcagggaagtgtgcaaggaaacagcatagagaacagaccctactgaaacaccatcacggatatggaggaggacaggactaagacagcaactcagattcaaacaccaagagagctgcagggcctctccgcaaatgctaggagaggttgacaaaagggagcaaacacacaatttccatctttttgcaaagatgtagcaacatggacggaaatggagacaccatttgaagtgaaatatgccaagcacagaaagacaagctttgcatgttctcactcctctgtgggagctaaaaaagtggatctcatgaagatagagagtagattggtggctaccagaggctgggaaatgggatggggcagggaagtggaaacatttataaggactgtacacttaaaatgtaaacatggtaaattatgtatgtatattttacctcaataaaaaacaaattaaaaagaaaaaacaaaaagaaaaatgtatttagatgcaattcacaaaacattcccagaaatcaaatgagactttgatgtagttacagatcaaaagtgcctaccatgtcttaaaaaacaaaaaaatgacaccaattgccaccaaccccagtgtctttctccttgttcccagaggaccccaagttccccgagggacaccactcattctgaagtgccctttgctagctgtgctgaggccagcagccatggacatcctgtcacgtggcccttgcttgatctttgcaggcctcccaagctgcccatcttgtggatgatgactggggatggcagatgaagcccaattttgtcaaaggcggatttttcatttttgtttcctgcccttcttaatgttgtataacttccaaaatgaaaaggggtaacgctgcctttaccattctataatcggaagatgttgaatattttacctttttacacttaagaagctaaggcttttatcattaaacaaaatccctttttataattttactcatcactcaaatgctgtgaaaaccgatgaagaacgtgctggaggcagtgagatgcattctcgcgttgtgccacaggggtgctcttgggaggccattggctggccctgcgtggctgcacctacaagcttctttggtgttacgatcaacaactgcagttggcccggtgggtccccacctgccctgggctctccttgtatgttgaagcagagggtgggcttccagaaactgagaattcagattctgaaaacaaatgacgggagagtccacacagcacaggggccctcctgctggtagaccaggctagcttgtgacaacatgcacatgccctccagctgaccagggtgtgacagggaagaggcatgagatggcaagtctggcccaagtgtcaggtcagtagctcagccaggatcatcccaggcgagggctggagaaacaacaataatgggcatctattcttactctgtcagttgtttgctggcttagaaaacctaggttctagacattttaattgtcttactgcagtggaaaaaatgccagttgggctcaagggtgaatgtgagtttcttgaggtctttctgaagcctgtgtgggtatctgacggtttctgaaaccttctgaggtctgttatttttatgggggaggagaggccagctgagaatgtcttgccaccaacttggagcactaagcagccaagagcctggtgtctcacgagggctgtgcaagcttgtgtgtgacatgtcccaaacagctatggattccttgtgatagtgtctagctagtggtaagaagtgtgtttttagtattctaagtcatttcaaaatgtttttagtggatgacaggccagggttttttttttgttttgttttgataggagtcttgctttgtcacccaggctggagtgcaatggcacaatcgcggctcactgcaacctccacctcccaagttcaagtgattctcctgcctcagcctcctgagtagctgggattacaggtgcgcaccaccatgcctggctaacttttatatttagtagagacggggtttcaccacattggtcaggctggcttcgaactcctgacctcatgattggccagtgttttaaaattagaaacagatatcaccagcaatagaaaatgaagaacactgtattaatgtttatttctaattacaagaaacagaacatcagtcccttatttgtacaaaaatacctgaaagtttacaattaggttcacgagccaaagagctatgtacagaatgaagcaaagcacatggaataaaggttttgtctcttcattaataccttctgcattccctgaaaacgtttatacacgccaggccaatttacagtcactgcagtttgcactgtgacatcacaaatctaccgccagcttgcccgcccccagaaaggcgcagagatcggtcatactgtcaggtattaagtgcagaaaagagaagacaaaacatctaggctgaggcacatgtttcttcaaggtttagcaaacaaaagaacattctggaactctaacacctagtgtaacagagcttacctattaaactctaataaccaaagcatttggcgttttccttctcaacttcgtcctggttgctacatggagtttcatttagaaaagaaaatcacaggcagagatacaaagtcaacaggctccaaaacaaccctgagctgtcccctttacattcatgtcaattaaatacaaaaataaaagtcaaatgtccttccgtccccggtttgcgggacttgttctcaggtggaattcccagccgcccagcgcgaggccagcgagctggggccttaggaagtctgccgccacgtggaggcggtttacattctccaacaattcacttcggcagggaaaatacaaaagactacgtcaaaccagctacatacaaaactgtgaatcagagtcaagcttttgttctccttttaaataaacgcatatttataaatatgaaatactgcaaatacaagctgtctattggagagaggcgtgtgagagagagattatacactgatgggactggtctacgtacacagaaaaaagaaatcctagagttgtttttccttgaaaagggtttacctcgagccagtgaagaggaaggaatcgtggtgtaactgcaatgtccgtccctacagtgaagcctgccaccaggtgtgaacgtgagaattatcttactgtcaatagtttgaaagactgactggctgcgaaaggaagaaaatgcaattgagcactgatggttaaaaacatgttttgctagaaaattcttcatttgtatacctttcatggaaaacaactagagtgtggtctgtagactgacatacagtgttactatacggtagactgacttccagctgactggccttactgaagcttgtgacactgctctaggctacgggggttgactgaggagcagagaaatgctgttccttagggaacacttcagtggggcggatttggggcaatatcatggccagcacacattaatagaagccaggcaggtgttgtcttgaaaaaggaaatcattctgctcaccacagtagtttgtcgcctgtcaaaggagtcctttctgctttacagggatcaaaggtaaggaaatggccactctcacacctgatcactaagctaaggggacgtggcaaagggggccacccgaggggcggaggggaccaagtgacaactcaagccaccatctgactcatctcccggagcggggacaaagtgttgtgttgacaaaactcttccatgtccacaaccactgtgaggtacttctgaccctaagccagcagaggaggagcctctagctgctctgtgttcactggcttatgggggttttcagcaggacggagggctgcaagcaaagatctttaaatatcagcctgtgcctgtggcccctgcagcgtttccttgtctttatcactatggaaacccatgagacacagcacgaagacaaccaggtgccattttctctttagatcctttaatcccccgagggacatcagccgtgaaacgactcacaccactgcagcagcaggggtaaggcagtgatcgttctagaacaggctgaaggctgtggaaacgcaaggctgaagtacccaggtggattatgcagcatccaccgctggccgatgacgggtgccaggtgtgtctcaaggaggctggcccacgtcaatctagaggcgaggccattcagcctgctgtttgtggaacagtgaattttccaaaggaataaagtctcctgcactgtgcagaacaagacacactaataacaagaggatctgacatctgagcatagagaaatgattaacagactgtggttgcttgactgagtccacaaaatatgccaaatgcctaccacagtgacaccttttattttaacaagaaagcttttcaagtatactgggaagggctgggtttgtcatttgggagctgaatccacaccgtggtagtcggcagagggtgtggaggaccctctgggaacatttggggacccatattcagtttgaaatctgcccattcaaaactctttctgtattatatgagttgaaacgccacatccccctcctacaataggctgaatacaatattgaaaacaaagaaggagtgcaaaaaagtgatcaatacaaaaaaagtaaacatatcagttttaattgtcaagattattccagggcaagagttcatttccaatcacttctctccggttcttgttcctaagcggcccaagccaagatgatcattccagtttattttcaactttccgctggatcttccatgccctccccaatttggccgatgcagagggaggcgaccctgctgggttcacagcagcaaatcgtcgtttaagtccaacaaactagtcaatcttggtcggctggcaccgaacaaacccatctcgctctgggtccccaggtgcagaatcgatgtgtgttcttcaccaacgcacagaccgcttcttcactccagtgttcacttcctccagtcttcagccgagaggacatctgcggtcataaggccactcggatgcagtggtgcttgagtttgcaaggcaggactcctttgttcagctggtaaaagtcaaccagctggatcaggtcagagaatttggtgttcccgtcatctaggctgaagaacgtctgcccgtcgtcctcgcactggagagacacaagaacacttgccaggttagaggctgccacctcagggaacagaacggggcccacggccagcagcagctacatctgcccatgatttgattccagagggacacacagggcaaggtaggctagaaaacaccaggggcgggaaagacgggagcagaggatgtgtgctgggggctgccatgtccctgagcgagggacagactttgggtgggctgcggaggctgctgaggacagctagctcccctgctccctaaggtggtcaaggggaagggctcgaagttgcccccagttcacccagctcatgagaattacatttaccagttaacttgtaagtacccactgcacacagcatgccccgagaagactgcacaaacctgggtcctcactatacgacctcagccaactcctgaggccccaggggtttactctgctccatgatgaagcaactgttgggtggctatgagggattaataagctcacgcaggtaaattccgttcctaggtccctgaatatggggcagttatttttattaaagcaggggaatgccacagtatctcccagagagaatcatattcctaacacctattttaactcagtgagttttcagttggatgactgtagtacagtgcaaaacactgctgaaaggaggtcgtgttgttcacagggaataggtcagccttaaggcttggctaattaatgagcttggaaccacttcgtaactctaaaaccattgctagagctaacagcacatcccacagccagttttcacacacagaggctgcacacctaatgccctaagtcccaagttgctgttcttttgttacttgtaggatttgggcattacacactctgcctaccacgaaagccccctttctttcttttttttttttaatttactcatccagcctaaaatgtcaatcacttttcattttatattttgagctaaaagaattataactgtgtgaataatataatgcagtagaagaacaaaaaggattgtctatgcagcactttccctaggacagtaattcctgtatttgcatataaggttggctggaagctgggaaggctgggctcaaccccagattctgttcctcaccccagtgcggtgcaggaaaagccactgacagccatgagcctcattttcctcacgagtaaggtggggatgtcagcacacagcaggaagcaagcagccacagaaaagacagtgcgtggcacactgccttcccctggctcacaaaagctaagcaagacaccctcctcatcctgtatggtccatggctgccagtcactacacgattcttgagatcataacaaagtcctgggggtcagataagcctgaagaactccaggttcaactgtgtaaaacaggtgagtttagttaatttaagccttctcagagctttttctttgctgacatgcagattgaatctctgagaggaaactgtccagccagcctcttttggtagagtttgggttccacaggatgcatttcacaaacattatcattacctgcagaatttatcaattcagcatgtaaacagctgctattaattttgtgtattgtattctcaactaaactgaattcttgtaggcgctgatctagcactctaatcatgaactagaattgaactgtggcatactgaagtgagaggtaaacatcaggcgaatcaaacataaagtgctttgtcaaaaaaagtagtgttgattaatgtattctgtaatgaagtttttggaattgttcaaagggagaatggtctttagatccaaggaccatgtggaaggagaaacaaaattactctttgggaggccacttaacgcttcttggatagccctggtgtacaccaggacaaattacaagactcctcagactccagcagccaacaggcaatcctgctgcacaactcctgccttccagacccacgtgctcacagctgctgcgacctcagctaattctcctccacctccccttcctgtgaccttgatccttcccatcagtaccctttcagctgtgggccctcagctaattctcctccacctccccttcctgcgaccttgatcctccccatcagtaccctttctgctgcaaccaagagctcacaggctcaaggggggcctcaacaccctatcaccactttcaggattatttccagggaaatgtttttctaatttcaaaagacaaacctgtaaagaaattcttgaaagtttcttaactgcagccttgaaactgtctgatacttaccggtcttgtcggtttataacttgaaaattgcattaagaatgaaaccagaaaacaaaccacaaggactggtctgagaacatcaatacttacaggtaagatctggaaatttttaattttctggtgatgacacagtgtgagtacaaatgcctttggattactctggctgtcacggaggagaaaaagcctggggaagggaaaatagttgattgctaaaatattttaaaatctggaactaatcacacacacacactctcttacacacacacacacacacacacacacacacacacaggcttggagccacaatgcttcagtgcagtgctttggcatttaagtggcctctaggggcaacagcacaccaggcaagcaccaagacggtaattctgaattgtcattctccattggaaaaaagctgggctccttggggatatgcctgactacagggttagggcagggaaactataggatgaaaaggattattttgtgcctgcatatcaagaagtgctcaaagaataatgaggacatgtcaaaaagacacaggaggcaggatgactaaatctgggcatcaaaatgaattttaaaagtaatgaatcataacccatgaaatcggaatccgtgtctgtagtattatttaaaaataaataagcaaataaattaatacgggagaagatgaaaatctttcttggaggagaatgtcagccaataaataaaggcaagatgtattcaaaaactaccctttggcaattactgtagtaactaacaattaacgaaggaggggggatcttcaacaaatgctgaaaccagcagatgaaaggtggatgagaaaaaagagtattttcatggcatcaaagtattgtactgttaatacttatttactacaaaggggaaaataatagctttacagtggagaaatccggccgacagcatcttcttcatcaagtgtctaaattaccaccactagcaatgagacaaattgaccttgagggcttccggagacgatgtactgaagatgacacaacatcacttttcgggggtgctcccgccaaaaatgcatagcctgaatctcaccatgagtgaggagcctaggctgagcccaggcacactctacaagaattggcttctactcgaaacgcaggtcaagattatgaatacatgctgggagagaagatttaggatgaagatgttcttttgctataaaggaggcaattaggaagaagggtatagattagacaatgaactgcgtcgtcaatgttaacttcctggtttttataaggtactgtggttatagaagttcttgttcttagaaattttacactgtaataattcagactaaagggacatcatgccacaacttactcctaaacggttcagaagaaaaaacagtaactaagaacaaaggcaaatgtgccataatcttaataagggtatctgggcgaagtgtgtatagttcatcctattactattacaacctttctacaaccttaaaatttttttttaatcctaaattagaatagcacaaaaaaggcataaaatcattgctcttacatgagaaaatctggagttagctgaaaagatagttatacatcagaaagcgaagaaagatccaatgaaagctacaaagaagaaatggcctgaaaaggaactcactttaaatgtatccaaaaccaaactacaatcatcagcaaaatcaccaggtctagattgtaatgtgaagatggaaagcagttaaataagactggaaaatcccatgctgaaaaggtaaaagaaatatattttactacaggacttctcagagccttaaatatgtgaatattcatggtaactgcctagcagttttccaatcttacctatgtagaaacctcccccaccctttctaaaatagcactttgcaggccttgtgtgcttcaggatatactttgggaaacaccgatcagaatgggattccatggtttggcttggtcaggccagatgggacggcgtgaggaagctcagaccccactggggaacacgcggcaccgccagagagaagacaaggagatccagttcttctcccaagcgctggtgcatgctgggcagctgtgcccacctcaaagacttgtcagagtcatgtcattccaaataaaacatcgttactctgacacccagaagtttgccgagcttcagctctaactagaggaaaatgtggggcgtccctttctctgccgttaactatctgctgtctccttctgcagatgggaagctacagacgagtgaatggcagcatggcccaggcctgtttacccgagagggacgtgtacccctgagaggggcaggctcaccctgggaagtcccaaggctgctggaaggcttgagctttatagggaatgcctgaaggttgtctatctgagatgactgctatgcggggagaatggcatggcttaggcatcagcaggaatcctggataggtcacttattagcttcatcatcttgggcaacttctcttctcagcctcaatttcttcatctgcagaaggggaacaacacctctttttttttgagatggagttttgctcttgtcacccaggctggagtgcaatggtgcaatctcagatcactgcaacctccgcctcctaggttcaagcgattctcccctctaagcctcccaagtagctgggactacaggtgcccgccaccacacccagctaattcttacatttttagtagagatggggtttcatggtattagccaggctggtctcaaattcctgacctcaggtgacccgcccacctcggcctcccaaagtgctgggattacaggcatgagctactgcacccagccagaataactcttctcttacaggaccattgagaagaccatggctgatgtatatacagctttgtgcatgatcacacgcaatacaaggtagcttgaaataacaatcactgcaatcagccaactgccacaatccagtgatttctaaggggattgcagttataggaaagatgcccagggagaagctaagcatgttaagtgactactaaccaggctcagaagttgtaaacacggcccaggatggacagtggcaagaaccaggtaagttcttaagaatcgatgctagggatggtgcactcaccagtccatcataaatgaacgaagagccccttgtgacaggacccgacagtgatcagagtacaatctagaccacgtttacaagcaagacaccgtgcaaagtgtttcatgcatgtattaactcattcatcttcatggtgatactgttatcttcatttcacaatgataagggaagtgacacacagagaagctaagcaacttccccaaggtcacacagccagtcatggaggagttcctggttcagcaggaaaagcagacgaaaagtgaaagtatccctcttacaagggtgctatgtgagtcctggggataacacctctctttctgcggttgggagaagggaaagcttcaaagaattcaaattttgccgaagaggtttccttccaacatgtggaggggcatgaagtgcagacagagggactgcacaggcagatgacacagggatcgatgcctggcacagcaggaaggccagtggggctggaccatgagtgtgggcatggcagggggggcatccacatgccctggggggataagcatggtgttgggggtggggtgggattgtttggcagagaggactacagacctagatttccccttaaaaagatccttctcctgcagttctgggacgggcatgggtggcaagacaggaaggaagcaggcggcaaattcagtgcagggctggtaaagcacgagtatgtgcgcgcacacgctcagctgcatgggtggggacggggatgggaggggagctgcctggatcctgggatttcaggaatacttgacgggcttatttaaggctctgatgtctctttctaactgcatacaccgtttgagaataaagctatggaaaatgctgttgttatactgtctgtccagaatcttgtgctgtttttcgaggtggttttcttttctttgttgtttaactctttaaactggcttgccttcatcatctctgcagggatcagtaaagattagaaatggattatttaccttgttatacaaatacacctcctccctacacccaagaattgagaggaagatgagctgttcctgtgttaacgcctgaatcaatcccattatctgcatttctgtgtgtggttagcgctccagcagcctaaggcgggagctggaaatgacagccttggagacgaggaaggctccagggaggacggagaggaacacctgctgaagaataagacgggcggcaccagccgggctgatttggggaacggaaggtaacagaggtgatgcttctatcgctttacaggtctggaaagacggatgcctcaccaactgggtttctgatccgagaaaaattgaaagacaaacatggctgggggaagcaaaacgctgacacacaattcaggtggcccagcagtgctgacctgcaatccaccccaccccaaggcagccctttcaatccaaagtggacagagtgggccttatcccagaatcactcaggaagcttcttcaaacatatgactgccacacccgcccccaaggttcagaaacatcttcgcctcgggatgatgggcgtcctcactgccctggccttggggaggacacttagtggccacagcaccaaataaagcctcctgtggaagtgccaattctccagcagagtgacgctaccccgaagtgagcctgcgctgcctcccacacacggcaagggtaacagaggtccccctagaacattctgggcccactgttgatacggttcaggggtataagcaggtatacactgtattagaagccccagaacacacagatacccctaactcaaaaacgtcacagaaagagaaatttctgtgttaggcttttctctcctcaggcatgccagaaactttagaggagaaacatactgttttacagttagaggaggagttgcttctaatgctttgagagactgctctgtgataaagctgacatcttgagtaaggagttttggagcaattgtaaagccacatgggaaacaaaataaaatcagacccatactctacccagcagtgaggataaataaacccaagtgcatctgggatcgaaacaaaaccaaacaaagaccaaaaatgaaccaactaaggacaaaagaaagaaagggagaatgcagagagcaggaaggaaggaaagaggagcagagggaaggaaggagagaggggggaaaagaatccaagtacaagacaacatgaatgcacccctttatgatttaggagtgggaaaaacaaaagtgtctgcaacttaactgattagaaaaatggacaaaaaatgtaaacagggtagaactgccaaaagacaaagaagtccttccatacatgaaacgagggtcagcctccttcatgagagatgcggctgacagcatgactctcagatgaagaagtaagcctgctgagggactctggtgatacttcacaatattacataggccctgcccttccaccccacagccccacttctcaggactcatggcaaagatacatggcaaaattatgaaacaatgcagcactgtgtctcataacatttgcctggaaacatggtgaacatccctcagtaggggacattttaaaaaatgatgttccatgtacataaaagaaaacccaagagtggaaaagaaatgtgggccatcgcgatgcgctgctgtggagcgatccttgggatgcagagactgcgggaactgcgcagcgcagtacttgcagcacgctacatttgcttaacgagaggcagaaaacaaaatcttttcactcgtatttgtacaatgaaatgacagaaggataaacaaacactaataaaagctgtttatctggtgtaggggttgggaggcagagttgagaggacagggcatgtgccttatttcatagatctgactttggaaccatgaaaatgttttatgcaatttacaaagcagcattcaaccaaaaagaaaataaatcagatccacttgcaaacactaaagagaaactgaaacaaacaaacctgatttacccagcagtttggtgacagaaccatagagaagaattactttaagtgactttgggcaaggtattttaaggtaacctgcctggattaatccttaaggattaaaaggactgtaaagaaatcgcaattcaggtgtcttactgaataaatatcagcattaatattttcaagatattacaggtatgtattttgtattatgtaatataaagtaataagtaattaagttaatgccattaacagagatcatcagaggaaaaaaaaaacaacaaaatcaaagaagtaaaaaatcctgtaatctcaaatttgaattagcaatatcaacgtgaacccaacatttattttttgttttaaaaaagcccatgtcctagctctgtttactaaaaagatctaaagattgtagtctccaaataccattttgcattagaatgaatcagggtccctgtgagaaatgcatcatttgagtctaatacatcttgtcaccccaaaatcaaataccattaatgctagctcaaaagaactcaggaagcaacttgaaggaaccattggccaatgaggggcaaagtgagcgtcgagaagaggttttgactgaaataaatcaaacacaaaaatctaagttcacagtgacagtttaaacaaaatccaaactaacaacaaaaacaccccttgtttgcctctagtggaaggtgggagaacacaaactcgttctaaaaattgacaagtaaaggggaaaaccaggcatttacctactttttccaggaaatatctaatgcaagaaagaacttcagctcatataggaaggaattagaaaatgatgattttggaacacctaatgaaatactgaacctgggcaagttcaccaagggctgctaaaaccatgtggtggacggggacggtagccttggtggggaggttccagctggctgcacttgaacccctgctcacccgacaccactaaacagcaaccaggcttcaggcctcctccactccaggcagcagagcacccagtacctgccctgcagacaccaggcagaagaaatgcatctgatcacaccatgaccaccactccccaggaatcagggagacagaggaacttattaaaataaaccacaaacatgctattagcaaatgacccacttctttaacaaacaaaagatgtttaaaaaaatagaagaaaaacagagtgatgagaaagactattttatatccaaggagacagaagtatatggtatagcatctaaatgccatttgtgggtcctaccttaaataacctcaacttaatttaaaggagtttttttggtgacaactggggaaatctgaacatggattagcttttagatgatagtaagaaattcttatttatttagttaagtgtaataacattgcagttatatcaaaacaaaagggtccttatttttttagagacaggcattgagatgtatttgctggcaaaaatttaggatatctgaaatttcctttaaaatagaagaggaggaagaggaggagaaaagggaaaagagagatgaagaggaggaggaggagaatgtaggaaagggaagaggtgaagtaagcaggttgaagctgcgtgatgggtaagtggggtttcattatacacttatgtaaatgtgaaaatttccgtaataaaactttttgtaaaacgaaggacacaagaatcattctttgagtttagcagcttccaggaacctgtattttgagtattcagaccccgtatgggacagctcccacatggatgtaactacttcctcagggaggatgatcagcctgtgtctctttctggaagactgctggctccgcagtgtcggccttctgtggtaactgcatcccatgtccctgtccctatatccacactgtggctggctccttcccagggtcattcaagtgtggtcttgggatttgctttggtcaacgggatggtggcaaatgtgatggtacgagaatcttgagaagtctcgtgcatgtgtagtggggtttaacctctcttgctatgcctgggagcctcaagtaatctgctgcagacacatgcccagtcactaattgccacggcaacagctcacagcaacaaccaaacacgagtgaacctatcctggactgtccagccccagccaagctggcccaggtgagaaaggccactcaaccaacaatgatacgtaatttatttttgttgttttaagccactaaggtttggggctatttgttctcagcaaaaccaacctcatgtagtacacaatcaaaaagcgtaggcaaaagcattttttttccatctgcccactaccttatgaagataaaacaacttgtgttgtccatctcttcagatttcatacagaggtgaaggataattacagatacactctgggcagacatggattagatccctttctgccccttactagctgggcaagccctgcgtaccacttatacctctagcctaccttttctcctctttaaaatgaggacaaaactgctgcctgtccagcaaggatgtctgaggaattaaacagaacagatccccagcacaataaaaccttagcagatgacagctcttatcagtggtggttccttacccatccacgagcccttgctgtttaatgatcctgtgggattcctccctggagatcctcccgtgaaaccagtgctgtgtcctgtgaatcactgtggggggaagacaggaggagggtaggatggtggtgcctctgcagaatggcttccctgacagcacaaccaactctgatcaactcagagcccctgactcccccagctacagcttgtgtggtgcactctggccacaggcaaattcgtaaggctgagggggagtggaggggggtgctgtttgattttctttatgtacaaaaacatcaggcaatgtgccctgtttacctgtacttagggtagaagggtggaggggactttggctacctaggatgttcatccgtgtgcttcgcttctgcaaaagaaatcccacattagcaccgaggacagcagacagacacaccaagtcacccaatatgtccaagctcatggcaggccactgggtggggtgcctgactgggctcacaagggaccttgccccatctgaagaccccactgacccctgagaacaaagagctcagggttcccagttgttaagaacaccctgaaatatctctagtagccccagtatcgaagtagacatgcttatttctcacactgaagacatacgatgaaaacgccatgaacatcctggtaaatcgcaggagaaacacacaagcctttctattaaactcacgcagttctcaaaacactgggcactggactccccgtgcttgggacttccttctttttcccatcccctgaggctgaagtacagaaaatgccagagtccaggctcctgctttgcacatggcctttaagtctcaggacttagaagccgagtgatagtcttcccacctggagattaagaacctaagcctcaggggtgagggagtggcccaaggcctccaggctgttagtagcagaccttgatgtgagcacctgctggccccactcaggcctgggctctgtgcactccacagacagccactgccagttcatcagcagaacagttctgcataggagccacggagggcagagaactctgttcctctcctgtcccttccatgaaagcccaggggacaggggacagcggggaaaggctgggtgctgggaacatggaaggggcctagaagggccaactgcttcctgcagctgagaactcaccccacccaacatggcacccctcttgccaacccgcatagagctgttcctctgggagaagaccacgtggtggggctaccaccttgagggtgcccctccaggctggccagggccggggccttaccctccaggcgtggccctcctccagggctgcgctctgggcctctgccggattctctatcacgcgtcctgtttgcccagaaaaatccattgccacgagggagttctcggagacactgcgctgaaaaggaaaggccgcagttcttaaaatgcagggaaataaggcagagtggagtcttggcatgaaactatcatcaagacggtcaggaaaggggagcagggaatgcctgctttctacctctgaactccccaagtttcaggtgggaaattcaccggttcaggctgaaaattcagtggccccttcagtttttcttaagaacgaaacacattctagtcctccctgagtattaaaaaggctgctggtgaggcccccggcacccgcagcatttggaccatgtggtccttcacaggctcctgacctgcactccaacacatcaaagaaatcaacagccagggtgagcctaggcctccccagtgagtcattccctcggggacgtgggttcaggaaaactcgtggaccctttctgtggcaccatttggcatctcaaaggggcagatgctgaaggaccctcaggactgtattttgagaagatgaagtgcttctgctcctttgagaacagagtgcccagaacacaagaggaacgatgacaatctctaaattctcaccagggaatgaatgcagcgttaatagtcaacagttcccatgggtcccaaggtttaaggaacaaaagcgaaaggcaggaaaggcagtaccccacaaggccagaagttgttgctgccatttttgagcacttaaagagagccacctacttacacaaccctgaggggagatgcagggacgggagaagaacggcagaggaattcactccctgtcgttgcactgttgagactacaaaacccacgtcatcgtgggacatactggcttccctgaaatgcacacacactctccagagcttctcttgcccaccctgtgtgaaatgaggcgtccttaacacatgtgatgcagaagctgaaaaggcactagacttctgaagctcctggctttacttaccactggcgtcgagaacggggacagcaaggccttcctctgctgagggattcggtaattctggtaaaggagcattccatactggagaggagaagccacagttagtcaccggcccgggagccccgaggcccggcatgtgacaaacgccacagcaggaaagggcaatgttgagtgcggaacagggagtgatgccctgtaccagcctccaggagcctgagtgccgctgaccctgatcaacacagggattaggagcaatgacgccccttgaaataaaaaatccgagtatagcttttgactcccccaaaacttacctactagtggcctactgttgaccagaagccttaatgataacataaacagttaattaacatatatttcgtatatgtattctacaccatatttttataaggaagctagagaaaaaaatgttattaagaaaatcataagagacaatacaattatgggactgtactgcattcgattctgtaagtctacatgttgacacaatgaattatctgtgtggtgtggagggcaaccattcaatctctagtatgtatcaagcaatttaagtttttcttgtcatgtcgtgacttttctctgttcttgggcgcacttccagcttcactagtggcatttcacatgggtcccatggtgttctttaaagttcctgtattgcactacacacaacgaaaaatactccagaaacatgagcccatttttttactacaacatgcaatttattggagagaggacctgctcatggggagataattagcaacacaaggtgggtttctaaatggatatgtccaacatctgagttcactgtactagcaacaggaggtggctacaaaattatgagagtaatacagcagggactatagttaattttatgcagttctgaggtaatccgcatctttgtttgtttacatctcttgactacaaatggtgccatatacagtctgtgtttgcatgcattcagttttgataaattttaactttatataatagattaatatatataaaaaaatctctaagtggacctgcacagttcaaatcattcaacttcacattcaatatggtgcatgcctcagtgctgctgctactgtggcccctcaggagggaagagctgactggttttggaataagcgggacagtgacaaacataataacatcaagagcaagtaatcttattgagtgccactatgggctcaatatgtctaagacactatgtgtctaagtgctttatgttatttcatttaatcctctccattttatgagctgtacactataattatccccatgttacagagcacagaactgaagcacagaggaatgaggcaagctgcccgcagtcacgactttgaacgtacacgacctgttccagacccagtgccctccctagctgaggcttgccacctaactggctcagtagtctgcactttctgatcctggcaatgaggactcagggccctgcaaagtctcatacacatccagcatcccaacctacacacccaaatcacacattccaaccatgtggagaagaagaaagagtcagaaacaggaagtgaagtcatcaagtgggacagctcttctttcatgggatctaagctcagttctggctctaggtctcatggcacatactcatttctaagataaaaatacctagaacatgatgcaaaggtctaatacaggaacgactgcactccagcaagagaagagcaagaacaggtcaggggaaatatttgatgagataatgccaaaaactttccaaagttgacaaaaagacgtcaagctacagattcagggtgtaggataagtaagcccgctccgagcatatatcatggaaaaattgctgagaaacagacacaaagaaaatgtcaaaaacaaccagaggaaaacgtgcattattttcacagaagcaatgggaagacagacaactaatgtttttacataaattataagattcagaagacaatgcagtgggaagatgcagaagagaataaccgctaaccttgcatcctataaccagtgaaacgttccttcaagaatgaaagtgaaacaaaaagtgagaaaatttctcaggcccacatgaaaagaaccgctaagctgaggtcttctagtcccagagagaagaatgcaaatttaggaaatattaaagtgcaaagatgtaggtgattaaagagtatataaaacaataacattatgtcttaagaggttttatatatatgacaagaatccttcaaaagggacaatggagcaaatggagtgaaaggtcctcatgcctgcctgaaagcagtcagtaaatgtactacattataaaagattttaataagttcaaggggcatgttaggccgggcgcggtggttcacgcctgtaatcccagtactttgggaggccaaggcaggcagattgcttgagtccaggagtttgtgaccagcctaggcaacatggcaaaaccctgtctctataaaaaatacaaaaattagctgggcatggaagtgcatgcctgtagtcccagctactcaggaggctgaggtgggaagatggtttgagcccgggaggttgaggctacagtgagatgagctcatgccaccgtactccagcctgggaggcagggtgagaccctgactcaaaaaaaaaaaaaaaaaaagatgtgatatctagggtaaccaggagaaaatagtaaatgtacatgtacgtattgggttaacagagggaaaaacataaatatacttaataaatctaaaaaattaagagaaaaggaatacaagagaggtgggacaacctggaaaaaactgcaaatggcaggttcaaatacaaatatgattatcacactaaataatacaattaaatcacagtaaatattttggttaaaagataaagattatcaaagtaaaatagttacattgtgattataagagatattccttaaacataaggacccagaaaagtagaaaaaagatggtccaagaaaaactgtgtaatgaagcaaagctgaggtaaaaatcattaaataaattaatatgtgccagattagactctggggcaaggagcattgctaataaagcatattttataatgtcttagaattgacataccaggaagatacaaatattctcaattttgggtacctaataacatacacattttattttattcacatgtttgcatgtatatatttacatatatgggtgtgtgtagacagaaaagattaaatggtaataaataattgttgcaaaggtttaatgctgcgttcattgccttttcaatgtcaggtcatgtaaaaccaaagcaatcagtactagggactcttgtgtggatgaggcaagacctccctcttggggatgagtttctacagtagattaagagacttctagaagacagagggaggaggaaagatggcaataaataattgttgcaaagttttaatactattcacacagctcctacagcttccaagaaattacctaacaaacaatgtaacaggaagaaatgagacaaaagattatctgctggcgctactaagagcatctttctgaaaagctaagtaaagccatgccagctttctcctatgtagacccaagttataagatttattcatttttttcaagaaagtgtatctgtgtaggtaaagatgtaagaaggtcctaggttaattcaaaataacaacccagctctgcctttccatggttgatatgaagatgctgtttgtagtagatggtaaaagggccctgtcaacttcagccctcagaccctcttatcctctaaaaggggatccggtgtcctgtgtcctcctctggaggaaggcagagcacacacacgggatgccttgttttagaatgaatgtcaacatggagaccctggagtcataaagagttacctccccactgtccctaactctatcccggttatcatttctgtatagtgggcaatgaatcagtgccgacaacactcaaatggcgtttcgattgcattacaatcctatggctatttggggcagaaacacatcacttgcactccacttgagaccggccccgaggccatcactgccaccttcctgtcaggtctggctccccagcctcctataagaatagtacctaagacgtatccttaatgactctagaatccgtgtatcactggatgcaaagtgcttccctgcaaagtggctgggacaagaggaatgcattcagaactcacggcagcttccaggtggctctagggagggcagcaaagcatggtagtgaggaaaggggttctggggccagaatgtcagggctctgaccctgctctgccacatcgtggcagctacagcttgggcctcagttttgtcatccacaaaatgaggatgataatatgcatgtcactgagctgtcacaaacagtaaagtgataaagaatgcctggcccatagcaaatgctcaaaaaaatcttaatattatgtaacacatcattgttaacactgacaacaataaagtcagttcgttttgcattagtcactctgcccacatcctttcctgtggctcgttatgttagcgcaacaaaggagagacacccaagaaacagtggttaagaacctgatacttggatttattatatattacccaaagtaatagaattcatagcttcttggagtatactaccactttcctttttcatttccttttttttttgccttttccaaaacagatgattcatttgcagattaaaatttcaaccatatacagacagcttcaaaagatcacccctggccgctgcccctatctgcacagctgcctctcccatctcctctccctactaagcaacctctttcttctctcctgcagctcacacaatgttcatgagcataccatcaaatacaaatattccaatttttcctgttcccttcacacaaatgtagccttctctctatatactgttctgtactttgctttttaattgttagtaatttttccgcaacaggacacaaagagcaatctcattctttctggaggtccatgcagaatactgccctcaatggatgtcacctatgtgaccagttcccactgatgacccttacactgaaaaccggcttacacaggagtggtctatgatctatgatgtattaacatggacatttcctcttccattatgaatttgtaaagttttgatttccataattctttttttaatcagtgaaaacataaaataaggttctgggagagagatacaggaagccaatctgtggaacttttggtttgggccccagcatcctataaaaatggcactaggatgtatccttaatgtctctggaatctgtggattactgggtgcaaaatgctacctgccaagtggatgggacaacaggactacattcagaattggatctgcagcacctccaggaaagttttgagctatgcttccttcagttcctccatctccttaattgacttcaccttgagtctctggaccagctcaaaggccactacagttcaacgaaggctgggagtttttgtaaagaaatccctagaccattgtatccattggctccagttgactaaacgaacatctcctatggagacccctggactttagccaagctcacctgggccagctaacttacaactcacaaggactctgtagacttaattccagacatgtgggatatggtatatgtgcacagaaacactgtgggaaatccaaagtgactacagtaaacagccctatgaaatcactctggcaactggcatgaaattgctgtcaagggcattactctatatgcagtaccacgtgataaatttcctttagaacttacagtcaggaggtactgtctctgctgaggagcttcagtcaactgtataattcatcatgtttacttcatggccctggctttttgggaacctgagagttggttcagtcgtgaaaataattaacacctcatgtactatttcctttctccctggtcctgatttttcgaatcctattcttctaatctagtggtctcaaccaggggcaattccccatcctctggcttcagggcacatttggcaacatttagagacatttttggttgtctcaactggccgggcgtgcgactggcatctagcaggcagagaccaggtatgccacacatctaagtggcctgcaatgcttggatgtcccccagacccccgacaaagaattattctacccaaaatgtcagtagtactgagtccggaaaacctagctctaccctgtttaatattaggccctctgttaaaagctcctgagatcttgtttagaaagatgcttaactacatttgataaataaaatattgtgacagaacagcggaaaagttacgagcattttcctgccagaatagacatcaagtccagaggccaattttccacgaagagatgtgcactcaacacaaaccgcaagatgtcacataccttgaggagtctgaacgctgtcatccagcacgtcctggtttgctcgtcctctgcacagagcaacctcagctctttagtttcattcctgactttgtttggctacaggaggtaaaagaaagtcctgttagtgttacacagggagtcagaaacagcttctgtcaaggcagggctgcatctgacacaaaccagagacaaccagctggagatccccctagcaaggagcacagcagatacacacacacctgtgtgttaagcgttcattcatccaccttcctgacaagactttattaagtgcctaccatggactggccccaggttgtgtaccacttagctgaataataagccatcctttgggaacttcagaggagacagaaaaacaaactagcacaggacaacgtaatgtggtaagcacaataggacaaagaggaagaggcatctaactctgtcgacggactggattctatgggaggagaacctgccttctgacttacaggaggagagatcttaaagttgcccccaggccactgagaggaggggctgctgcagggcttagccaagaggggcaacccctgaggagctcagggattctgatgtctgagcagccccaagatcagaccccaagtagaaggtccagagagggagactgatgttggctctggagaatgagacagaaggggaagtaggcaccatggggagaagacaggtgcccctccagaggcagggccctttggtgagggaggagaattgttgcaggcataaactgacctgcatctccagaagaacccccgacctcagactcaagaaacaatgctggacacaccccagctctccctcccaagaatctggaggggttgagggacaggtgtgactaccctgcgctcggctggtgctatgagagaagcagagactgcgtttgcagagacaggcaagcatggctggtgtgggctggtgggaagggagagtgccagctgctgctcatacctccagccccgcctgaggctgccttgggcctctagctggtgtgaattagacgcctattacttataaccgaaagagtattccctgagcaaggtatgaggtgatattttggaaagaaattttcccctaaggaggggctccccgtattgtgtgttctcgggatgtggcttgggctatggctcataagtcagcctacagggcaaactccaagcacaactattcactggctactggatgtgggcaatgtggccaacttcctatcccacaaggggctgtgaagattaagataatggatgtaaaactgtcagtggaacatatcatgcacagtaagcattcagtaaatatcatctaccattatgattattaataccaccacaacctcatcaggggaaaaggagtgggctctgcctataggtgtgtgcacatgtgtatgtgtgtctatgtacatgtgtgtataatgtatgtgtatgcacaaaggtgtatgtctatacctgtgtgtatgcacaaaggtgtatgtctatacatgtatgtatgcacgtgtgggtatgtgcatgtagatgtgtgtgcacacgtgtgtgtgcatgccagcacacacatgcatgcagagggtgggcagcattgtgtctattcctgtctgaccatccccacagccagaggcccacacagaagccatcagctcactcagtaccatgcaggcaacccaggtgacaggctgggggtcccctcccttgccccacctccccttccagctactagtactgggctacagccacagcccaccctttgatgccaaaagccaccctccctaaaacactgagcccactagccacattatccatccctgtctgcttgtccttgagcttctgagctactcaaggactgatagcagcaagtgtacaataaatgtttttacaggaatggataaatccagtgtgaaactatgtttctgttgaagacaatagaagcaacaatcaagtgctgggcaagagaagaagtcagtctcctgtgggctgctgagcatgcgcgccgtctgtggacagctcgtgggtacctttatgcagagcccgtggtctgtaggggcgttgtactgcttcctgccagcgatcagggagaagatgttgctgtcctccaggtcggccagcagctgcaggtgtctgggttcctgtgacaacactggccaggttaaagtctcaagcacagcaaagagcaaatgtgttcacctctggtagacagagggcagtctctgcacacttacaagcactttccccgatgacactatacatattacatatgattattacgcgaggtgtaataagtgctaaactaaaaccaaattcacccagtctcacccaaaacacccacttccccagttctcagacacacaaggctgttggaacgtatttgatacttctggcaaatcaaagccccatgaccggatattcaagataaaaagcaggagaaaatctataacccaaaggtcagagttaagagcacagggcctgtctgcctttggtttgttgtgagtccagagtccaaccgtactttgggttttcccactggtagcttgcttgtcccacccttctcctcctcaactctccagcccagctctgtttcctgctctacgaaataccctcccaacttcagcacacacgaggacagtgagcgggccacacagcagagctgggaggtcaggaagctaccatgccctgtgtcagttcaaagcccctctctgcagacgccccttctctctggcccaggtgtcggcagctgctgacttcccagagccggccccaacaccttcccagagccggttcccagatgctcaacacctgtgctggggtcccgccagctccctttcacctctgctggccagagcaaaagagaccacagccctcagatggtaagtgctcagccaggtattgggtggacaaggctcctgccacagggtatatgtggacagcacaagaagagagcagacaagagtgtacatgggagcaaaggagcctccggcctaagctctcttttgagggcctgcagctgttttccatctcccaccttcttctcactggggatacatgcaagcctgcagtttatttcatgaaatatctatgatacataaagttacactggcattagggtggcaatagtctatcaaacatctttacagctagcttaaatcccaacttatgagaactaggccagtctctgaagtgatggggcagccaggggtgtctgctcccaacccgcagtgggggtggggctaggcaggtggggttcttaggcctgtattatttattacctagtttctgagcgagaccaggaaacctgtgactccaagttcagctgctgcacaattagcttattaagaagttgtcctgagcttggaggagtctaaggtgcatttaaaaatgaagcccaggttcactctgaggacctggggggagtgactgtggcagaattagggctggtggtggtagcttttaaagctcacctttgaagttcccttggtggagcaataaaggccagatctccgcaaacacacatacagctttttccatgatttctttcccagctctttcacatgcaaaaacccttgaatttcaggacaactactggagttcagaaaattctgttgaagaacaaatttttaaaatcacataatgctaatctaaaataattaaagcagacatgttatcagcatagctgacattttctgaattattaaaagactcctttttggatcaaaatgagagtgttctcctttccaaagtcttaaaatcccatctcaattcgtgttgcatagaacataattcgtatttaaacatatgcaagcaaatggacctttccaacactggtgataacacgagtcatgaatttccctataagatagtgcactgaaggatccagtctgatatcagactgagggcaagagcaagtgccatgaccaagtgattgggactctggagactgacagtgagtatgtagtggccacttttacccaggcacccctccagtcaagggtcacataaaaggtgtcatgtgtccgcaagtgatgcacccaggtgcaggacatcctggtgatgtccccctgttccagctaactcttcccacaggcagccttaagaataaaggctttatcaaaacaaaacaaaacaagaaactacgcttttcatcaaagggaagacaggccaagggccaggtcatggagcgaagttggggaggtgatgctggcaggtcctgctactagactgggaggggacaaagctcttttcccccaggtgggaaaggcacgtcggacagagccctggtgcacctgggtcagtccttcttgagtctcaagagatcactgcacatcttcacaaagcgcatggatcctctcaaagtcaaggcaattaaaacagaatctgctatttcactgttcactgtgtataggtggtaacttagtgctgacacctctcgccagaacagacacatgctatggtcagaagggcttctgaagacaccaccagaacagagctctgaaactcttatcttttagatgctgaaacaaatttggtgataacaacgtagaaaaagggcttatgaggagaattctgtaggaactacattttagtagtttctcttacatgtaatgtcacctggatcttgttggtggccttaggaaatggtttattctctcacttttaacatgtacacaggcacatttttagggtgtagctgtaacattcccattccccactcccagcttccccggaggagtgtgtgtgagagctgggcacagaggccctggtggctccctccactggaagaggaggtggggagagaccaggttttcttagaacagactttatgaatcaggacaattaaagcaggtttctttatttgtaatatatggcaagttacttttaaaagtctgttgtggtaacccgatcatcttttactatagactctgtgcttctgcagagatttccaagcagctaggcggtggcctgacctgggacccctgctcagaaaggagctggggagggagccctgagactggggtttctccatgcaccccctggcccacactcagcagtggcatcactggactcttctaagtcagagcaagggcatcgtgtaagtgcctgtttggcttagaaggaacccagctacacacagattttccaaggaaacttttaatttctggttactctaaaccctccccccaaccacccctccggcttaagagccaaggttataaatggtgaaagatgcgatctctttaggttttttacaatgctgccattcagttccaagaggatttctattcagaaagtctatttcagcagagatctattgtggcccagtacctgcaaaagctgggtttgactgccatttgactgctggcaccaagtaaccatctgttctgggaagaaattctaagaaaatgggaaaaaacaaatacgtaaaaggttagcttcaaagtgagggaaggtatgtcatatagatatgtcaattttaaaactattcctaccagtataattacatacacctgtatttaaaatggcggtcctttttattctcctatcacacagaagaaacacctccttcaaaaggttgtattttgtttcctgaaatgctgggtactagtgtggaataccaactatgtttactaagggattcatgtctcacagcatgctccatggcaaagagcgatgccagcgtcccagcccagtggcacaagtgcacagcgtgagataaagaattcctgaaactaaaaggtaagcccagtcacgagaaaagcctgttctgctgcattccccaaaaacagtcttcaaatttcttactttggaataaaaaagcagctacattatcagagtcagaaatggccctgggtcttctccccagttgatgcagctctgacccatgactcaggatgacagcgagtgccccaggagctaggaggtgccctccctatcctggcctctcacaggacaagtgcctctcccaaagaaagaaaagagagatcaaggtgaccagctcaagacaccaaccaatcgcactgatttctctagtcattcttccacgtatgatcacaaaatatatttgctatttgcagagaataatgagtttttcttctgctaagtgtttgatcagttcaactgagaactttcaaaataacagaaaacacccagcctctcccagctcctgtcttagagactaaccccctttacactgtgtctatgtgaagaaggagacctctaccttcagccagtcccacgcacatttagtgaagcatgagactgggtttcaagcaaggactgcttcattaaactacaactctgattctcaaacccatatgctacaccatgcctctcagtcactttctaatctgatactatgaaacccaagtataaacttcaagatttcaagagtcccaaaccccaaacctgaagaggtaagactcaccatgggatttttaaagaactcgtattttgcgtaattcttcctgaatagaaatttactctcactggccatggtactctccacctggaccaccagctcatggtcttccaagcacctctctgcaggggcaaagcatcacgtgtgagacgcaacaggtgggaaattcatggtagctttacaaccaaatggaagatttgttcaactttctattcttctttaaacattatgaataaagatgaggtcaggaaggaaactaaatttaaatctctctttaatgcattaccaaatgcataagaggtcttaagatatacagcatgaagaattcaggtcaatacttatttttatatactttttgaatttggcatcaaccagatgttaaggaatgagcccgtaagactcttagcaaatgattttgcccttaaattgagaaatttcaactcttgtaaagactataacaagtgagacaatattcaaagacaaaggagaaagaacttgaaagaggtggaggagggggatgaccaagaaggtgcagagatggaaggagatagaagctttttgatgacatcaaacttggttgccagaaaagatggtgctgtgtactgtgggagaggccgtgatgcacagcaagactgtacgtacatactcatctttcacactgaagcccgcacgcacatcatggaatagttcttgtcaaccgaattacacgtgaaggcagggaagaaaacacactccatcctccagcacccgctgtggacacgtacacacacacacatgcacgtacgcacacgcctccttcacagcatcttacatagcagcactgtcccccagaaagggaaaagtcgcttccctcactgtgtgaacacagtggttccaagtggagcgggaagaactcagcatactctagaacagcgtgtgcccagagaggccgcactgctccctttcatggcagttacgtcccttcccaggcacctcctcagaaactgtcatgggaggatggtggccatgggaaactaaccttattaaatcatggaataaacaagatgaacaaatgtacagcagggtcaaagtgtgaagtgatgccaaaatggtacagattaacatgctatggaattgacaccagggtagttctgttatcctaagaccctaccctcctctcctgcagccagactggaatcttgaggaaagtttcatcttggaaggaaggaatgaagttaaaggcaaaagcatttctgagtcaaagtgatctcagaatgcagaaaagactttccgtctacaacgaacaactgtcgccatgggcactcatctcagatgagccccgaccggcatgcagaagcaaattctggagctgattcgtgctcggccccggttttgacattacaaggaaaggattccttggtaaaaacacatttaaagccagagtttgtgaaggaaaggaattttctccccgtggctgccagaaagctcagacttggcaccaccaccaagtgtggagcagttcccatttgtccctgtctgggagggaatgctgctagcaacatgtgaaccaatacgtggccctcatgtctccccatgatagaaaaagagagaaaccaagaacatgcaacaaaaactgttacgtttgctttccaaaaagaggttcattcattgaaaatggattttccagaaggaaaacaaatcaatgacttctgttgaaatgtttattcagagaaaaatgtctttctgtagttacaggaaaaaacaaaaacaaaaacccaaaaccaaaaccaacaatctaataacctgttgatggttgatttacagaactaaaaatttttatcaggcaaaataaggagaaataaaaatgggaggtgatagctacctaaatgaggaggatatgtctgtttccaaagcgaagggcattttgtctccaaagaaccctgaggagagccaaagaggatgcctggggcagccaccagccccaaagggggtggccaaacccacgcaggcgcccatccttgtggacaatactttcctgtctccctgcgcctcccctggaaagatcatgggaaagttgcacatggcagtgtaaacacacagggggacgtgtccctggtggtcagatccaggtggacaggtgagggcttggtgccctggcaaaggggggcccaggaactcgggataaccggtgggctgtgaaactgactgtgtatcctgacagaagtgtgcttttctgaggctggtgactccagagggcgcctaccatccccagaggtgggtcccaagacaaacaaaacatcaactcccttttcgtcactcacagcaggtcagtgaacacaacgtggcaggtgacccctttctcagagatccagagctgtgcagcctccggatgcagctgagtgcccctggcacaaatgctccaggcaccagtgttccagttggccatcgactgcacatctgttcaaagatcttccctccagttttaattttctccatgatttaaagatatgtattttcaaatgaccttgcatgattataaacaatcacatcactatctataaactgcatatgattacaatggcctaagttaaatgggaacactacttttcaagataatattccaaaaataatttcaagaaatggaaagggcaaaaattccttgaagtacatttgtatttttcaaatttctgaaactaatgctggcattactctactcctcaagaaaaaatatttaaatatcaagacaactcaaaaaagagaatcttacttccttgccttaacccttgcagctaaagtgtgactcctcggcagaaacctgtgctgccagttggcagtggaggggccatggcagagccggtgcacggaagctgtgcaccccactgtctcggcctcacatcgagctgcagcccttgggccactccctgcccatcattcctcagcacagcccacccaagggagagaaaagagctgtcagcaagctcagggctttcccaggctaagaaactgtcaacagagtaatcagtgagatagccctgacgtgtggataaggccgtaagtggacttctatttataaattttagtgggggaaaggacatcttttgttgcttttcacatacaaaagggagagagggacataaaaccagcctgcaaaaggccccctctaatcagcaagagtcaacaggcgccggctgtttctccctccacacctttctgcatgtccagctgtcagcatccaacagcgtggcagccacaggacctccagagttactgccacggtgtttcccatctgaccaggaacaaccacaaagctgtaaacagcccgaaaaggacttgttgctcttcctgtttcaacctaattctcaggacaacggaattcctcaaatccttgaaatttgtaagatctggcggaaaccctcttctctttactgtgttctctgtgtaagttccagcctctctcccagattatctgaccttagtatgcctgatgtctacagttacttggggcctgggtgcaagagccccaggcaccaggtgccccccacattcccagggatgggtttatctgcaatcccattttcaagttcagggggcatcaagatactagttttgtatgtttaaatttgtatttttcaaaattccttttatcttttttttttttttaatttttgaggcagggtcttgttctgtcaagcagctggagtgcagtgatgcaaacacagctctctgcagcctcaacttcctgggctcaggtgatcctcctgccttggccttccaaagtgctgggactacaggcatgagccactgtgcctggccaaaaatatcttttaaaatataatttgtttacttgatatgtctgcaggctgactgtttaatatcactgcatcctccatgtgtgaagctgccctggctaaggtgaaccttccagagacttgcagctcaccatgctcggggcagaagggatggggacaccttccaaaaaacctgccccattctggcagcctcagctggacttactgtcggctgttgagtggcctgggtcagggacagtgttttcatggctaagaactccactccagacactgagactgagaaacatccccaacaggtagaacctgggggcagtgctaacataggaagggaccatttaaagggacaagtgaactgggaatcataaaacagaccatcattcactagggcttcacctaccagggcaaggggctttgcaacaactttttcaagtgcgtccagtagtgaatgtccccaggagctaacgctgggaagggccacctgacctcagtctgctcataggagtcgttctctgcttatccacaagcgcagcacagagcgggcaggaaaaaccaccctcagcgagaggggctactctgccgagtgacagcagggatgccactgttgctgccaatggagggtgaccagcatctcagaggagcgatgccctccaggctgcagacacccacgcatggtgcttttctcccgcagaaagggaaccacctgctgcaggctatcttgggaactaccctcactttttctaaagccatcacttccttctgggtatagaaaaggtttaatattattaagggactgatattttagctgttaagatccttatacaggttgaatatcccttatcctaaatgcctgggaccagaagctttggtttttggattttttttcaaattttggaacatttgcattatagttaccagttgaacaatccaaaatcccaaaatcagaaatgcttcaatgagcatttccattgagcatcaaaacagtactcaaaacatttcagattttagagcatttcagatttcagatttttggattagggatactcaatcagtaataatgtactttgtactttggaatcttcaattctggaggccctacataggcttaaaatgctgtccaacttgggtgccctataccctcaattatgggggggttgggttacaatctgccttagtatctgccttatagacttgcaagcactacctgccttttgccccagccaccagcctggcgtatgtacacatccctgtgagaatacctgacatataattacctgggcaagtgctctctacaaggagacagcaatgcctggggatgtgccctaagagttggagggccagaagggcccaggaataccatccatgataaagaagaagcccctgttggccttgcggcccttgcgtccctttccaacggggataaagctgagatactcaacaggctctctgagaggcaccctgcagccctgcattttctcactaatgagcttctgatagttgaatgctgccaaatcatggcagaaataagatttttagttaaacagcaacttaaattaattttttaaaaaacgttaagtgatatggttgggtcacaaaacagtattcagagaagttatagggatggggacacagaaaccctgtgtcaacgggaatgagtcctgggggtactgaccttataggctggtgaaactggtagctctaaaaacttgcaaagtcctctgcaaacccagccaacagaaaaatgtgtttcctagtaactaataagaacgggactggtggtgagaaagaaaactgaggaaggagaggaaggatattctaaggaatttcatgtatcttcaaatcccggctgtgtgaggttcgttatttttttattttttattttttttgtgaaacaggacccaaaatttgacacaaatattcctcttttttttttaatcatttcacttgtttccctttccctttttttccttttatacttaattttacaataaagtgtcatcgcccactagaatgtattaagtccatctataaagaagagaaagaaataaggtatgtaaatatcacaaccctacaaatcctgtgtgcttatggacatttcttttcctattctctcagagtaaatggttcttcatttggttaaagttttaatgcatcatttatttatctaccatatgatagtctagaaatcaaagggtatcacatgaaatagataattcaaaatttctgaaacattccttatatgttaaaattttatgtatgtatatctgtacccaatttctatgtgtcctgagtgtgtccaattatattcaagtactaaatgtccgcagaagtccttttcatagttctttcaaatgaaaagaatattgagacttgtgaatgggctttcaacaataatcattgtatttgggtcaaactatacagacttgtttttaaaattttatatatatatattttttcatacatatatatacacatgtagagacacatgctgaaggtttcccactgctgtctaatttccaagttacttgtgtgtcaacaggtgcttttgacagccttatcagaccactgtaggatccactcatggacgtcccaagctggagcttgacgggacagctagtctccatgggaacaactgtgacatcatggtcactaactgtggacctagtaagtgatcctggcaggagaaagctgttagtgacaatggaggagaaggcttctgtcgtcacacaaatgcgtttagcaattgatagagatgggaaagaaaccagcaagagttctatccaattccttcaaaaagcataccgtctctccaaagtacagggcgcattagaaaacagagacttaaggtggtgtcagctcaaatttacactgcattatttaggcttaaattgtataatattacctggaaggatgctactccagacctagaggtttaaattaagtattccagacctagaggtttaaattcaatgtattaatctttcaaaaaaggttcatgagaaaaatttagaactatgggaagtttccaatctgtgttatttttctctccttcaagacatggaacaaatatagctgttgatttagagaaaattttggttttgaatattttactatgactttgtaagaactatatttattagataagaatttaagcaaaagtctgaaaagcttttttacctaaaataagccacctgaacaaaatacctcaatacgttctgtaaagagtcaatatcttcaaatattctgtgatacaaaatattctcttactttttaggcatgacatgggcacacacatatacacgtgcatgaacactgttcaaagccttattaaccagcaggcagagatgccatgtaagactcaactcaaacttacagcaaagtgcttcataatttgctccaattcccagcggacctctctgcactttgctgcctataaccatggctcccttcttcccatgagctgaggagctgatctcagaagggcagctgcaatcctgtgcatggccagctctctccagagcacctcaagggcacctccctcctgtcccccgcccacaggtgtgcagcaagctccatgtggctctgacagctggggaggctggacaagccacagggaacctcgccatgtctgagcccttggcaagttattacctcaaccatccaaggcaagattcccaaagtactaggggaaaggggctggagggaggagagtgaaattttaggagaaacaggagagtcgaggggaacccagagactgcctgctaatttcgcaggggacactgcggtcacacatttggcatttggcagcagcagtcttcattcaattgcacataagcatccccaggtgccaatcctgttctgatggttccctacctaatcctaggtgcgggtggtgctccactagtgtccagctgttgtcatccacacagtgacttttgtaaaccagcaattggcacaggtctctggctgtcatgtctgctagaatctccaccactttgcttgtcccatcttcactaaagactttaacatcctgcaacacacaaaggggatagttacagataaacaacttcgggctttcaagaaataaaaactgaaacaaaagaaaacaggtaaagtaaaaatagtagtgctccaacacatgggcaactgtttttccaggcagccaacaggtccccaccagctgcagggatgtgactcttcctccctatctcccctttcccacctcctgggggcagagcaggtaggattacaacatgatactcttaaaatgcccaggacaactcatgggaacatacagcacacggctaaaccaccaaacctgtcttaagaagtgacaggattcacaggattcatttaaaatacgctggtggtctccaggttggacattttacagttgaaccaattgaaaaaacaagcaagcaacaacaaatcctgtaaatctccctcttcccatcataacctttgacgagtcgacctgttctcccagggcacagggtccagcagcggcacctacagcctttcccgcagcacctcacccctcacagacactgaggctcagggtggagtggagatgaattaatacaaaagaagggcataataaaaacatagtcacaagattctttagcccctaacccctacaaagttacaagcaagcttcatttgcccggtgctgttcaaatccatgaacaccgagcagctccaggccaagggatggagaagtagagtccagaggacgggagtctatcccttccaggcaagaccctgcagcaatgcacccttcccagaacacgaggtgtgtttaacaaatccttacctcgacagcccggaaaaagcagtcagaggagcaagatggcattttaaattgcgactgcctcttgcaagggagcgtgtttccgtctctccccactgtcccaggctggctgtgtggagcctgcgtgtgccctggggggcaggctgtctccgggcagcagggaggccacccacccacccgctgggctcccaggctgccttgcaccggctcccttagggagtgaatccagccacagtgatgcaatcaccccacggacttgctctcccactcccatacgacaagacccggacttgggggtgaggacgccaaccacaacaaccgcaacaacacaactctcacaccaactggtcagaaaaacccccgctcaatgctttcccatggcagtgaaatcacacacaggcagctgagaggctgaaacacgtgcgttctctgaatccagacccatctgccaacctccaaataatctttgtcccgcaactgatgtgtcagtggcagctttggagctggatctgcagggtgggtgagaatgttagtttgtcctgacaaactccctccgaggctccccgctctctctggccccttttcttgtgtttggaagggggtgcttacttgctctgaactttgatttctgtggccggcgtggagtctgacagcagagggaagggctgggaggcccccaccttaatcaggaactgggaccacaccattctacagggaccctcttgaccctcctacagctagctaccctcagctgtcacccggtgggcaggaaggagtcaatgtcactcaagcctgagtgcccaggtgggggtggtgggggtggtagaggcggggctcagcgagagcggaagagcccttctctgtgagggcaggttagcctcccagcagacgggggaccagccaggggagcctgcactctcaggtagggtcactgccccctgcctgccacctacgggccacttctccaactcaaagaaatcccagggctggggctggatcaggacccagagacttgttttcaactcttatttatttttcaagaaatccaccatctcttttccagaatttatgtgtcactcaatgaaagtatacttccccctaacaagcaaaatattcaaatacagctgacatggctgaataagtctacagaaatacaatttaagtgaagaaaacatgtctctgggtcctaggtaggaatgttattaaaatgcattaacataaaagaaaaacaggaatttggaaaatataactgagctccaacaatgctttataaatatgctaaccatcatagggaatgtcttcaggaccagtgcatgccttctgctacccaaatcagggttcctaatgctcttcttccctgagtctctcaatgagcttatctgcactgaggatacatgatcttctctaggaaagtgaaattatgttgaagtgtgtgtctcatctctctccaagtctctttgccacttttcttgttcaaatcagccatgccaatggttttctcattttttttttcagccctgctgcatttttctttaaactctctccccaacccctgttgttccacagccatccccccaaaggtctataaatagcccgggtattaaaagctgagatgtgcttggtcacacgtccacatccactccttttagattcccacagaggctgggctggcgagaccctgagggggcaaggcagacaggagactgagtcagacacaaaggcaggcaccttccagctccagcgacaggcccctctgcccctgacacagcactctctggtacttccaatctcaccagggccctccaaccacacacaaagctaagacccagagacagaacaccaagaaagccctgtgtataccagccatctcaaaccacccagtcaacgcgtagagctactgatgagaatgtttgtaaggaacacaagaggtacgagggctcctattacagggtactgccagccactgaccacggagtcttttagagctggcagttctaggaggagcattctgtacagcaccaactgcccctttagtaaccacctgagcactgctgggggctcaggtctcctgcggagcaggcctgggtttccctggcccatccagtgttcaagcatctcacacgaggtgggcctagaaggttctctcgagcaggtcaaggcccttgtcccgcagcaactcacagttcagagcggagattgttaccacaggcagttaatttccaaggtatgacttgtttagggaatataagaatctggtaacaccaggaaaggtgagaagctgagacccacaagttctatctgagttctatcccggcttagcctcctactggctttgtgacctcggataggtaattagcaatctaagacttgctttcctcatccaagctgtggggaactgctctgagaatcagtaatgtaagcaaaacactgcttaatcaatgtatggaagttctacattagttatgacctatcttggcctggggtggtggttccaaagaggaacttagaaacagacttggccataaccatgcttcatcagtaactagctgtgggaacatggctgagctatccagcctctctgtgcctcagtttcctcatctgtaaaatggaaatctgtaagcagcaccagcctcatagtgttgctatgacatggattaatgagataccctcttgaaaagatcctggcccctgacacgtgccctccctgggacgtgcttggatccaccgtggatctgggaacaaggcaggctccagctgaaggcctgtggacaaccaccgaagggtgcaggggcaggaccctgaaagctgcttccaactcaggatttcagttctgagaaagcaaacctcatgaccagttaagatgcagcaggaacaattcagtcagaaaagccacccctcaaatcctcaatttctttctctctactgcaaaaaagcccctaaatagcaaattgtttttaaaaataaaacggcaatattaaagagggcataattatgtcaacagcatgaaactctgtctttttagagttagttgggggaggaatggtttgcaaagctacccaggcctctggctggcttggcactgaatcccgttataaaagccctgaagtgctaatagaaggttccactgttcccagactttctgttgtcactttttacatattcactgcatagacaaaaaagcaagagcttaattttttttgcaaacttaaaggaagaagtttaagaacaattggagttgaaggtagatcattatatctccacggccccaaactccactctggggcacctggttttttgtctcagtggcccccacggggttgttgtgtgtgtgggagtcattcaggcccctccttgctgtcaatcttagcacagaccctcactcttgcttcctgccacagtcttagaccttgctcttggataacttacaggctcagggaatctcatgactgcatccaaaagacctcctgactggctgtgagtctttgctcaaggctcagcagtaatcgccttgtaaaaatagcaaatggggcactctctttgtcctcttcgagccctctgcagcataagatgtccctggacagacggcccagcctccagggtgcacacactgacccacagtacccgagatccacacctaccctgagaccttcacacagaaaccgagacatctgagggcttctgggccagcagctcttgcgaccagtttcatcccagtgcttaattatgatctagcatactttttagttcaaaagctcttttaggatgtaatgtaaaatggagtttttagtaactctggtaaatactcgtggtaaatgttttggagaagccaggttgtaatcacagggccaagtggaggcattcacagggtaagagaaattatcaaagcaggcaaaaggtcccgaagacgtgatatgaggttgtgcatgtggatgaaatcctgttctgggtgacctaccctaccctacctggcctccgaggggccttgaggagaaagcaggaagactgctgtgccaggaaggcaaaggaagccttaactccacgcacatgtctctgcccctttgacaggaggtggagctatttctggaaggcagaaagcttgcccgatgtcacagaggtggaaagtactggagccaggatctaaccagggctccccgccctggctctgcttgcctttcttctccactgcaacccactacccagcgtgtaccaggtgggctccaaggcttcacacaaaaaggcttttgattccatgtggccctgaaggcctcaaattgggcagaccctgaagcctggaggtttggggtaaattacatttacttcagactagggcataaccaaccagggtaggctaaattaatctcaccaaaaaggaatgtaattctgccattatttttagttctgttttaaattaatgatattatttcttgatataagggataactgaagcactacacatgattatatggctctactcaccataaagagaacacgcataataatcctgttcaattatagtgactcaaacctacttaaaaaaaatgtgcttaatagcctgcattgtcccacctgaagtgttttgttgttagcctgggagcagttcagtgtcccccaccacagctgaggcttgaccctgaggcctggtctcagctccccaggacgcagcacactgcccagggctatggagatgagacttgtggcctgatttcaaatactggaggagcccccactgtctgaacacagcaaagagtgtggcgcaggttcaaggggtggcatgggagccgggtgccccacccttagtgagaccagacccagaagggtgtggcctgatagccttggtttccgttgcagggagtcctgaggtcctgagtaccaggagctcagggcagtgcggatgacttgggagaagcctagctggttgggccagttgctagggctggatgctggagggagaaccacagggttgggggagtgtgagctggcagtctccagggctacctgctgggctaagcatcccagttgctcctcctactgaagagactctgttgcgcaggaaaggcaactgtgctgcacactagagggttgtcccagtggcctgagaggtgtccctagacccccgccaaggttggtgcttgtacctgccctggagagcctggtcacgggcttgccagacccagccatacccagctctgccgcccccagccagggtggtggcagagtgcaggacgggatccctgggaatcccgcccatggccagggaaaccctggtatttccccacatcaacaaaggccaaaaattccactgctattattgcaactgcctctcaactgcaagcgccacctactggcctgtagggtgaactgcataactcaaagtaattcctgctgacagtatacagcggtgggggatgagataagcctcctgaaacctccacctccccatttctctgtaggagacagtgagtctgaccactggtccagcacactgttactacaacctacaaacaactagcatttgagaaaaccactacactaaagctatctataaccaagtaattcataaaagccttggccccctaaaactacagagaagccaagacaaaggaacttaaccaacatacagaacagtcacatcctcaaggtgggggagggaagaaaaaataccaagcaaatgaaagtaaattcaaaaataagtagtgaccgcttctacagatgagaagaaaccaacacaagaactccagctccatgaagaaacaatgttgtgacatccacattagccctctagcaatggctcctaaccacaatgaaaactttgaaatgacagataaagaattcaagatatgaagtgtaaggaagctcaatgagagccaagagaaagttgaaaaccaacacaaaaaaaccagaagagtaattctggagatgaaagatgagatagatatattaaaaacaaacaaaacaacaacaacaacttttggaaatgaaaagttcactaaaggaatttcaaaaaacagttgaaagcttcaacaatagagtagaccaagcagaagaatttcagagcttgaagactagtcttttgaattagcccagataagaagaaacaacaattttttaaaaaagaataaagcctttgagaaatgtaagattatttaaacctaggacttataggtattcctgagggagaagaaaaaaaataagtttggaaacatatttaagggaaataattcaggaaaatttccccaaacttgctagagatgtagatatgcagatacaagaaattcagagaacccattagagatactacagaagatgcacattcaccaaagaatggtcatcagattaattcaaggtcaacatgaaagaacaaatttcaaaagcagttagatagaagtgtcaaatcacctataatggaaatcccattagactaacagtggacttctcagcagaaaccttacaagtcagaagagactgggggtctatttttagcctcctttaagaaaaaagaaacgtaagtcaagaattttatattctgccaaactaagcttcaaaaatgaaggagaaataaagcctttcccagataagccaatgctgagggaatttgccactactagacaaatcctacaaaaaaattctcaaaggagttataaaaatggaaacaaaaggatgatactcaccatcataacagcatacataagtagacaaagctcactgtataaagcaattacacaactgagactacaaataaaccagctaacaacactatgacaggaataacacttcaaataccaatattaatgttgaacataaatggcctaaatgttccatttaaaagacatggactggcaaactggataaaaaaacaagacccagccatctgctgcctacaagagacccacctaacggctaaagacacctacagactcaaagtaaatgggtggaaaaatatatatcatgcaatggaaaacaaatgtgagcaggagtagccattcttatatcagataaaacagactttaagctaacaacagttttagaaaaagagacaatgaagggcattatatcataagaatgcattcaatacaagaggacataaattttggaaatacgtgtgcaagcaccaaagcacccacattcataaaacaaatacaactacacctaaaagaagagaatgacagcaataccataatagtggggggctacaacaccccactgacaacagtagacaggtaactgaggcagaaagtcaacaaagaaactctgaacttaagctagacctgatcaaatggaaataataaacatttatagaacatgctacccagcacctgcagaatatacatttttctcatctgcacatcaaacaaaattgaccagatgctttgccataaagcacatttcaataaattttttaaaaaatcaaaaccatatcaagtatcttcttggaccacagtgtaataaaattaaaaatcaataccataaggaactctcaaaactgtacaaatacgtggaaactaaaaaacgtgctcctgaatgacttttgggtaaacaatgaacttaaggcagaaaaagaaatttttttaatgaaaatagagacacaacatatcaacacctctggaatacagcaaaagcagtgctaagaaataagttttatagtgttaaatgtctatatcaaaaagacagaaagttctcaaattaacaacccaatgtcacacctcaaggaactaaaaaaacaagaacaaaacccaaagctagcagaagaaatgaaataaagatcagagcagaactaagtgttattgagaccccaaaaaacaaaacaaaacaaaaaaacccacaaaggatcaatgaaatcaaaagttggttctttgaaaggataaataaaattgatagctagcaagtttacctaagaacaaaagaagattcacatgagcacaatcagaaatgaaaaaggtgacattacaactgataccacagaaatacaaaagatcatcacagattattatgaacatctctatccacacaaactaaaaaacctagaggaaatggataaattcctggaaacacccaacttcctgagattgaatcaggaagaaacagaaatcctaaatagacaagtaggggtaataaaatggaatcagtaattataaaaatcttccaataaaaaaaaaaaaaagcccaggaccagatggatccacagcttttttttttttttcctttccttttttttttttttttttttttttttttgagacagagtctcattctgtctcccaggctggagtgcagtgcagtggtgcaatctcagctcactgcaacctctgcctcctgggttcaagtgattcttctgcctcagcctcccaagtggctgggactacaggcacgtgccaccacacctggctaatttttgtattttctagtagagacagggttttgccatgttggccaggctggtctcgaactcatgagctcaggtgatccacccacctcagcctcccaaagtgctgggattacaggtgtgagccaccatacctggccctacagccaaattttaacagccatacaaacaagaggtggtcccaatcttactgaaactattccaaaaatttgagaagaaattctttcctaactaattctacaaaaccagtatcaccctgataccgaaatcaggcaaggacacaacaaagtaaggatactgcaggccaatatcccttataaaaacatagatgcaaaaatcctcaacaaaatactagcaaagcaaatccaacagtacattaaaaaggtaatacatcatgatcaagtgggtttaattccagggatgcaaggatagtttgacatctgcagatcaataaatgtgattcatcacatcaacagaactaaaacaaaaaccatatgattatctaaatggatgcagaaaaagcattcagtaaaatacaacaccccttcatgaaaaaaaccctcaacaaactaggcactaaaagaacatacctcaaaataattagagccatataggacaaaaccacagccactatcatactgaatagggaagagttgaaagcatttccccctaagaactggaataagataagaatgtccactctcaccactactattaaacgtagcactggaagccctaaccagagcaatcatgcaagagaaagaaataaaaggtatccacattgaagaagagaaagtcaaattttctgtgttcatttgatggcatgagttgtgttttttttgttttgtttttgttttttggtagggtctggctctgtcactttgctggaatgcagtggcgtgatctcagctcactgcaacctccatctcctggcctcaagtgatcctcccaccttaccttccccaagtagctgggactacaggcatgtgccatcacacccagctaattttttttgtactttagagatgaggtctcactatactgtccaggctggtctcgaactcctggactcacccacctcagcctcccaaagggctgggattacaggtgtgagccactgccttaatcttatatttagaaaaccctaaagacacttccgaaagactcctagacttgataaacgacttcagtaaagtttcagaatacaaaatcagcatataaaaatcattagcatttctatacaacaataatattcaagctgagaacaaaatcaagaactcaatcatgtttaaaatggccacacacacacacacaacatacatacacataatacgtaacaatacatctaaccaaggaggtgaaagattgccacaaggaaaactacaaaccctcatgaaaggaatcatagatggcacaaacaaatggaaacacatctcatgctcatggattggaagaatcagtatcattaaaatgactatactgcccccaaagcagtctacagattcaacataatttctatcaaatttccaatgtcattcttcacataattagaaaaaaagattgtaaagttcatgtggaacaaaaaaaaaaaaagagcttgaatagccacagcaattctaagcaaaaagaacaaagccagaggtattatattacctgacttcaaattacatggctcaaggaactaaaacagcatggtactggtaaaaaaaacagacatacaaatcaatgaaatggaatagagaacacagaaataaagccacatacttacaaccaactgatctttgaccaagttgacaaaaataaacaatggcaaaaagacatgctattcaataaatagtgctgggaaaattggctatctctatgaacatctctatccatacaaactaaaacatctacaggaaattttagccataagcagaagaatgaacctggacccttgtctgaatgaaactggacccctgtctctcaccaggtacaaaaattaactcaagatggattaaagacttaaatgtaagactggaaactataaaagtcctagaagaaaacctaggaaaaaacttttggagtttggcctaggcaaagaatttatgactaagccctcaaaagcaatgcaacaagaataaaaatagacaagtgggacttaattaaaagattctgtgcagtaaacagacaacctagagaatgggagaaaatatttgcaaattatgacaaaggactaatacccagaatctaaaacgaactcaaacaactcagccagaaaaaacaaacaatcccattaaaaaatgggcaaagaacatgaacagacatttctcaaaagaagacatacaagcggccaataaacacataaagagatgctcaatatcactagttatcagagaaatgcaaattaaaaccacaatgagatatcatcttataccacggagaatggctattacttaaaagtcaacaaaacaaaagatgttgacataagtgtggagaaaaggaaagccaaatacactgttggtgggaatgtaaattaatacaacctgtatggaaaacagtatggagatttcccaaagaaataaaaatagaattaccattcaacccagtaatcccactactgggcatgtatgcaaaggaaaagacatcattatattaaaaagacatgcatctgtatgtttatcaaagcactattcacaatggcaaagacatagaatcaacctaaatgtctatcaatggtagactggatttaaagagtggtaatatacaccacagaatagtatgtagtcataaaaaagaatgaaatcatgtcttctgcagcaacatgggtggagctggaggccattatcttaagtgaattaactcagaaacaaagaagcaaatactacatattatcacttagaagttggaggtaaacaatgcatacacataaacataaagatggaattaacagacattggggactccaaaatggagaaagatggaaggagggggtgagggttttagaaattacctgttgggtaaaatcttcactatttgggtgatgggtacagtagaaactcaaacctcattattatgcaatatatccatgtagcaaacctgcacatacacccccgagtctaaaatttaaaaatacgttttaaaattctgctttataattgatagatttcaagtttgcagtgaaaattaaaaagatgttgtttttaaaaatccttttttctaaaggagataaagttctagaaataactaaagagttcttgaaagtcaagcatggtttgccaggcgcagtggctcacgcctgtaatcccagcaccttgggaggccgaagtgggcggatcacaaggtcaggagatcgagatcatcctggctaacacggtgaaaccgtctctactaaaaatacaaaaaattagccgggcgtagtggcaggcgcctgtagtcccagctacttgggaggctgaggcgggagaatggcgtgaaccggggaggcggagcttgcagtgagccgagattgcgccactgcactccagcttgggcgaccagagcaagactctgtctcaaaaaaaaaaaaaaaagtcaaccatggttttcagagaccctaataggactttccacagtgaacaagtctcactggctaagggggtggacaacaagattcaaagcagtagcctctacccttgttttataccaagtagacaggcttatttggaagaatcagttttgatgtgctcatctgccatttttttaaacttttctaaaatggatatgcatagcctgttattttgaaaaacatgtttttataaaatagaatcattttgtcaaaaataaaattgaaaaccacttttaaaaaatctccattggtggattaaaggggagcaaagataagaaagtatggcatgaaaggcatctgggctgtgacccccagtaccagtgtccttgctggggtcatctctagaaaggtttaatctgggctgaagatacaacctgagggctcctcccaaacaggggcagggccctcttggagctactgtcctttggggctaagattccagaagggacacagttagcttgctttacagtcagctagagatttctgttttcacacatgactccttgttgggtatggtttttggctctaaggatgctggagatccccaaatgggctatgtgccacaatctgaattcctacttcaattgtgtggtcatgacagaggcaggtccagcaggcacagaaggacatgttggaggaatggctgcccccttcgaggtaatcttcagatgggtgacatcatggaggaagcctgtggtacatctggagacaccatgacaccacattaggtttactgcaaggccaagcatttagtcctgtgcccctccacccttctctttagaaggtgctgaacttcaagaggatgttgtaacccacgactgtattttacttagtattagaatttatgcattttcccttgagtcagacattgctacaaaacttgaccataaagagaatttcacttgtcctctcaaacctatgaggagagccagcattctctctcttctctctgtagcttatttgccatccaaatcatctcacatttaaaatcttccttttcttctgatatctcactgacctcatccatgatatccaggagtatgagctgaagtttttcctaaattggaattaactttgggactctcacctctatctaatctattccttgtacattgtttacagcactgaactgtttttcttgtagatggactcaggggagggcctctgtggccttccatcctcagctttgccggatcccagccctatggagctgagcacagaaaggcaggctgtagtgcctggagcctcagtttttcacgtgacacaggcacagcaccatctcctctccagggctagtcacgcaggctcatgggaacgcggtcctgctgccaatccagtgagcgcctaccaccgttgctgggaacaatttttttgtctttcttcctctcctaagctcctggacagagagtcacatcttgctcactcttcctcactcttgcttgctcttgctcactctgcactgtccacctgttcgtctgttcgatgaatgaaccctaggaaagagttgcttgcatcacttctactatgcttgaattttatactcatcaaaaaaggtgggggggtagccttcattcaaacctacagcttcttccactctcagccgaaacgttttgctggtgactgttcaagtcttccattcaacattgcaccaagatgtccctatctgaatggcttccctctactggagtgtgcttagggcatgcaagtttccctgaagggcatcctaaaagccctggcactagtgtaacaaggacacattcatgagagctgtgaagggcagtacatttagaacagataaggaaaaggactttcttcaggccagaggccacttgggggcactcattttcctgtgtaaggacaatgacagcagctgaaggctgcagccactcatggtccctgcagctgtgcaaagttgggaggggtggaaccatgagttccagacacacagacaaggcagaccatcacaaacacaaacacgtgggcagctgcagggccacagtgtccactcctgctgctccaacatctctgcggcaggacagtcagctggtgacactggcgagagaaggcactgggactgctggtggtgacagccttctcttgggctgatgctcagtggcctgaggatttaccgtgagcgagcccagagtgtgtctgcagactggcgccgaggaggcaagggcgtgggaaggctcaacctggccagcggcagagtaccaggaagtctgcacgaactcactgctgctcacctgaggaacacggggtggggagaaggtgaggagttccgcggcagcgacagaggctctacatagaggcttcaaaatctgtctctaacctagcttgctgagtgtctgggagttttcttaactagctgttctgggtcctgttgcattccactcactgtcccctcctcttgagcctcagaggcctaagcaggaggcggaaccagcaggggaaactgcagagcatgcagccaggagaggcaggacaaagggccatgcactcagaaccaaggggccagaacagccaaccaaagaggatgtgggcttggaaacttcacacacacacacacacacgcatgcacacacacacacatacaaacacatgcacatatgcatacagatacacaaatgcacacacatatatgccgtatacacctacatatatgtaaacacgtacacatatacatgcaaacatgcacaaacacatacacacatgcacatatacacatgcttcatacatacatatacatatacacataaatatatatacacataaatatatatacacatacatataggtcgagtattgctaatttaaaaatacaaaatccaaaaaactctaaaatctgacactttttaagtgctgacatgatactcaacggaaacgctcattggagcattttggattttcagattgggatactcagctagtaagtgtactgcaaacatttcaaaatcagaaaaaaatccgaactctgaaacagttctggtgccaagcatttcagataaagaatactcaatcattatactcctacacacacacacgcatagacacatacatacattagttttctattataaatataatgtgttcattgtagcaaatttggaaactaaataaggaacaaaaaataataactgatattccttcaagcagaatgcctactcaagaatgtagaatgatagacaaactggacaacatcatcaggacagcaccagtcaatggacatctgcagagagcagaggatcgacacagtctcaaatcatcttccttcaaattacttcttaattacaaaaggaaaatacatttgacccttggacaacacaggtttgaaccattcgggtccagtaataagcatagttttttcaaccagatgcaggtggaaaatagagtcttggtggtatttgaaacctgtgtatatgaaaggccaactttttgtaaatttgggttccaagggctgactgcaggactgagtatgagcggattagggtacatggagggggtcctggaaccaatcccccatgtacactggggaaagacttaatgagaaacgtaacagacaacaccctaatcaagtcataaatatcaacatcagcataaactggaccagccaacatcatcatgcctgtgggccacagcctcctgtctgtggaccagatgggactccaaggaaacaccacacaaaccaaaatggcccttcaagaaatcccatccgtcacgacaggtgtgaaaaggctgaggaacactctgtattaaaggaaactagagatcttaaagtgaatgcaaatggttcctgaacaggaataaaagaataacataaaggatgtttatatgaacaatcggggaaacctgaacgaggtctgtagatttcaaccctgcatcttattaagggtaaatatcctgactttggtaactttattatgatatgtaagtgagtaaccctgtttttagtcaatagactctgaggtatttaggagtaaagggacttgatatctacaaatgagtctcaaatggtccaaagaatcatggtgtgtgtacatataaatgtatatatgtgcatatatgtatctctatatatgtacaggacaatggaaatgacttaaaatgtggcagagatattaacaattggggaatcagggtaaagaatatatgagagttctttgctctattactgcaacttctctatacatttgaaattttttcaaaataaaagtttaaagaaacatacgtgcgtgaaaataatgacctgcggctctcctctcttcactcagcatctcagtagtatcttttcccatagtaacgatcaccccagaacatgaggttacatagtggaaagcatgggggcccttgtttcagggctatcttcaccaggagcatctctgtttcttttccattcagcagttgtcttcactatcccggatatttatgtccaaaacactcagccagtgtggctcaatcacagactaggagctcaatgggttcaacaaaatatcccaggtgtccaggtggggttccttgagtccaggccctggaactgggtccctataggtgtgtgttcacctgcccagtgaggtcccacaagctgaccatcacagggtcccctagtccatgcccgagctctttatttggtggctatgtgatggccgagctcagggacacagatagggaagggacgtagcacccgcttccactgccttcttcctccctcttgtattggaagcccaaaagcagccccccagcaacctgaaacgcatgcagtatcatcagtctacttttatggtaatgtactgtctttatcaggacaacttctccttcatgtcttatttcaaaccctgtcactgactgatgggcattccgtttcagaaaaactctcacctgagaccatcagtaagcaggacaggtctaactgtgatttcctgagtagggaacctcaggtaagctctgtaaggcctgctgtgaaagcggtaccctggatcacagcaccgaactagcaagagcgggacatcagcctctacacagcccactgggccaccacccactggccagtggagcagggctgtcctgtctgctaaggccccatgaccaagaaggtgtgggcagatgctagacagacagaacaatgacagacaggtggaaggggctgggtatgggatgggcggaccagttggtgaaggaagactggcagattcacaaacggtgaagtctgagaagctgagagacacagcaggcacaggatggctaaaacactgcaaaagggctataatccccagtaccatctccagtctggacgacgcagaaaatgacagccatgagaaaaatttcataaatggagctatcatttagggctataattttattcaattacaacatgccagaaaatgtatttgaagataaaattttcaccctcaaaatcccgatttatctccaaaatatatttgctatgaatacagttgacgctaataatctttatactgcccataattcattttttaaaaagcaagcttacataccatcaaaatgagattatataatcacaaaaatactgataactggaaaggcaaaacagaaactatggagatttctttgaaaaagcagaacacactcactggcagcccttggactcccagcctgctactttttcagtactaaaaaccacacaacccatgcaaaaatcaccagtgacccacagcagctttcagccatctggggagtatgtctgctgggctggcagggaagaaacatgagccaaaaacactgccatttgggcactaactcctttaaaaccaagcaaacaaaaaggatctgctgagcaccagctcagaaggtctaacaccaagaagaataagtacctgaaactgactgtgcacatcttacccccatcctccaatcgcccggagttctcagactccaagaggtctccaggcagatctgaaagcaaacgccgtcgtatcagacctcttggggtctgtccatttgctcccagacaggctcagtaaacatcgtctagagtttcttgaaactacagaaacagccaatcaaagtgatagattgcctggacacagtcccctcaccacccagggaactgtcaccagagccccagtggtgcgaggccctaggcagtgagaagaattggtccaaagccacattgcgaggaactgcagagtcctagccagtggccagcccccaagtcatatgccttcccatcgtattataagtgacatacagcccttggcattatttataaaaatgaactttctacacccacccacatacttataaatacataaaacttctgctccagcaatgacactgctggaaaccaacctatccatctgtctatccatccacaaccccattcatgaccaaggacccatgcacgagaatgttcatttcagctctattcataattagaaaaagctgcaaacaaaagtaagcttatgtgccattaaatggtatataaacatctcagtagcgtcttttcccctagcaacgttcaccctagaacgtgaggttacacaatggaaagcacgggggcccttgtttccgggagctgttcatcaaaagagggttgaggtaaatctatcacggtacctccatacaacacaacactatgaagctgcaggggaaatcacaacaatgcacatcaattttgtgaagagatacacaagatactgtccgcagtgtcacctctggagaatgagactagagttggaaactgagaagaaagtgaatctcaccgtttaccaaatacctttttgtagtatttgtttcactttttgttttttactatgaatgttacttttataaataaaataggttctcctttttttggtctcctggttggacatagaggtgatatggtaataagtcatggcaaacttactcctgactctgaatcctgtttgtagtgctagattccgcaaattgtcacgccctgactgaatgaaccagcttctttggaaagagatgagtgggggtagagtgggaaaaagttttcacgtgaacttctctggggaaaatgctagcttctaatgcattcatgttcctggaggcctttttctccagaaaaggaagtagctcttggaccaattggtgtaatgattcaacaaccaatcctccatctcatctactgagacttaaccagccctgctgctacgggcaccaatcccacctggtaaggccggtggggccagataggaaccctggtgcagagccaggctcaaggctcctccactcatcccagccacaaagtcggcaaccccaagcatccataaaagtatcactaactaaaaagaggcagaaagtgtggagcataagatgaaatgtgcctattaatggaagaaagctcatttaggcatgaagagtccaattctctcttcggacagaaatcacaacagtctcagcaaaacaacaaaacaaactcacttagaatctatcagtgtctaaatagagaccttggttatatagatgtggcatctaacctcagcattttataacttaaaaagcagatcaaaatagttagtgctccagaattacaagagggatttccaccagtaacatctttttttgaaaaaagtttctttggtggtaatcaaactttaatgaaacattaaacctaaaatgtaacctataatttgaaaaaatgttttcagatttgagtcagattggccgaaccttttcaagccatctcaggcccagctacatggggagggtgcggatgtgccctcactgtcagtcactgagcagatgctccctgagaaccttctccgtgccaggcaccaaggtgctgggattcgggtctggaataaaaccccttgactttatggaacttcattcaagtaggggagatagacaaaaagcaaaattcagagattgttagatggcagaaggcaaaggaaaaacattcagcaaagggctgctggctaagaaggtcctcaaaggcagcaaaagatgccacaggccgactgtgatgctccctcccaggcggcagaaactggggaccagctgagtcaggaggctcccatgacgacacaggcaaggaaagtaaagcccaggcctgggtcccacagcagagaccaggcaggcgctgtccaattctggtacacaggctggggtggcgtgaaactcaaaagaggagtgaggaagggaattgggaattctgatgggggtactggtctgctgctctgagatgggaatttggaggtatcatgtttggagggaaggatcagatgctgactttggacctgttgcgttggcagtgtcttttaagcacccacatggaggtgccatgttggcagctggaaacaggagtctgggccttgaggaagagtttggatgggaatgtaaaccggggagtaatcaacatagggacaagatggaaagctgagggaatggccacggctgtccagggagggagcgcagagaggggagacggagcaccaaggcccagtgactgaagagccagcaacgatggctgagaaggaaagtccagcaaagagggtggaaacccagacggagctgtggaaaggagagcagcgagcgacaggagccctcatgctgctgcaggcccggcaagcggaagacagagaaccccgctggctttagccatgtggatgccaccctgatgggaacaagtggaattgaatagcacagtggggacaaaagctgggctgctggaacgtttttaaaaaggtttaaaaaggagcattaggaaaccaaggaaaatgataatcttctgaaagcagtaattttaaccactgccttaatctgtgagggaaaggaaggcagagcctcgacccaaggcggtaaggaagacccatcctcagttttgcctttgggaatccttatcccaagtcctctgccagcccaaggatggcagagcataggtccccctcccatagaacgcctggggactttccagttgaccacatccctcctacagctactccctctgggcttccagagtttcccttcttcagggcagtgtgctgtgagcccagaacactacttctggaggtcatcaaggtcactgagacataacaatggacttattgtttgaagtagtcccaggtccttttctttgaagcttttgagagcaatcttctcagctctcccgctccactaggagaggacaaagtaaatattctgggtgggactcccaggcctcagacctactcaatgtggtcgggctagctcctgatggatgcattggttaaggtcagctgcctcttcttcctgctcctgagtggccacgggacttgggggtaagaaacccatgttggggagctgggttctgatcctggctctgccaaagcaagggcgaccatccccctagaggagcatccagaacttctataaaaacaaggccatcgtccttgtactcgtctgcctgggatgtgctgggctccattctcggaggtgtggacagagcagtgaataagagaccctgtccctgttctgggggactgacgttctagtggtaaaacagagaacaaacaaaataatctcaggagacagtgaacaacacggagaccacaagcaagtgctgtgtcagagggaggctggccaggggcactgccttttccaaagaagcccaggaaggcccagaggaagagatatttgaactgacacctgaatgatgaccaagtggcagtgaagaaaaggtctcaggaaagagcctctgtgtggagacgccacaggggaaatgcacagaggtggacctgagctggcaaatgtgagggaccaagaaggccagggcagctagaacacagtgacgacacacacgggggagggaatggagaacgggactgtacaccccacaggggagagcttggatttaattctgggtgtgatgggagaacagtgggattcaaatgactctctagaaatcatacaagagctgctgggctgtggatgatatgaggcaaggtgaggtgagcaggagacaggctgctgtgtcgtcccaggctgggactggagatggcatggtggagaggacaggaagcactggatatgggacacattggagagggagagttgactggatttgtacctgagtccaaagggggaatcaaggatatgctcctcttccttggccacagcaactgagcggacaatgaccccttttagttaggtgaggaggccttggtgtgcttcgactatattttcttttgttaaatttcacatggcaactagagacccaagtgaagacggagggtacctttcagtggtgacttgtcctggttatagatctgggtcatgagcagagagatggcatctgacggcatggggccagatgcagtctctcagagagaagaccactagagtgggggaggctgaggacagaggcttgcgggcctccaaacaccaagcagcctggcagagcaggagacagcgaagggatgaaggagcagagagatgaagagatcacaagctggggtcgaaaacacttagggaagcaagtttctaggaatcaaagctgtgtcacatgctgctgagatgccacccccaactggccactgatcttaactagaggcaggccacaaggccccttgatgagacccatttcaggcacctagtagaacagagcgccaaccaaggtgggtgggggagaaaccaggagaggaaaagtagagacagggagtcaagcagctggtcctgggaggtctgcagaaaagcagcataaaaggaagcagcagccagagaggaatgtggccacagaagggcttcacttagatgagatgtgtcaaggcacgtctgcatgcaggcaggaatgattctggaatgaggatgaaactgaccatggaggaaggaaaagaaaatcaatgactacagactcaacgtcctagagaagataaagggggcagctgcaaatggagtggtggccctgggaagatgtaaggatgtgttcccctgtttgggtgggaagacaggcaggtgagtgctgatggggaatggataaaacaggtggtagacacagcaggtggctctcattgagagcaggtcctgcctactaagcccaaggctacgacaccaggtgagaagttagaagggggaagaaaaggagtaacaagttgtctttttcatgaaagtagtgaataaattgggagtaggaaaatctcctgggagaaaaaaaatcaagggatagagagaggagacttacctttttcttactgatttataagagctctttatttaggatattgcaaatgtaaatattgcaaatattcttttgcagcttatcaacagtttaacatttgatttacagcattaattttcttcatggtcaaatccagcaatcttccactatgattttacctattgctttaatagttagggtttcattccttaatctgaggaccaattaattattcaactatatatttttctattcctcctacggtctgattttttattaacagattaatcaacctaaaaatatttcagtgtatgtgtattagtttgccatggctgccataacaaaatgccatgaactagatgacttaacagaaactcagtgtctcacagtttcgcagaacagaaatccatgatcaagatgcgagcaggtctgatcctcccgaggtctggagggagaacccacttctggcctctcctggaggttctggcggctgctggcatctttgtcattccttggcttacagaagcatcactgcaatctccacctttatctttatgtggcattctcgtcccgtgtctatttgtgtccaaatttccccttagaaaaggacaccagtcatattggctaaggagcccagcctactccagtacgacctcatcttgatgaatcacatctgcaacattatttccacataaagctacattctgaggaactggggctaggacttcaacttatgtattctgagggggacataattcaatccataacagtgtgcaataaggccctaattcagctgctcatccaaatagtttatagttgtcggagcacattaaattaaacaatgatgccacttttacaagattctaaccttgtatgtatttgactctcttgagtacatgcttcagtgcacagaactttcactctccattcttcaactcaaaccatgtggttttcatgacagtagctttataacatcaaagccactcttttgaagaaggtaatctgtcagcattgaaagaccaaatccaaatggtctcttctgtgtttccatccaacccaacctcttggcagggctggaccctgctgacgaccctcactggacgcccagccacacaggtcccactcagtctgttctaacctcttcatctcaggcttccatgtactgtccccacttggaagggccctgatctattctggaaattgtaggtagaattttggatttcaaattttcaaaaacctagatgtaaataatgtgtatttctagttccaaatcagggttctgactgattcagtggctgagacaatataaaactaaattaaaacaagaactccatctataaaagtaagtggaataccatctataataaaagaatatgagagcacacactgctagtattgcagacacccgttaagtacctgagacctggtgggctgggcagcaagcttctaggttcccatcagggccacggttatggcaggggcaaatctggttctctttagtctctatggcataaaagttgttcacctacagaacaacttcggtttctatagaagcaacctgtcctttattaggggaactccaaattacaccaaagagggtggacacagaataagagaagaacgccttccagggacttgggccactgaactgactgctaataaaagaacaaacaatgcctttgagggagatggccatacagcgtcaccagagaaagagacaagccacatgcaccaggtatgtgtccagagaccaggtcattccagagtgggaggagaaggattctgagacttccgctgcttgctaacaaccaagccctccgatcaaatacctgaaaatcttaatagcatgagattggtcaaagcagacaccacgcagacttcgctgagacggcagatttttctatcaaaatgtttctttttacccatccccttcgttttctttgcctcatcctttggcttattgcacaccaggtttagtttgactcagaattatcagcatggagataattcactcttgatcctccaatggcccagtcttctttggattcctgccctcaacaacacaattcactgtggtcagaattcacattcccaaagctgttcctagttatgctcttggtacctactagaatcttactggaatacaatgaagaatttttgtcccctctcatgtaactggttacaaaggaggtgagcaactgctgagtgcaatataccagggcccacttcacactcccccctgctggcctctgtgcccttcttcagctggccccagtacgatgaggagcaaggcatcttcctgggcacgggcagcaggcaggcaccgtcttcctaggcactgtcagccctaggccgtgggccccagtgcatgctccgagggaggactgtgtggtggggcagcaggaggtagccacagcaggaagagtctgtgctgtgctgcagcaccgcccatgaagccgggaacagccacagcatacataagggcttgcacaagaggagtacaactaatctcccacagcctccagacgctattgcactaaaagctgtttgtctcggccagccccacccgctgcaactgggacagccaagagagtgggggactcaggaagagatttcaggtctgacattttcatctcataggaaacagcacacaacaagtgcaggtgtgtgtacacacgtgcagcttaggctctgcacaactgccctgcatgtgttccaagccacaaccctccccaggcaggaagagccctcccagccctctgagttctcccacactcctccccttggaaattgccagagaccacttcagccgctggcctccccgggctggtgaaacgatgcatcgggaagagacttaagttttccttccacacgcttcaccactgttcacagggtccatgactagccacccctgccatcccccaggtggctacatgaagaagctacccaagtaaagttggtagatcaaaaagggacctctgaagtacaggctggaaggggctcacaatgataacaagatcttcctcttgaactgtaagtgattacagacactaatataaatccagctagaagtgtaaccatgcggctgtcactgtgcttgagaccatgaggtctttattcccttgtgttccgtcttctcgggaacctttcacagtatgctgaggctcaagggctgaaggctcaggaatcccccgccctcggatgacgtttatacacaaggaagctgagcatggaagagacaaccccctttgcacagtgtgttctgccaacagaattatgagtattccatggcttttggaaagaaggaaggaagcagcagcatgtccccagcttctcctgaagtgtggggaatgcctggggatgcctagggcaccacggggtcccagggaggtggctctgcgagtgtttcccatggccaacagcaccagctcagagcgtgccttgatcccgagttgtgaaaaaccagagacagatcagttgatggcaataaatattctcctgccttcaggtggccgctgccaagcctcacagagtcccaggcaagggcacctctgcagagcttgccctggtctggccttaacagacgaggttctggtcaacagggagaattactgtgggatgacctggtcagttctgttttctgtgaggtttctcctctagaaagagctcactgcagcatcagtgcatgttaagaggcacatttttgattctaagcaggggtttttctttgtttagcattttattttgaaataattttattttgaaataatttgtttagcatttttacaaaaaatgtgcaaaaagcaatacaaaaactctctgtatatattcttcaccttagtactccaaatattaacatttcaccccattcgctttatcaaattcccattctctttccctacctacctaggagagtgggttgcagacatctcgcccctttcctgctagatggctttgtgtatatttcctacaaacaagaacactcgcataactacagtacaatgatcaaaatcaggaaattaacactgatatactaccattagctaatttacagacctcatccaaatttagccaagtgtctgactcctgtccttttagaaaagggaaaaaaaacaaaaacaatgttgttcttggttcatgattcagtccaggacccaagctgcgtttgactgccttggctctttagttcctcagatttgggttttgtttttggcttttgtttctgtgggggtcttctatgacctcaaaacccgaggtcattctctagaatgtctcttggttctggttcagctgacgtccctttgagattagctgtagagatgctgtgtccccctgggtgccacagctcaggagccacacaatgctgccctgacccttttttggtgacatcagtgtggctcacctgggaagagtgtctgccaggtgtttccacacacgtaagttattattttcccctggcccttcatgctggctcctgtgtctttatgccatgtccccttcattctttaagcatctcccaggcagccctggctccttttattggagaatggtatctagaaatgacctgagcgttaggttgaacgtatatttaaagacagaggaaacacagaactgcaagttgtcttacagaccatgaaaactatgagaaatcaataaatcacatcttaccaattttacttagatgcactcagctgtccaacttcactccactgccctagtccagataacacgtcagcatctcctgcacctgcatcccaaccggctatcccacacctcctccagcccagtccatccttcacactgcagcaggcaaagcaaagtacaaagctgctttcccctctctgccagagacctcctttgccctggagaccaatctcttcctgggacacctaaggccctggcttcctaggcgctgcctcctctatactatctcagccaccatccagggtgcctgtgccttcctcaactgtcctcattccctctttctggaacactgtatgccttccaaggcacttaaggattcctcatcttcggccccactgatagctctccccacatgatggaatgtcctggcagcatgttggaaactgtctgtgataatgtgcctctataaggtgattagcattggtttctctcactgggttatgggctcccagagggcaaggctgtgtctgccctgccagcctcagaccccagcacccaggcagtacctgcatgtagaaaccacctaaaatctatcagtgaatgggcacaagagaggaacagaggacagtaagggcgttatttcctgactgtgtcctggtaggggaagttggaaccctgaggagacaggcgcgggctgagcgcagagtgtgagatgtgcacacatgtgaggggtttagacaagcagacccaaggtccttgcttgctatcggtcactctgatcctccgtcccagggcgatcctgtggacttgagaccatgtcagggaggcagcggcagtgagctgtgctgcacagctgaaaaagacaggatgtgtaactactggaacaatacatgctggagatctctaagctcataaggtcagagacccgatgtggtgactatgcagtagcctatgcaaacgccactagactctcttcttccttcatccctgtcactgcagggccacacaggcctgacttgtcataaaattactatacacccagaaatagccacggaaaagccagagggcttgctaaggtgtctgcggtattctgaagacacaaatcctggagtccctgcaaacagctgctgaccacctgggacacagagttccacccctgctggggaaggcaggcttccaaagccaccgtgtgctaccatgcggtgcctctgagccactctctcattagggagaatgcagaggtggagaaaggctccaggaatggggtcagggctcggaagtcccgaaactcactctatcccggatgtggtaatcaacataagcaggtctttgcagacagatatagcaacacacatcctgagctataaaacatcctcaaccttttagtaggaatctgacttctagggtctaccctggggaaaggattcaaaatgtggcaacagctgcactccaggcacccagtgaagcatcatttatagcacagacactggacgacaatgcaaattatctggtcactgtgaagtaggtaaatatggcacaaatcggtactcatcaatgtaggtatcagctatcatgagtgttttttaggaagaccacactaagaaacacagaaaatacttatgagatgttaaataactgaaaacatatctaaaattatatccacctttactaaaacctgataaaatgccgaggggccaggaactcgaccaaactctgggcagatggaaagagctgactttgtttttaatactgttacaatactgtttttgtgccagttcaatggtcagagtcaaaagggcagtcacacttaggctccaaggttaaatgaagaagaaagcaatgttgcttcccacttcctcgagtgtctgtgatgttcccgcggctcctggcatggcaacactgcttctcattcccttccaggattctgcagagagaccagggactgtgtgagcggaaacactacccgtgaacaaaaagagaggaatgtgcgccggtacatggtgttcccatttaaatcttttcggggatttcctcatataaataaatctgaagatgccagggttctataaatagggctagaaactactgccctgattctagagaatctctgttgtaagatgacagcgaagatgctattttagggcaaagtaaaagataaaccatgttagtcattagcatttggttctctcagggaccaaaaaataaaaatcaccagcagagggtatgtacttgtaaaccttcccacacagggactatgtctgtgctctctttcctagaaatgtccagacttggcaccaacagcagagggaggatgtttaccaaattctcttgtgaattttttggattttcaaaacactttcacttggtttcctccactaattcttttttttttcttttttacatttttattactcaaactacttgtccttcagccagttaagagactgaggcgagagcctaaggaaagaaaaacagaaaagacatggaggaaaagagatggccattgtccaggcagtggcctagatggcccatctcatcttgggtctcaaccaagacccagaggcctaacacttctcgactgtaaactctagaacactttatcctaaactgggtggacctgccacatgcgcctattgcaggagaaaagaaaagtccctccgtggctgctcacaggtataaataaagcgccaatgtccacgttcagtgagtgtaacaggcttctccagtgggtgaactgtggattcctactcaaaaccaaacacaaaccagcaggctgtttgctcgcagtcatttatggcagaagctgtcaggtaggtaaattggggaaagtgcattgtctagtggttcccccttacctgatgaaatttcgagtcaaagcagcagcaagaattagcaaatcagtttgccaaggaaaattacttcctgttgctagcaaaataggcggtctctgtgaaagcactgatggccaccgataaccaatgactgcacactgcccttgcctttgagtccacaggagcctcacgtagatggccacaggtgggcaaggcacagacttagatttttggcaaaactatggtgattcttcctgtgaaagacgtatataatttaagtgctcacatttccaatgctcttgacagctatagatatcaagaggtattcaatgctacagtaaaatatctgttttaggcccctcaaattcagaggtttatattttaaaagatatttgtactccggagaaacactagtagttgggatttcacataagattcctgcactgatttcctgtgtcatatttagccaaacaagtggtctgctccaggtcacgactgcctcgctgcaattgcatcacttgctctgatgcaaacacgggaacatgcaggtgccgtcacgtcgggccttcgggattattctcagactgcaggggctgcggtccctagagagctgtgagagacctccgctttagcaaagctgccagaaaagtctaaaaaagtgaggatgacattcaccattttaaaaataatcatgggcaatttagcaccctttcccaaagtgcgttctgtgtaaagtttacaggtgctgtctctaaagcacttctgtgatcacaaatgtttcagatgctctagcttagcttgagtgaataggtaggttttctttttctgtaagatttttcagatcctctaaaatcaaacgggaaatgtagaattgccaagaaaacgatagacgatgccaaatttcccaaacttactgaacctgcatggctttttccccctcaggacaactcaggtaactggcattctagaaaatgagaggtaaaaaacgtgaagagatctcagtcacctcagcaacgccagaggaagactgaaacccagaaagctagaccctactcaaaccacggagagctgagggagcctagccaagcccccctttgaaaaaaacatgtcctggccaccctgctgttaaagccttggctcaaatgcaatgctcacagtcaccgaggacacccgaacctgccaacgctcaaggctggacgcagggctgctcccaggtcgctctgggtcctgcacctatctcccatgctgagctaagcagctgtgcaatagtgtgtgtgcccacgtctcttctccgggtagcccaagtcttggaaggcagacagtagagcaaactcatctctgtctagagcctgtccaggacagcccctcacctagaggagcatattacaggaccataaggttagaacatccatccttcagtggtggccacgccggagggcataaatgatggtgagcaatgcaatgggatctgctacatgtgtgggttttgcttgcacggtttcagggattcacgcgtcccctcataagtaattgaatgacaagttgagagttcacttaggcgtactgaaatgcatttctgtcgtctggggcactgctgtggcacactgagaagacagctagaagctcgggtcctgagtctaaacccactttttgtgatgtatttgtcaatgaccttggaagatgactttatcctccctgggcctcaggttccttaagagcacatgtctcgtggtcactcctgatgaaggcagtgatcacgtggcaaaggggtggggcacagtagtggtgccgcgttcatgcagtaaaggggcatgggggcacagctgcggtgccgtgttcacgtgggaagtagggggtgcagccatcatgccgcgtccacaggggaagtggcagggaggcgcaactgcggtgccgcattcaaatgggaagtgggggtgcagccatcatgccacaaccacagaagtggggggtgcagccgtggtgctgcattcatgcaggaagggaggtagggcacagccatggagccatgtccatgcaggaagtggggtggagtggacgtcctgccacgttcacacggcaagaggggaggcagccgtggtgcagatttgactgtcctgagctccaagacacagagacatcagcagggccccgcctcctcagacagagcaggaaatggaagtttccagagatgctgccacacatcagcgctggagctgggttctgccccagcaccttccaagtgccgtgggcaggagctccccctccacaccgtggcctctcggtgcagacgggaaatggttacaggcaggtggcttccgttgggagacaggagccacgcagtagcagaaggaaaggagttagagatgcaggtgtgaggggggccgaggacagaggattttaacttgaaaatggcgggatgagttgaagtgcacctcatgctgactcttgcgtgcgtgaagccacaagggaccatcctgtgatggcgcagcatcttatccatcccgccagggccaaggccctgggggctgcagacccaacccactgcagccagcacccctcagggtccccagcactcagggtaaactgcagttaggctcaggccccaatgtcttctgatctccaaaggcaccagaaaaggtgacacgggcagactgtggaggtgctaagagtaacagggcttgccagcgggtggaaggggctaaaggatggaggaagtccatcctcagcaaggcccaccagcaaactgctcgggacaggcccagttgcagacacacatttgcaggagagagcattctctccgtgcaatacattctgtgaaacaacctgcactgggaggccaggactagtttttctcagcaaagatggtctaacatattgcatgcagttaaagcctcaggagacctaattttgatcattagtaaataattgtatgcacaaacccttatccaaagtgattactgtggttccagaaaattaatttttaaaattaagcagagggagaagagctgattggagctaagacaagatttatgtcctattactaacagggttaaactatgtgactaattgtgtttgaataacaaatggaaaaatgtgctctaaaaactcattatgtagctgcacgagaatctttattggctgaaggaaagtgtggcctgtcaaagtgcccactgagcttgtcttaagttcataaataaacaagttcctaatagcattactatactttttcttcaccggcactcttctctagggtgcccctggggacaccccgccctcttgtctcagcacctctgcacatttactgtaggagtcagttctctgcctgctcttggtttctgcttcttcaacatgtgaatctgttcttggcatcacacaccacaaccaactcactggggcctgtggggtcagtgcgccccacatgttgcctcagttgcccttgccaccacttcacatttctgcatacctggcttacccacccgtatatggaacagctgcttctgggtgacaagcccaactctggtctcaccagctgccgttgtggagagaggacaagtgccgtgacacaggacgaggctgtggtggctgctgtctccggccctagacttcctgttctgcaaaagcaactctccttacaatagagaccagacagatttggttttatttcttgcagccaaaggcatcctgaaagcaggtgaagcacagtgtcccacgcttgccaggagaaggactccccacatctcagcagctggtgttactactgtcattacctgcaatgttgtggagttggagtctggccccatgcccaggtgccttgaccttctcagttgaagaccaagcccctggcagtcccaggctggtgcatggcaggaggggcagcttcctggcagtggaggtgctgtccttaaaagcccctgggcctccttttcagagaggtcttcctctccgatggtcatgacccaggatgtgcgaggcacaatcaggaaaccgaggctccctgataagtggaatgaaagtctgccaatacctccaagaaatgaagggttattcagaattggatgctaagctcctccactgcctgcacaaatccatctcctttcagcagcaaatgccagtgtgtgctgcatttggggggtgatgcttcagccccaggcaggaggggggacagactcagagtgtcttctccaaactcagcagagtgctgacctcagaggtctgggaggggcaggaagaagactaaggctttgggctcatctagattgagtacaatttcctgcctgtacctctagttggctgtgtgactccagccaaagtatttcaccttgtggagcttcaggaccttggtttcaccatatgaaaatagtctctcccttgcagcatgtggaagtgctgtgaaaattaaatgtgtagtaaccaccaacggatgctaaaaaacaggaaaattaagattctacctgatagaatctcttagaacccaaatgtgagtcttggtctaacatcacctgattcatctgaagcctcttccttgtccatctggaatgcagagaagctattccttatgctttcaggtgatgctcttacagacacctgagctagactctcaagggaatctacttcaacctttaccaattttgcaaattctcttccataacatagattcatttgttgattcattacattttcagttatcccttgacttaaaacatttctttcaaaggcccactcgctgtccctgctccacgggtgaggatgacagggaagagggcccagggtgcatcctcagagctgacatggagataaagccagcacagcctgggaagggcaaggccactcctgctgcagagtgagatgctgctgggacattccagtgacaggaagtgggaccccaggcagccccctccctggggatgctgacaggtgaagggaccttcccccacaaggagtaggtggcacctccctgtacctctctggcccttgttccagcctctggacccagagagtaggaggcatccctcccatgtgtgtgctgtaggaaatagccacaagtgccccaaatgatccttaaccacttcccattttctcctttgcctcctgccacagcctctcaccatcgagtccctccacttgggatgagtgccatgtgactagggtccttctcacagggataatggcatccaagaaagaacacaacaaagccactagcttctagaaaacctatttctgtcagagcagaatggtcaagccagccactcaggaaaggtcatactggactgctgactggagccacgtgtctaactaactgagcccttctctcacaagcagcagtggctgcagctgccatcctcttggtgatacttttgtagctgcatgtgcagacatcattttgaaagcctatttaatgtaatcctttttagattcgggccatcatcccagcttgctgagcccttagtggacgccagatccagtgcccatcagggaaagcccctggcatgccaggtgcagggagacaatgcagacaccataggagtcacctcgcaggatgccacagccgaaaccagcaggccaggacctgcctgccagggtgtctgcttcagcccacacagtgcttacagacactgaaatgtgcaaaatgtggagagttcaggtcttcagtggcaattctgatttctctcaaagcatccaattttctggtgacactggtcccatgctcctgctggccatgctcggctgatgggcggtggctgtggacacagggcccctcttccctagcgtggacaccgacgctcagtcttgcctcgaggagctacttctgccctgacttctgatgtcgctgagctgacaccctcctcacacagcaaacagccaggatcagaatgcaggaaccgagaaggcctttgggacagcccccctacagggtatcgtacccaccagcctgaacagtcaaatgtacctatacacatggctcccctcagcctctcagagccttctgaacttcacccagcacctgcaggaagaaaatggcaccccactcacctttctctcctctcccaggaccttaaagaagtacagcagagggagacagtcaccaggccgtggcggggggccagcccacctgccagggtcctctgcagtgtgtctgtgggggcaggggggacagctctggtatttacccaggattgtctggcacctggcccaagtcccaggtctcggagcacatccttctgtggtgcccctccctcccgacacccgaggccagctccaggcacactgcatggcgcttcctcaactcagaaggccccggagggtctgacgcaaaggaggaccactgcagccagtgtctgccagggcaccaagatcaaaggcagcctcaccacagagacccagtggcaccaactagaccgtgagcccagcctctccggccggagcatggtgcttggcctcagggctcacaagtctttgctatatcaatcacccttaccacaacagcctgtcttttcaaatgagtcacaaagcagttaaaaataccctgttgatttttaccacaaatatccagtttcctgaacaatgactaatttaatttcaccaccttttagaggaaagaaattaaacactcagaaagaaattcttatgtatttgtatttttggtaagtcaatgacgaggtattattaaacttaaataaatcaaaccactgaataaaattaaatgccatttaataaatgatggaatcatctccacagaagctataccttccaatgaaagtcactcactgctgacaaggaggactgctgtcacctctaacagacactatgtaaaaccatacatcacggttcctctatgcactctcccagagcaaagggggatgtctgctctaacatcagtttttgccttccgtgagggaataggtctgtgtgctctctcactttaatggtgaagccatagagtacaacctcaggtaaacgcaagaccaatagactctggcttaaatattaacaagccaaaacattgctgttttaaaattcatcatcaacaacaaaataaaacagaaagcccaagaagtctagaaagacaactccaaaacatctcacactatttatgagcacccaaacaccagtgagggcccatgagccagtggcagaggtgcgtggaagtgcctgggtttactggctccagatttccatgcttccaccaagggtctgaccggcccaggtttggaacccataacacgttggacaaactgctctcagggctccccctggccaaatgctgagcagctgcagggcgggtgccaccccacgtgggggtagcaacgagcctgggtgggaccagggaggtgagaccgaccctgcactgcttctgtagaagcacctgggcaggaccccagacccagaagaggaagcagagcctgggcagggtgaggaagttgaatccagggcaggtgaaggacagccaggcaggaaggaatgagtgggctgtcagacggtgacatcccagcacgtggatctccgatcagaagtagccccctttgcgccggtgtacgtctcccccacagctggaggatcacaggtttgaaactcagctattcccgccaacccagatgactcaggcaagccccatgggtacccttagcaaactcagcacagcactcaggaagaacctggccaatgcagggtcacgaagccagggtgcagtcatcgtggaagaacttggtaagcctgcctggggctgctgcatgctctgggatccccagggagaggacgcaaggcagctggggaagacctccctgtccttctagatagaataatggctgctctcttttggcacatgcctgccacgtcttagactaccaactactccatcctgcttcctctcagatagctcttcactctgtcaccatcgtgctaagctcacgagagcagggcccactttgcggtcaacctcttggtctcagggtctggcaaaacacccggcccgttgtaggggctcaaggtgagcgaaggcagagagctcagagggaggcggcattggaggaatcgcgtgctgttgaataggaggctgagggctcttctctacccatgactactcccatgcagaattttccctcccctccttcctttcatcaagtcccattggcccgtagcctttacagggcactgagcttgtatcttacatgtctagaaaggagacacaccagagctgcaggtggaactcagatccgtgagggcccacaaatgctgcagtgagaccactgccactctcccaccctgtcccagcacgcgggccagggggctcagcatgctgtgaggagcgccaggtccacatcatggtagttgcttgctctcagacctggggtctctggacaccagcatctgatctcttatcacattacggagctaccaaggagtcacttaaaaaggagagaggcagggccaggcgcagtggctcacatctgtaatcccagcactttgggaggccgaggtgggcggatcacaaggacaggagatcgagaccatcctggctaacacggtgaaaccccgtctctactaaaaatacaaaaaattagccgggcgtggtggcgggcgcctgtagtcccagctactcaggaggctgaggcaggagactggcgtgaacccaggaggcagagcttgcagtgagccgagattgcgccactgcactccagcagcctgggcgacagagcgagactctgtctcaaaaaaaaaaaaaaaaaaaggagagaggcagaagaaaggtactaatgcctgtgtgggaatttcagaaggctttgcctacaaagcttgggcaagaatgatttttcctttctcatggaagtttaaatatctctactttttcctcccgttgccttcttcatgaatctgctatttaatagtgaacataatgacatgaatgaggaagtttccaatcacctcactatcccattaccttccatagatttcgttatgctttcttcttttcctacgttaactgagttcttccctgtgagcaaagccactttatgtatcgggtccactttgtcaatttttctactacttcagaatccttgactagaccttggtctcagcattacttcctctgacttgaatgaagggaagaagaacatcagatttctcttttcctcaagcaaggggcaaggaatggagccaaagctctttgcccagcaccatcccccaccgtgatcctagatccaaagccctgggaagtggctggaggttgtccagcacttgctaccgactgcactgagaaaacacacttttcatgagatcagaagtcaacaccaagtacagataaagaaatatcccttcaagcaagtcgggaaaaaaaaaaaaagaacaaagaacaaggactttctacaagtagttctagttctgagtgagaaacatccttcctggtcgtttctgtgggcttgaggacacgagtgacacagacaccaatgccacgttctcatggggaacaagctctgatcccaagaaaaacaccagcaggcaaaattccccggtttccttgttctgcttacaaatttggacaatccctgggggtggaggccaattttcttgccaaaggctgagagagccagataatattttcatggtcttattttagaatgggtagctctgtaaacaacctcagtgacaaaacccacagacagcttgtctggatccttatttgaagcagaaggtcaccagcgaggtagacatcccagatgcactttagacatgtgacaaagtgcacaagcccagccagtgctggctcccagatgagggacacttacctcaccttctaagttttgatagtgccataatgcagcctgctccgggggcctgaggtcagaacgggacccacacttgggagccagcgggtattggaaaaaggtctctctctcaagaggacagaccttgcatggcacaggacaggcagatttgcagagaaagggatggctggcctgtcttgcttgagaacagcaaaggtagggaagtgagagcaagtagggagaagagatgattcaagtagaagggcaaaatgacttctaaatatgcatttagcagaaggaaagtcaaagtcccgggaagccaatcagcacagtggctgcaatcacaggctccgattctgaggccgggtcacactcagccgcaccatcaggtctcagccacactcagctcagctgcttacaggggcctcccttccctcaactgtggaacagagggaacatgcgtacttaattcatacgggatggcatgaggagtaaatgaacatataaataaacaaaaaataaacatatccaccacttacgacaaggcctggcacacagaaatccctcactccataaacatcagatggcgcagttgttctaatgatcacctccacccctaggggtcttcctccagaggctgcagcccatcctggctcacagccctgccaaccggtggggaggaactttcaacccctttctctgccagtttctctgctaagctgacttgttggctgtttgaccttggacacattactgaaatgctctgtgcctcagtttcctcatatggggacaatggttgtgtcctatctacttcatggatctactttaagtagaaactacaagttcaaaaaggaggttattgccctgcgggtccaatggaaactcttctgctttcggcagatcatattcaaagtcaggactacaagacagaaactcttcaactcctgtgtactgacatccaggtgcccgggtgagcccagcattttcacacctattattgagccagtggtgaaactttttcaaagaactaagattcatctttaaacatcaaatcattgttattatttgccattttttatgagactttttctaaaatataaagataaaacagagttttgatcaataatgaaaagaggtttaattggttcatggttctgcagcctgtacaagaatcatggtgcgggcatgtgctcggcttctgatgaggacttaggagcttacaatcatgccagaaggcaaagcaggaactggcgtctcgcacagcaggagtgggagcaaggggaggagatgacacgcacttttaaacaaccagatctcgtgagaacttactattgtgaggacagcaccaagccatgaggaatctacccctaagatccaatcacctcccaccaggccctgcctccaaaattggggattacaattccacatgggatttggaggggacaacatccaaactgtatcggcctcataggacaacaagtactgtgacaacaagaaaagaactgagagagaagatcccaggacttcccgcccttcttcccaaagtaataatctggcacatctgtgcagatcccaataatctggcatatccctcagcctgggctccagccaggggcacactcacctgctttgcggcggcctggctcggaggtaaagaacccggcgtgagcacaggggggctcccagggccacagagttcaggaaaaggattggggatggccggcagagatgaggttctaaactgctggtcttcctcctgaaggcgcctggaaggcagggataagtgcctgttaaaagctgccattccccacatgacccagccttaccactgtggtgatacacccagaaagcaggacacagggcttctaggagtcactggcatgcccacgttcacagtggcatccttcacaaaagccaaaaagtagaggcatcccaagggtctgcagatggatgaatggatgaacaatatgtggcatatccataccatggaacactactcagccatgaaaaaggaagcacattctgacacaggctacgacacggatgaaccctgaagacattatgcagagtcaaacacaccagtcacaaaaccagagacactgtgtgatttcacccagtgaggtaggtagtgtattcaaacccatagaaaatagaagggtggctgccaggggactaaggggagggcaatggggaatcgctgtttattggggacagagtttcagtttcataagatgagaaagttctggagattgtacaaccattgtgagtgtgcattaatactaccgaactgtaccctgaaaaaaacagttaatatggtaaattttatgttacatgtattttactaaaacgaaaactttaaaaaaattacaagttgtcattctcagacccaaagggtattgggtatcaattctcttcttcattaggcatcgggggcggggggcggggtgccgaagttttgttgtcctgggtgcgtgctcatctcaggcagcattcagtgcctgacatggcatcagctccaaatacctcatccgtttgatcagtgaatacctgatgtgtgaaagttttctgaatatgagcattttcatgagaaccaagtgtttttcaatgtccttgaaatgagcattaatctaatcaaatgaaaatacaagaaaaggctgtgtgttctcatctgaattatgcaatggatggttacttatataaaaaggttgttgacactgaattaactggaaattatagcttcatgtatctgtcctcgcaaagcctgtgtccacattagaaacacaccttggaaacacacgctgaatccacacaccacctctactttcctggcacatctccaggggcatctgttccctcctccgaaaaatgcacaacccacttgtcacacaactatgcaacacacacacagtatgacgaatcagaagcaactgtgaacagcagagaaatcaagttcaaagtcaaagcgaatgtcaagtgtctggcacctcccctctgtagagtaacttctggcccacacctccagggcactcctggacacacagcctcctccacccttcctgaggccacgcggccctgtctgcagcctcctaccttcaaggagaggggagcaaacctcacattatcttcactcggcatttccaatccctccccatgtttaaacatacctcagaaacccccatcataggctgtgtcctcaagtaatttttttgacaatttttacgatttcacaaaatcaacaatccgttagctttcccaggagatttgccactacagaaacacattttgtgactgtattactttttctcttttaccaactttccctattttttaaaggaagatccagctaactatcccacgtagaccagcaaatgatgcatggatttaaaattacgagaactcacatggcatgaagggaatcagtgctgcgaaatacaggaaagccgttcctataatggtttgatgacatgccataaagtttatttttactgtgaacaaatcccactcttcccataacagcttcagccttggcaaggcgtccaactgaaacgtctggccattgtcatacaggaggagatggataaaacgggtggccagtgccactttcccatccacggcttctagccagtgacttcaccccaaaaagataatctgacgttttagtgtccacaaaagcttctctatttattgggttgttttgagcattttaaaaagtcctgtgttgactttaaagcggctcagagacatcgcctaaggcaagactaagggatatcacacaaagacaaaaaatccccaccaaagaggctcacaatagaagggacagtgactatggagaggggtgctgagatttagggatgtcagggatggtggcaggaactgcagagctgaggggcgaggtccttcttctctgtgccttggctcacttgtgtttgtctagaacacatgcgtggcccttgcactctcaaaagcctgggttccttctctgtacagaatcggctcacccatcggctttcctatgtgcaaagccttcttgcccttcccaagtgtctcctctgcccataccctgcctgccccccagctcccttcgggttgcatggcagcccccggtaagttcctctgcagcgtggaccatgctccgtgacctctggtacccagcagcctgctccatggccacttcccacctgatgtggtgagcccagttaccgccccgctgtgccacggtttcctcagctgggaagcgagggtaacccacactgcctccctccgagggcactgataacaaggaggagctcatcagcatctgcacacagtaagcactcagcaaatggcctcacttcacaaaataatctttggtgattccagattgatctccacatttttttttaatccacctgaaagtaagaaacaaaactacttatctgagaggacaccagagagaagacattgggcccaaggaacagcacctgtgaccctgtagggagagggctttgctgtcccacagagcaagcctgcccctccatcccagggacttagcgcaggtagtcccggggcacatatgggcgagttcagccagaactcgaggttcaagggtcctgggcaactactccagcagggaggcaggccttctggctttccagcccaccctcgggcaccttcgccatgcaactgcacctccatattcccaggcactccccaaggctactgtgatgctcccaagagatgctcccaagagaaaaacagctctcccaccagacttaactcctcaggagctaagtacaaggggtcacgcttcaaagagcaaagttgaacaaaccctgggacaggcatcattcagcatcaatgaatatgacaaaaagtgagaagtcggaggggaagccggggtgggaagctggggaggcagctgaccacgggcgccagggccgctgcaccctctcccctccgtaagaaacagctgccacctggggcaaggtgattatctgggctgcggaagacccaagatgtcagaccacaaagaaaactctcagaagtttctagaagcaagaagagcccaggaaatgaacagagctccccggaagatggggtgctgagacagaaggcaccagaaccccatcctgacagaggccagtgagggcaaggggcagtcccagcagagatggctgtacatcctccgcaaaggcccagagaggcacgcagggtcccacggagccccacgccatcccgactgcgacagggcagacaggcggatccttgagggctgcccctggctctcagcttgattctacaaagatcttcattcagaatgtctaaggtactctcagcaccttcaccttcgacatgaccattctctagacaccctcctcccaggcactcgagacaaaatccaagtcaccctccacacactctctgtctcctcacagccctggcaaaattcaagtgctggcaaaacgcagctgctcctcctcagcaacgtgctcaaatcccccctccttcttcatcctcaggcagcgcacaatcatctcccatccgggggctcctgagaccacttccaaaccggccatgctctgccaaccctgctgccctctaccactgcccccacgacccctggcaaccagaatgctggtgtcaaaacccaaacccagccccttcacacgcctgtccagaactctttctcacgtggctcctgaaaaaggcacacaaagtgcttcagcaccggcccccatctgcatcatctcttctgctcacaaaacctctgcctccatctatctgagctcctatcaccctttgacatccgttcagaaatcctacctcccaggaacctccctcaacgtccccagcacgttcctccctccagcctccctgtttccacagagatgtgcctacccctgaattagcagaggaatgtggcaaaatgcaactctgagggaggtctggggttgcacgacaagctccagggggtgctgtagctgctagcctcccgtccctactctgggtagtgaggacttggggcatgcaatcagctccatggctgttcttccaatctttccagagatttttcctctggtggttttcctgcatatccctctacctagcacagtgccttgcacatagcaggcactcaataaaaggtactactggaattgaactggctacaaagttcaacccaagggcggcacactgcacacactcagtgtatccgttatcccatcaaagcaatgtatctgcctcttgactttgcaagaccaacactattccccccaacaccatttaactcacagagagcagtgtccctgccgacagctctcatccttggagaaggctctgcccataaggcctggacctacctgacagcgaggatgtgcacaggctgggagcgctgcaccctctgcctcggggacacctgtggctggatggaccgaggagggcctgaagcccgaggctggctgcgggcatgctggccattctgcaggaggggcaccgtgtctgactgcatgctgcaggccgagtacaggctctccagggatgcattcatatcgttcaccagggcttccaggtccacatcatcctctgcacagaaaaaggcaagagcaaaaaagaaactttaacaatggagagcaatcaaacccaaatgtacatcttggtgatcaggttccaaacctcaatcctatttttcaaatattatggaaggggtagaggggaaacaccaagacaagtatgactgtatggaagcatgcatattacatgtattcatcatgactgacattccagagacaattcaatcattagagctgggctgcatttctacctgtctccagggagaagccattcagagcatctgctcagctcccttcagcacccccttctctcctccccaccccctccggtaggccgcacacagccacagctgcatagcacgaccccactggcctggactcagctgactgaatcacaggtgtctcccaggatcaggactctcccttccctgggattccagaagtgaaacaagagacagaaacagagcagcacccaacactgacactggttccagcccagaaaggttaagtaggggctgacactgtggcaggggtttgtgtgtggctgctactacaacacatgcctgagggcttcgggtgcccacccatcctctcgattggccagagtgcagaaggaagcccatcttcacagaggaaggcatggggcagatgcagagagagaagccacaatggcacagagagtaagtgagagagagagcggcggaaaacgcactgtagaaagggaggaatgagcacgcagagacagtgatggttggttttatgtgccaacttggctgggccatggtgccaggttttagctaaacactagactagatgctgtgaaagtattttttagatgtaattaacatttaaaccacagactttgagtaaagcagattgttctctctcatgtgagagtgcctcagcccatcacctgaagacctgaatagaagaaaaagaccggcctccaaggggaaagatggaattctgcctccagacctgagctgcaacccttccctggatgtccagcctgccagcctgccctgcagattttggacttgctagcctccacagtgtcatgagccaattcctaaaacacatgtgtctctctctgtatacagcctatttaatgggtctgtttctccagagaaacagagacctagggctacaacccagcacatggagatggggaggggttggggtgggacggggaaagggagccaggagctagggctgtgcagcttccggtgcttcctaaggcctggctgcactcctgctcagggaagattggtaaaacattcttgcatccatacaataattttgttgttgttgtgcttaagctaatttgagtgagttttgtacgtgtaacccaatacattctaataatattgactcctttcttctgcatttttagatttttcgctttttgacatcatggcaaataatgatggaagctcacataattcgtcctctcttctgctcccagaatagctgcaagttacacccacttaacacacagggtcacagacagcaagaccctcttcctaccaaaggctacattggtaggaaggaaagcagagaccggcacttgcaaacttgctcaccctgccctgctcctagtagctctgggcccagggcccaggacgtgggcttcctatttcttaagagtcctcaactctaacatgagcttagcaatagtgtccaccccaccgggggggggggggggttgtaaggactaggttagttattatctgctttataacacagcttggcacacagtaaacaggaagatgttatttattagccctatttcatctatttcttacaaaataacaaaaagtgatcgttattaacctggcttaacagctgaggaaataggcctggaagaattaaatcacctgcccaaggtcacataagcggtattgaaaataagctttgcatccctcattctctcctaccaggtgtgtgctcctcacagaagcttcagaggggcactctgccctctggttaggaaggcctttgttttaaagggctcccctcatctctcaaggctaaagggcataacaagacaagacataaggaaacaaaacaacaacaatgagggagggaagtcctgggcaaccacggtagtgcagagggggtatggagtgggcagggtcacccccgggggtagtgcttgggcttctggagtgggtgggacagtaggagcagggtttagccagatcacgctcaagatcctggtgaagacagacagatagaagggaggggtgaggacagaagggaggctgctgaaatggcagcgatgagatcactgaggcctggccagcacagcccttgctggaagaacagaggccacattcaaaccagggccaggggagagggcaggggctggggagcatcaggctggaagaggaaggttgccttagaaaaacaggggtcagatggatccgaagatgcggactgggtgaaatcagcagctgagacgcagcaagcagggccctgtgtgcccaggatctgtgtggaaggagggaagaagagagatgttgccatggttcaggttgtgagtggtcaaatattaatcctggccagatattaaaaggacaaagtgctgaatcaataattaataattactgcataatcaataattaatcacaaggaagaacactcagagtcagcaggcgaactcttgctcatagctggggtgaggtggggtggggaagagttggttggcaaaaaatcaggacccctggaggggcaggcatgtacctgcctgagctacccgaggcccagaaggcttgtggcctcagggagaggagagcctcactgccaactgctggagcgaaaattgcagtccagagaactctgcctgccaaagacaagacctcagttctgtatttattgagactgctgcatccatcttgaggaaaagttatagtggagaccacgaatctggggcttcaggaaagttctagaacgtatgcatcacgcacccactcatctcctacactcctatttagctgacagggaatagctgcttaattgaagctctgcaaaacaattagcacgagcgccactcttaacttaccgtattaacagctcaatatttctatctcagtgggccatctaaaagtcaatactggccaaaacacaaagttcactgttaagtatagtcagtcttgggtgatgcaggttggtctcaatgccacacacgtgcacacgtgcgaacatgtccacacacatgcacacacttgcacacacatacacgtgtgctgtggggccactctgccaattcaatgccaggcttttaatcctgctttggaaataaaaacagtggtacagttcctactctgagactgttctcttctaggaaaataacatgttttcattccctctggggaattttcatgtgcagttatttctctctatgcattcctaacagccccttggctgtgctccccaggcaagcagcccccggggtctcctgtccttttcctgctaagccttctgtcagtcaaccagatcattcctgggtcatagctctgcaattaggtcaaatgcaaagtaattctgtcattattcaaagtaaatataaggtaacagatgccaaaatataaacacaacacatatcctcaaaatgcttttactctcctctgaggtggattatttgtacaactattttctactttaatacattcaatcatgaatattttcaacaaagccaggtcaatctggtaactcaataggttataatcttcataaactgaatccaaccactctatctggatgtttcaaaccttcatactttccagagccattacagcaaaaataaaactttttagaaattttaaatgccatactttagaaacaactgtaaaatgtcctgtggggttcattagcattttatctgtttagataataaaatcaattatggttctctgacttgtaagcttcactaaattctaacgaagagcgacagttaaatcttccaaacaggggttttaaaggtttgattcaaaagaagacaatttttcatattctacaccattttttttttaattactacattaagatacgactgaaatcacactgagttcttacaagcatccctatggcgtttattctgtcagctggtctacctcagtaaggactctgtgtgccacctctgtgggtgtggtcaactgcaaaattcttgtctggtcccatgaatccaagtggatcaataatcacccatttgtgaaaggccttctgccacgtaacagaagtgggagaaacaagtaaacaaatgcttctcgcagtgaatattcagattgtctatttaatgttaacttgacgccaaaatattttccatggggctgccccactgggaggaatagtgaaaggtgaagaaaaaaataattttatatataaaatttcacttcagacggatttataagaatgtattttctgcacaaatataggtcaaacaacatggctgtcaatcatgttattaatagttattttccttctttaaataacccagtccaaaactgggtattaactttgccccaaatatttgagtagcttgtctgatctcaaattcacatctcatctagtttcactgtcattagcaaactgaggctggcttagttttaaaatagatataaactcagcgaaacacatttgcatcgggcttataaatcatcacgagtaaatgtcttccatgcagcaggctaggtgtgctgactaggaaaaggcaaagaggacagagaaactccggggacagaggatttaacttctagcaccatctcaccaccttcaccaatacatttcttagtttacagcaccatctagtgtcttctttacattgtttagggattaaagatgacactggattcactttactaaatgatttggcaacataaggacatgttatttgcaccatgtgtttaggacgtgtccattacgatcccttcttcacagacctacacaagcttccatcagtgtgcgatgccttcagagctttctccactacccccttcccccattttcatatggaagatataccctgttaagtcataaacagctggggtgggggtatatcattaagtcaaagcagattcagtccctaagaaacagataaatggcactttacatgaaaagtctctaacacatgtgcaaaagccaaagtccttacacatttctatctagaaaagaagtgaaggtcaggctgcaaaagtgttttccactagaccatgttcacttggcaagcaatttctgttaacttctaaccaattaaaactttgtgcaaatataacttaaccttctactgaaacagctttctgaacaacaatttatcttctattctcatgtattctagtcacatgcacttaatttcccatatatagagtttggacataagtaagtagaataagaaaaccaggtattatatggttagagtattcttctctatcatatttatggtatttaaagatattcagcaaacacaaaagcaaaccacctaaccacaactccaaataaaaatacaaatggaatcaatgctttatttcacgggttcctacacacaggcaggatttgaggcagaaaataaaatccctagaattagtctgtccagcaaatgcatataaatatccttgtacctagaaagagctacacagtcataactcttggctttcagtgtttataagagaaacttccttctcccaacctttgttgaaaatggcatcctctcctctctacccagctcacaaaagacaaggggaaccaccattttcagtctctagtaattgagaaaacacatatcaacaaactgatgaatttaacaatttgtaagaatatacgttttttggtttttcattatgtacagacacatctgcaaaagagtcgtggcctatgctaatgggcagtggcagggctccaatcagtgctggtgcctatggagactcagaagtctccactccgactcccaggacccacaggccacatgggcagaatcgccatccaaagcatattcaaagtttgtgatgacataaaatgggacaaaaataaacatatatcctgggcataacatagttagacaaagctaaaatcacaaggatcctctcagtctgctgaggctacactcacttgttcctgattactatttacaggtggtttcttaattatttttcttagaatgttttttttcttctcctaagacaaatgcaggctagtgtatccaggaaggctgcatgcatatttaatcctatatccaattccctgagggcaggggcattgtcttctgctaccttgaaactccatccagaccctcctccaagaagatcccaatatgacttacagatccagggccctactcaacaattctacagataacacaaaatatggagactactgattctctgctttcataaaatctgtcctctgctctccttaaagctacatttaaatatacacattctttctaaataaagcactaccccgccctttgagtgtttaagtatctatggctgctatttagattcaaagcaactaagaagcgactgagagccaaatctcagtctacaaccacgaagatgaggcacagagcaggcacagctcatgagctgcctggcagggtgcagaaggctgggagacaagaaggggagcccctccacggagaagcctccggctctaccccaaagactaccatcggatatgcagacagccctgagctgcatccctggcccttttggactttaggcaagctgctccagtcttccggcctcctcttagtcccaactcgaggggcgatggtgtttatggctcccaggatgccgcccgaccttaaggctctccagaccctttcttctttgtttccttgaaaatgtgactgttaacagtggatagagaaaaacctgtattttacaaatgagctgctaaaatcatatctcccttgtggaaggagagaggattcttacaacgcaacaaccaggaaatgattctgttgccagaataatctggtttatgagcctctttcctctgtgtgcacacggagcctgccatgaagcactgaaaagactgcctgggcatctgagtgtatttgagtttatggggctccttcaaaatgcaaaagtaaacatttgacatgctttcttcaagtttccatttgcatttttcacgtttcacgggggctgcacccttgccttccatgtgaggtgtaacttccccttttaagtcattttgccctagccttcctgcttctgcgcctggtaggagtttaatttcaccagccagggctgccaacctaatagaatttctgactctgggtgtgtcagtgctgagcagaggagtctctgagccccgggttgatgaatcctgagtgtgtcaggtgatccttagaagaaacagagcaggagatggtagggggctttgctttccttggctggaggcagccctgctacccactcaacccaatgtttctgttgccccccagcactggccaccttgggaaccaagatattgggaagggacctgaagggcataagggaatccagagactcttgagaagggatcgtagctcacctcagaacgcctggagcagttggctaaacacagcaattttaggagcccctgacccctttgtccagagtgtggtgagtcactccagtgaggaagagagtttggcaggtggcagcctgccttggcatctgtttgggtagattgctaggctctgctcattttggcctacacctctgctgacgttttccccaggctctgggatttaggtgggaaaagtcattaacgtgccctcaggcagggtcagagccatgatatctgctatttggtgtttttgggtaagtgtgtgaaaaggattggtaaccgtatttgaaaatcaatgatcatgtcggctcaacatcacccgaacaaagggatgaccctcatttttgctttttatctttcaggcctttagtatttccagttaagtatttgacaagttaaaaaccaatatatatactactttgtttctgtactttttggcttgtcactttatagcagtggtttgaaaagttttaaatcagaaatgagtatttacactttggaaaatatatttgaatcagagaggaaaggtggcctaaggaatgagatttcatgacagaaaatggtttttattaattagtaactgtcagcatatattttctggtccaattcaaaggggagggaaacataaatctgttaaatctcaacgctcacactgaaatgttgcaatggggaaatttgggcttattcatattcaataattaaatatcttcaaagcttagaagaaatacaaatttgtttttctttctttgttctatttttaaaaagtaaaagcaggtatataccccccaaaattgaaagtagggacttcaacagataatcgtacacccttgttcacaacagcactattcacaacccaaaggcggaaacagcacaagtgcccctcaacagatgaacagatgaagaaaatgtggcacatatacacacaatggaatattattcagccacaaaaaaggaaggtgcctctgaaacgcactagaactcagaagaaccttgaggacataataagccagtcacaaaaggataaacactatctgattctgctcatggggtccctggagtagtcaaattcctagagatagtggaatggtggtggccaggggctagggaaggaaatggggtgttatttatttgatgggtacagagtttcatttttgccagatgaatagagttctatggatggatggtggtgaaggttgtgcaaccatgtgaacgttcttaatgccattgaaatgtgcatttaaaaatggtaaggatgggctgggagcagtggctcacgcctgtaatcccagcactttgggaggccgtggcgggtggatcacctgaggtcaggagttcgagaccagcctgatcaacatggcgaaaccctgtctctattaaaaatacaaaaattagccaggtgtggtggtgtgcacctgtaatcccagctattcaagagcctgaggcaggagaatcgcttgaacccgggaggtggacattgcagtgagctgagatcatgccactgcattccagcctgggtgacagagcgagactccatctcaaaaaaaataaataaaaaacaaaaaataaaaaataatggtaagggtggtaaattgtgttaggtatattttaccacaattaaaaataataattaaaaaacaaacgcagtttttaaattgaattgttcccaggttaccctccaggtgatgccaagcagattggcttgttaaaggaccaggacaaggctagtcatttcctaagttacactaaacatagattcctcttcctagaaaaataagaattttcagtataaatgtgtatgcttccccaccaatcctgcagaacatggcaggtgggattttaaaaaactgtttatctttaatgacacatgcaaagtgccgccgccagtggaggctcattaaattaaacttataaaaatgtagaaagtctatctccttttacacacagctgggccaacagcccctcacccatttccccaggacaactggtagcaaaggctaaagtctaggacaaacttcagaatcaaatgcagatagcctggcggccagacaactgcaactcaatcatcaccaaaaaaaaaaaaaaaaaaaaaggtaaggtaataattaatcactctgtactttgattccagtgagattttttttttaattgtggtttagggagttgtacaataattatatttaaaaaaaataaggaaagcaattcatcttagcgatttcatcaaagacctggcatccaatgttcagtgagcatcccctagaaaagcatgtaaagtttccttttccttggtttcatcctgctacactgctgcaaggaagcacctgggcattactaagatcccgtcaggccctttatgactgcctggactctgcaccatagagcctatacaacacaggaaaacaaattttccactaccaaaacattacagcctgcccagcaagaaccaaaaacctaagctaaaactgcatttaatatgcacagattcagctaagcaatttctatctgtactactcaaaagacacttcgggagtgacagagaaacatacccacaaaatattactcaaaaagagcaaaggattaactgtatctttcccaagtcttccttagccatttgatctgtttcctctcaggctttttatttcaattcctaactcttctattacatcacaagtcacggagaagcagaagtacaagaaactatataaataacttgtcattctggaaggttctcattttccatgaaccctaaaaatattagcccgagaacactggaactgaagagggaaaatccaggttatggtccaaatttctgtcactcactagcactgtgctctctcagaaagtccattttttaaaggtaaattagacaccggggaatctttaccatcacatccaatgttaacactctatgattctgtggatttaactccataaatttaaaatccattcatttacccgatatttttcttcattcaacaaatatttgctgaacactaactacatcacttcaggtattggaaatacagatgttaacaaaacagagacaaatccctgccacctcgatgcagtgacgtcttaagcaacgatctttggaaaaggatttacaaggctaaatataacatagcaagaaaggacaggaaactgtttttactacttctggaaaaataattccctccacaaagaagctaaaacctgcttcagttaagtggcaactaaaggagagacgagggggtggacatatcccgtaggaaagagtgggcacccaagggcaaggggtactggagcccgaaggagggatcccaagccccagcgttctgcaagagaggtgaaggatgagtgggaagtcaagggaagtgcagagtcgagtacagtgtgcgtcctcagatgaagagtttcttggcagagttcatgacgctcccagtttataaaagtatcccagaggccagaaattctcctaggatggttatgcacactgcttggcagagagaagagttttaaaatgagatctctgtttacagacaagacagtcaagtagagggcattcagctctaaaaagagcctgaattctaaggcatcaggatgagaaaagtcattctaggagaacagtaccaggcgattccaagaaatggcagttctccaaaaactgaaatgcccaggagagaggagctggttttccagaatgtggatggaaatgcagtgtaaccagaaaaacaggacactccagatgggccttaaggggcagatgatctagagctgtaaccctcaaaccgccagatgcatggggccacctaggaacttctggggtgggaaaaccagttcctgagatgcacctggcattctgattcccagtctccgggggtgggctcagaaaacgaacagagttcctgttagggtctgaatatctgtgttctcccaaaattcatgtgttgaaatcctaacctctacagtgaaggtattaggaggtggggcctttgggaggtgattgggtcattggggtagaacccaaatgatggaattcgtgcccttataaagccctggagagacccttccccattccaccatgtgaggacacggcaagaagacgccatctgtgatgcagagggagagtcatcatcagttgccagatctgggagcaccttgatcttggactccccagcctccaaagctgggagaaataaatttatgttgtttgtaagccacccaattgatggcattttcttacagcaactcaaacagactaagacagttccaaaatgaatgcttactatttttaagataattatttttgaggtgccttctgaacaatgctccagggagaggggatgctccaggttttgatgaacaaagtatggaacaagcacagggagagagatttcacagtggggagtcatgagagaggaaaagactcatgttttgatttttattgtttctctctatagaacattacattattaatcagcatgacaaacaaaagccaccattttttgagcacctgcaaggtaccagatactatgccaggcaattctcatagttcaagcttttcctcatcttcctaccaaaccagccaagcaggcatttttatatatttcaggagaagaaactgaggcacccaaaaacttggctaccaagacacagagtggagagtctgcctaactccaaagttgcacatactgcctccttacgttttaataattttctttagttttttcctcactaaatgtaagttttatttttttatttagataccttcctttgtcagtgaacttgagtttctagaaggccggagctgcccttgcctcatgaccttaccctgagtctggcacacagcaggtgctcagtacacgttagttgagtaggtgggaaatagattcatcagtttccgtcaatcaagcggtagaattttcccgaaagccagccagccaggcagagctcccaaactctctggaggctgctgtatctccaaacttttagtttcttggaaaaaggcccagagggtaacccaccaggtacataaatgccagattgtcttattccaaaaatggatggcatgtgtccaaagaagagctgttccaggcccaggaatctattggcaggatacattccccagcagtcaggccttaccaagtctacctgaccatgccaggcctccctgcgactccgtaggctccaggagtgacactcaacaagccctcctctatggcgagccttcacacctctgccttgaatcctgccttgcccatcccaatagtgtttctgtccaggaagtgcagcgaattcaacgtctgccctgggcttttctgctctgagaaaccccagccacctcttgcatgcacgcttcccacataagcccaagcctttcatgtctccactcaaccctgggtgcagctccatgcatctgcggatcctgccgtagggaagacaccattttgcatgtcactaccttcttctctgcttccgcatggtgtctacaaaacaacaaatctgctgtccttctaaggcacagcagctgcccatgatgtaaggtcagtctccccctcagtaccttgtcctgccagcagagaccacaatggaatatgagaagttggtgcttggtgggatgctgggcgctgccctgggaagatttctatttccaaatggaaggtgaaaataagtgtgtctgacacatcgtgtacttactgctcacatctccaagaagcatagacacttagcactcaacaaagccaaattcagtattgtatttcacaagtattcctcgtctgttctgctcaatgcagtgtatgctggtgaaaaagagtggttcagattgagaaaccgtggaggggagggaggaacagtacaagaatctagcactatgccaaatgttcacatatggcatctaagtagccttatgccaaaccatgagctaaatgctatcagccacatttcacaaatgagaaaaccaaggtcagcaaggctaaaacacacactcagcaccacacagctatgagtaaaacttgattcctcctctggtttaactacaaatccaacatctttcagttttcccagatttaaaaaacaaaaaacaacatgatccctgggcttaaggaacataaactgcaaaggcagacatgtatttgataatttaataaagtgaagtatgacaggtctgggggagaagtaaaaagccacaggggataccaaagaggaagcagctgcttttaatgggcagagggagaaagagaaacatccagggagaaggtagtgtcatctttgtcaggaccaaagaatgagagaaacttaaacactcaaaagaggttaaatcattcctggctaggggcagcccatagacaaaggccggggagggcaaaaataaacagcggttccagaaaggtaagctgtctatgcagctggcccaggtgatgtgtgtacaggaaggatgtgagaagacgccaaagagtagagtgaggactcactcctaggccactgaatcccactctcagagaagacaatggtgttcccagactgtttaaaaaaaaaaaatctgacaaccacacagaatggccagaaggtgcagaggcaggcagtgagtgacaagggtgggggtcgggtgggtgagggggggcagaggtggagcagatgttgagtgagacctgggagaaaccgaactgtcggcaagcacatgaacagggaaagatggattccaggtcactgcagagtgcaccagaagtaggggtggaggttatcaggggcatactgtgagtctgtgacaggaagtactcccaaccaaggagagctggccatgcacagagcctgctcctgctggagggtggaggccaggaagagtccaaccagacaatttgccttcatctctctccgaaaccactccctgcttcaaatacccacagtggattagcctcagtaatgacagtctagagtcactgggagtgccccgtccgctccaaggtggggaaaccattttgccatgatgcagaaatctagctgatcccccccatcagtagctggggtgctgcagggagtccccattcagggtgctgagtccccaagaggaagcacactagttatgcaaaggtactttcagccatttggtatgcaagtagattagaagcctgctgcaattatttttcagtgcatttaaaaatatatccacaaagatgggaaggttaatggctgggcactaacttcctcttgtcattgccccctcactctttgaacaactcaggactatcgtgaaagactttcttggtcaggctgaatccaaagttgaaggggttaagtggccagtccatgcaggttgtaagggaaatagctggggatggggggaccacaaggcaggctcctggctccaacacttgctgagtctcggggcgccctcgaacaccaagcattaaacaccactgaaatgtctgctcctcagaggatcactgtaaggattgactgcaaatgtgcacacagtgtctacccatgggtaagaaactaacatttttgaggacctccttaaagatgggattaattcatagtggggaatataatattagccatgttaacaaaagtgatattggaaaccttgctaaattgcttctgaaggcaatactagtacattctgtagcaaatgacagagggtttttttttttattttttacttgtaatctaactgaaattctctagtttgacatcttcctttggggatagagtttaaaattgtataagaaagataactcatgccaaaataaggaagcattctacttatctggaatgactagactctggctgattagtactggttaattgtggttaaaaaggaaaaaaaaaaaaagaaaaggctgggcgcggtggctcacgcctgtaatcccagcactttgggaggccaagacgggaggatcacctgaggtcaggagtctgagaccagcctgaccaacatggagataccccatctctactaaaagtacaaaattagctgggcgtggtggtgcatgcttgtagtcccagctgctcaggaggctgaggcaggagaatcgcttgaacccgggaggtggaggttgcgatgagtcaagatcgtgccactgcactccagcctgggcaacaagagcgaaactctgtctcaaacaaacaaacaaacaaacaaacaaaaaaaacagaaaaaaaagaaaaaaaggttaatttaggcaaagtacaatatagtggaaaaatataatacagacattggattttaggagacagaatattctcatttctacctaggggaaatttaaaagtattctttcatcactgatcttaatgaaatgaaagaattatttctttctaagttgtactctgctacttcgaaaaaggatttgcacttccttggacggaaacggtccatatgttgtggatcattaaatcagaaatgactcactgctcaccactgcatcccctgggcctgggccccaggcctcctatcgcctacacgagcaaccgatacttgtttcacaaatgaatgaacgaatgaacgaatgaatgaaagacacagggaaactgcggagcaacgggatgaaaagcaaacacaccaggggaacagaaagagttgctgggataaagccctctattgagctgcaagcatcctgacagctaaaggaaacatgaaacattaatggagtccaattatctgccaaaggggaccagacaaaagagtggcgtgaactgtcagagcatggggaaggcgaaggcccagaatagctgagatttgaaaaattacaaaggatgacaatggctttttcagttctgctccaaataaggaccaggagggagaggtctgctgcttgcctaacacactggggcaaaacaaagagaacacaggctcctcaatgccttttttgttcctatcttccttattaagacaaatgatcttcaaagtggaaaggaaggaataagcacaattaaagggaaaccactgtcccaggcagcgggggcaactgtagggattcgatctactgctttcaaggccaaggaaaactcaatccctacagttgaaatcttggtttgagccactgaacgatcgaggaatcaaaaagaaagaaaatactggtggacttggataaggaaggagggctaatctagaagcagaatagtagagggatgaaatgcttagaggccagagcccaccagtctgggttcaaatcccagctctgccactctcaagggctgtgatctgggcaactcccctacttctggcttcagtttcctcagtttccctataaatatggagataataattgtgcctacctcataggataggtagattcaatgggttaaaatacgaagcataagttcttaataggttaggaacctactactatagctggagaagtcacttaaacatgtaagaaacagagatgaaggtaagaaatcatgacatatctaataaactatactatcataatttaactgtaggttgcagaataatcattaatgacatgtacaaatgctattatttggtgtggcatgactccatttccataaggcagaaataaaatatgggcattagttattttgtgggaaaaggattatagatgatttttctcctagcttttctgcatctcaacccgaatagaaggtatttagtgtctggggtgggggcagtcacagaaatcacaattatcatcaactttggcatcagtgtgcaaccggagaccaacattcactacttttcaggactatgctgagcgtttcagaaaaagaaagttacccctggaaatagcacagtttcaccatgagaaaatgatactaacaaaagttacttctgcacagatacagttagccccccatatccacagatttaaccaattgaagattgaaaatattaagaaaaacagagtgtacttgcacatgtacagacttttctcttgtcattattctccaaataattcagtgtaacaactatttccacagcatttacattgcattaagtattataagtaatctagagatgatttaaagtataggggagaaaatgtgtaggttatacgcaaatactatgccattttacatcagggccttgagcatccttggattttggcatttgcaggaggttcctgcagatatcaagggacaactgtgtacacacacacacacacacgcacacatatatatataatgaataaaatcttcaagattttttgtggataacatagtaaaagatgaactagataagaggacattagaggaatcatgacacaatatgctgtcttcctgcttgagttcctgttctctcatcaatcatgccctcatccaaactgctgccgatatctcatgaatggcaaggcacagcaggaagacagggcgctagggaccggtttctacctttgcttgcctagagtaaccaggacttcccacaagaaggggagaggcaggggctcaggacctttctggagtccacaagtctattaattgcatgtgagttcaggaattcattaaatatctatgaagtatgacttcagaccaggcagtatagtagaaccttgtggtatataccaggcagtatatatgtcacagtaagaaagacatgtgtactgccctcaacaaatctatgatctagggagaaagggaaaaatacaatatataaaataatgctcgcaacaggcagcttatacatataggtgtgtgcagggtggctcctctaaattaaaacctgagatggactttggctttgattcccatcccaccactgagttaacacctgtctgtgacttctgggcaagttatcaaacctctcagcctcagttttcccatctgtagctctgatgaggaagataagacatgcagggaggttctagcacaggcctcaaagtcatcatcagcatcattatttttgccaataattatgcatgatgggtacatgcaaacgaagaatctaaagtgcaaagtgattcctaacttacccccagtcaaagagcattgctggaagagactaaaagacagaaaaacagccagcccaaagccaggctatgtccctcggcacctaatgttgctaagaatggcttcttggaggaaaaaaaacaaaattttttcttgatctattttaccttctctaataattggcattcttttctaattttggtcttttcctcttgacagtctctccactaagaaattggtgcttctgaaatagtccattctccaatcttttttctacacttcccctgttactagaaaggaaagcattgcaccaaatacattgctacaaattaaagctgcatgcctataaccagtatttctggcttaaagaaaaccaagaaaagaagctaaagaaactaaagtcagaaaacagccgtaatgggttggagaggacccctgaactccagagcctgaaagacattcctcaagtcaggagttaagtgtttgtgtaggatgtctccaactgagagaatgaactacttacacttcctgggttatgactccagcaatcaaggaaaatgttttgattccagctcaggaggctttactacgacaatcacacacacagccctgttctccagacggaacaaaggcatgatgaatgtgtgtgctttgcaggcatgggattggggcgcccgaggtacacacgatgcagaggagacagacacagaaggcacagaggctggaagagcagtctccactttcaggcaggaccatagcctgccctgcccacaaggctaaagcaaccacaccagcaaggagaaagggagacccaagcagttgcagtcagcaaagaagagaagccagctggagcaacaaagtgtctctggccaagcagaagacaaaaaaagctgggcagagactctgcaatgcttctgttatggagaatagagggaagtgggtgggtgggaccacttcgtctgtggtcagaaactctgcaatcctggctcatgcctgtaatcccagcacggacagatcacccaaagtaaggaattcaagaccagcctggccaacatggcgaaaccccgtttctacccaaaatacaaaaattagccaggtgtcatggcacatgtctgtaatctcagctacttgggaggctgaggcacaagaattgcttgaacctgggaggtggaggttgcagtgatccaagatagtgccactgcactctagcctgggtgtcagagcgagactctgtctcaaaaacaaacacacaccaccaaaatcagaaactctgcaatccatcacgaggccactgataccaatacaagagtagggggctagggtcgatttgtgacggggtatttgaggggactaaggacatgctaaaaatgagttttgggctctctgccaaactctcatagagtggatctctcaatagagtgaatgaccttgaatgactctggccaataacttaaattctcagatcctgtctccacccaaactaggctaggtgagatctcacaggatgaagaatctgtggtgtgtgcagccactcatccctcacctacccacaggctggcactgattactgaagcctgtcttcctggggatgagacctcagactcccccaagcactgaactcaggggtctcagagcacctgttagtaggaaaattctgcagtttggtgagtacactgtaatggcacaatcattcatttcaaatatttaatttatattactttttttccattgtaagaataactacattataggtacattgagaaactgcaaataagccaataacaaaaacacatttctcaccccaagaggaatgccatgatagcagatagactgtcaatctctaaaaacttgacaatgaatgtcttccttccctctctcagctcctaacctctctgctattaggaagcccccagatcctgagagctttaggctctctccctccccgtgcctgggacacacctctgcatcctcccagggtatgatccactggatgtgtcccccaccacctgctcagaccatgacttctccccactgcctacacactgcctcgtcctcaaagatctacaaatattcttgggaaataaatcaagaaaaatactcagagtgaaataagtcaacttcctcaaatttcaaactcatcatctattcattttccaactagtggtgccacaaattgctccagactgatgtatcaacatcaaaaccacacattactgatagcaaaacaccctatctcttgacaactgcaaaacctttgaggaaggcattatcctggatcagtaagttttctagggagtgagagtaacacaccttccagcaagaggacctattttcattttccctcttgtacatgtcgtacgtcatcctcttggctgctttctttcttaagcaggggcaaagaatataacgcaacctttactgacttcagtcctctctctgagcatgattgatgtccactgggctaatgaggtgtaatgctatttgctcctaggtaaatggacttaccctgctggactccgtgagttctaatggctccttttgctggcctctctcttccaatactataccgctgccaaaaccaactcttactgaggtgaacttacaggaatttccagggtcttttgttccttcctgtctgctataggtttagataataaacattcaaagttctgtcattgtatttttaaataaaatgaaaaataatagtaattatatttttattttcattatgaaaaattgttacatttgttcaaaatttttaaatgcacaatattacaaggtgaataaaaatcacccataatcccaccacccaaattaaacatcattatataaaacatatattgtgctcttattttctctttctacaaaattgggaccatacagtaccgtaacctgtttccctgtttttttcactcagtaaatctgagcatcttctcaaattactagatatttaacatattttaagacagaataatagtctatcatcagtgtatgtaatgtttatctgatcagtcttgtctttccctatttcctttattctaggggaatatgctattgattgaattgaaatggatatacatgcacacacatgcacacgtcattgaaataaattcctggaattgatgggtttaaatgtatgacctttgcaaggcttttgttagacagtagcaaaccgccttccagaattagacccacttcttcgcactcaccagcaagagttacttcttaaagagggcacaccatggcagacatgatatcctgtgctttacagacgcctctttccagttctcacaacaacttcacaaagaaggcactgttgtcccatgttatagacaaggaaactgaggctcagtacacaagacagcagagtttcaaatgaaaccagcactcactggcagcctctcaggctgttaccactgcaccacacggcccactaagctcatgagcctttgggagctctctacagagtcaactctatctgcttttgtacacagacttcaacatctctttttcaaccctttgggcatctttactcaattgggttcctggtgagaggcatggccaggaatctctgcttgggttatgagcagtaacaacaatcagacaaaatttgcctaaaactgagaggccaaacttctaaaaataaaacttcacatctcaaaaatattgttaaggaaaaaactaaatatagcattaccctacaatccagcaattccacttctagatacataccccaaggatttgaaagcaggaactcagacccttgtatgtcaatgttcacagcagcactattcccaacagccacaaggtggaggcaacccaagtgtccctccctcaacagatgatggaaaaataaaatgtggtccatccacacaatggaatattatttggccttcaaaaggaaggaaattctggcacatgctacaacatgggtgaaccctgaagacatgctgagcgaagccagttacaaaaggacaaatagtgtatggtcccacttacatgaggtactaagaacaggcaaatcaagtgacaggaagtagattagaggttaccagggactggggagaattattgcttaatgggtacagagtttctgtttggggtgataagagttttggaaacagataaatggtgatggttgcacaacactgttcacatgaccaatgccacttaatgtacacttatacaaacgactaaaatggttaattttgttttatatatttttaataaagaaaggttttttcaaaatcgtcaaaagtaattccagctattgcaaaaccaccccctttcaaagaaaagtacatccctctctgctgtgtgctgctaagaaatgtgggatgcatttttagcaactgtcacacaaaaataagctgcttacattagttaggaacaaggtaataaaacaggagcaataaatcctctttgccagatagcagtaacaggtcaaggaaagtcacagctaatcttttattctaaacatcaggttccatgcaaggatccaggccactctggatcaaacataccatgtaaagctacagcctatgatggcagcatctgattatgcctcgaaaattaaggaagcaggaaagaaccgcactgtatgtttgttagatttggtcataggtcccaaagcatctcgttaaaaagaatccccaaagttgaacttggtgtcaggcacagagatgggaaagggaaggcactgactcctgtaggctgtgctgtgggctgaaccacccccaccccaccccagggagggaaggagcctttgtacccagtgccagggagctgcaagccccaggtccattctgcacagactcacagggctgtgaacacgccaagagggaggatgaacactctgcacttggacccacttaaaagaaggatctgtgtctttctgttccatctaacagccctcagagcacaggcttccttgatttccagctcagttggtttccatttttcttgtgaaatgagtatccagaatcagacacaaacacatcatgctttccttttttgtaaactgcctgctcatgttctttgccagtttttctatgtaattgtttatcttattttatttataggattttttttacataaacaggatactaatactctgcatgttacatgcatttttgtatgtacatgcaagaagttacaaattattctcccaggctgaagtgcgcctttcagcatgttaaatatcatctgtaacgtctacatagaaatatgtaatggtaatacagtcaaatttaccattttccctttatggttgtgctaagtcttattcacaaaagtctttcttagcctaagagaataaagattctcactattcattaattcttgtcattcaaacaaataaaaggcattttgttctttcacttttaattatttaattggcctgaaaccaattattgtgtagaatacgcagcagggttccattccttgccaccccatgtgaacagtcatggttcctgtaatctctgttctgccgtgatttcactgtgctgtatgtttccataaatgtgtgggtctccttatgggatatctattctggtcctttggtctatttgtctggccttgaactaacaacatcctttcttagttgtgataccacataagagggattgctatctgatagtgcaaatcaatcctccaaacgccttgttgtttttcaaatttgtcttcaaattcttgagtttcactctttcttattaaagttaggaaacatttttcaagtcacatgtgacaaaactgttaagaatttggctgcaactgtattaaatttaaagataaacttgagaaaatgtgacatctgcactatattctgtctcctgatccatgatcataatatagctctccacttactcaggttgttttcatgctctgaaacatcctataatgcctggtaatcttcctgaatatactcctagatagcttataatttttgttaatattataagtgggatttctttttatattacatttcccaattgttttttcttggcatacaggagtactattccattttacatgttgatctcacattatatctgcttagagaattcttgctcattttaaaagtgctaacatatctgtgtaaattttctatttgaataattatttgcaaaaagacacatatttcagtcttcctttctaatgtttacattttagtttcttcatttgcttcttttattacactaagacctccagtgacagcaggcactgctgtctaattctagatgttcatgaacatgactctaacagttttccattatgtatgatgcaatgttgtaggtttttaacaaatgaattttaacaagttaaggaggtttcttttcagtactagttgagtacaaattttgttattatttgttatgtattataatgagtgaagagttgtattaaatactcttctgccaggtgaaatgattatttttttccctttaattctgacatattcagtgtgttcactgttttatgatagtaaaccacccctgcactattataataaaaccaacttggtcataacatttgtttcatttacatttcacttaaaataaggtactgaatttggttcattagtgttttacttagaccttttgttctatgttaacatgtaaaacggtattataattttgatttcttgtactgtttcaaagatacacaaacatggtatgaattggagatctcgtcctctgtgtaagctgttgtcctctgtgtttaagagtgtacacactcttagcatgtttaaaaagagaaattgttggggccaggcgcggtggctcatgcctgtaatcccaacactttgggaggccgaggcgggcagatcacgaggtcaggagatcgagaccatcctacctaacatagtgaaaccctgtctctactaaaaaataccaaaaaaaattagccgggcgtggtggcgggcacctgtagtcccagctactcgggaggctgaggcaggagaatggcacgaacccaggtggcagagattgcagtgagccgagatctcaccactgcactccagcctggatgacagagcgagactccatctcaaaaaaaaaagagaaattgtttctttcttgaaagtttaatatcactcatctgcaaaccacttgagtatttttgaaggtatagtattgattacaatttcttccagagctgtttctctattacgattttatatttcttcaagagtctattttgtttttacatttttgcaataaatcatctatcttcccccagatttccattttttcgttcacagttttcttgatgctgtttttaaaacttgctaacgtgctcttaccatgattttcttgggcaccttttgccctcctgagtgtctgtgctacaggtttgctgttatggtcgtttttaccaaagactggtgtttgattttgttcctattggtactctgtttcaacaatttctgactttaatttttataattaattccttctacattccttattctatttcatttctgtaatttcaatttttctttttttgaagcttagaaagttagccttaccacctttgcagcattgtatgactttccacctgtactatgttcactttcattcagttctaaatgatcgatatttccattgcaatttcctctctaactcataagtaaaataagagtgggtgtgttttaaagtttcctcatgcatgtttatgtgatttgttttcaactttttatgttgacgtctgatttattcacactgggtcaaagaacaagcatgaaatagattgcttaaaattcagtgcaactttctatataccgtcaacttttcaaaaagttacacaggttttagaaaagaatcaagagtctctgtctgttgggtagagggagctatgtgtgtctattaacttgagtttgttaacactatcacgaattgacttggaattactcctactatcttattttgtattttgtttaatatcttttttctcttcacatcttgttttttcttccgttttctacttgatgttgtttgattgttgttgtgtttttcatatatattcccttatatctttttctgctaggttgggaactatagattatatgcacattcttttagtaattacagtcaatactttagacgcacctaatatttttaaatacacaattgattattcatcacatattattttcccatatgtgccctgtttccctagtatccacattccgtcttcctcaagaagtacttttcatcattcttctaggccaggcactgcagctcacacatgtaaaccaagcacttccagtggtcgacatgggaggatagcttggggagttcgagacaagcctgggaagcctagcaaggacctatctctacaaaatttttaaaactagctgggagtagtggcgcacacctgtagtcccaggtactcgggaggctgaggctggaggatcacttgagtctaggagttcaaggctgcagtgagctacgagctgctctccggcctgggtgagagagcaaaacttggtctcttaaaaaataaaaataaaataataatcattcgtttggtgaagactaccagtgacacatttttttctcaatctttgcctgagaaagctttatttggccttccctagtcagtgatatgttggcataacattgtagatggatggttatccttccccctgcatcctgcacttgggagtacactgcattgccttcaggcattgcccagggtgcccaagtcttgcctcattttgtcttgttgtgtttcatagtttcttgccttgtcttacagacattattctttcatgcatctgtctgagcattataaacacatatttcaaagccatggtcacacttttttttgttgcatataggctaaattggtaatctcttggttttgttagctataccatatttcttagtatgggactgcttcatgtgcttttggaatgctggtttgtggattgttttgtttttcttttcctgcctccccctccccactgagtggtcaagtcgggacagtctggagctgctgcctcatggaagactgcaaggttgcagtctgcgtcactgcactgggaggctgcttgggttagctctggctgcagggctgcatccactctgtctggctgcctggccatgagttcacatgcactacaattcctcccaggcaacggcccttttccagcatcttttgaaaagaggggagccccaccacagctctcggctggatacggtgggcctggctctggccctgcttccccagtcactgccggagaagggaaagcgcagccctttgtattccctaggacctaggccagcagcacccatgccgctttgggagccacagccctgaggagacagcactattcaatgctctgtggacatgcctgggtctgagcaaggctgagtccttttggctttcccattttacatgctatgtgtatgtaaaatgattgagaggtggccaatgtcaagggtgtgcttaaaggtatcaaccctctggtcacggagcagaggtagggttcaacatagtgacgtgttcatccattcctttaagccctgtttcaggtgtggggatacatccaagactcagtttcaactgcatacggtgtaactccacatcagggaagagaaccagctctcttctacacagaatgtgctccacgttctgtgctgcaaatgtcccttaattgaactactttggtatctgtagaatatttgagtgtacaatttaaagacaaaggataaaaggtaagccttaaagagttctttcagtgtaattttttctggtttcctaattcaagtattaacctaagtttttatataagcattaacaccaaggcttacattatttccatttaaatgagatcacttgtgagcatacaacgtaacacgttaaaattttcttaagctttgaagtcaatactaacaaattggtaccctttccccgcatcatgtcacttcaaagttttctaaaagatgatcccaaaattatgcttgccacagaaaaccttgacagcttttatgaatcttctaacaattgagaaaacattgctttgacttcatggtcagatcccagcttttatttttatagtcaacctttctcattaagtaatttaagaaaatctgaatattcacattcccaccagctctaggacctgtgatttactgtacttaaactctccaataagccaaacaacgtgccacacgcacatttcattctatttaatcctcaggctcctcatcctacggcaaagcttccatttattcaatctaatttcctaagtagtctaattttctaaaggtagttccctttcattcctttcccacaatgacctcatcagaaattaaatattaatagaaggaacagaatcacagaaaggtagagaaagaccaagagtacatgcacccaaaaccgtcttaattggaaacataaaaatgccaaaatcaagaggattcaccttggagtacccttcaataggtgacatcaagttgcctttcggctgaaacctagataactcgtatgaaactgatcgtgaagttttgctcactgaagtttgctaattgaaaggaaatacatgaagatatcagaaccaaggatctttctctatttgggaattcactgtccttaatgagaaaagaagaaccaatgttagaattgtaatctattagtgtcaagagcaacattttagaatatcagatctgggcactgctgcaaagctagaactgggagtgttcttgtgttttgctcattccttaccctggtgattcgcaagtcggtcagactgtgcggggagtcctggtcctgccgggtcttgttgactgcgaggtgtctgctccaccttgtcctaaaaaaacaggaccgcagcagaaaggctgtgagttcacaagaagcatcccactcttttcaacacccagcttccccagcatttcctttcttcctcaattccttacttcctttccacttacttactttttccattttcaatgatagttgttgaaaacagactgcataagggaagctaatcatgaaaaggtgcaagctgtttggcaaaggagttaaaagttactcctgtgtttgggcttaaatagctttccctgaatagcaattcaaagagaattattgccaactgctccaatttaggcagtgaatagaaataattaacattccatggaacacatgcattttctgtaacaactacaggtaatcaagtgctgggcgttctattacctgggacagaaacatctagagagtgttttataaatggttccctctacaaaatgttaaggagctcagtggcatttttttagacattagtgtgagaacaacactttcaggcaaaatgtaaaacagcaatattatgatcctaagcccataattctagaaacacacctgcatgggaccagaagccaatgaaagatacattcaaatgtggggaaagaaatattatcagtgactaacttggggtagagagatgtctgttttctcttatagatttataaaaatctttgacatctttatgatgcatatgtaccactactgtaattagaaaggtttgaactgtgccaaaagtataagatgtgccccagaactactaatattaatacattgtcacaaatatcatagttgacttcagcaaattccctcctattcatgcaaaagagaccttccagattgcaaactgaagcacgtgaaacatccaacatgcgaggtgctggcgacagccaacatgcacacacagctccctctgccaagcggggctctcgccacagaggcggccactgaggcatgggaaggtgagttaccctcacaaccctcatcacccagtgggtcccggctgttctgggtctcgaactacagagtccacactccttcccaccactctgcagtgcccaaactgcccaagaaactcaaaaggcacattgatttcaacaaggtgcccaagcagcaggccttgggaatgtgactcttaatttctgcctgaatgcttcccagcaagcagtttctctgcccagagccctccttgctcacgcatgaaatgggatggatgctcacttctctgctgcgtgcacactgacctgggagcaaacaggtttaggtctggtcaacgctgtgcttcacggaccactcacaatggggggaagcagagggtagcccaggggacagactccagcagggtcagctcacccacatctaccacttagaaggaggatgtttgttccctgggaggcaaagttgcgttcacaccttcctccagaatatctggagaaaacaaaataaaacgaacaaagccctaaggaagggagacattttcaccagcttctctctttttcccctttcaaaagaaatagctttcttttcattttttaatcgcagatgtaaaacttgctaagtataaaaatttatatttttgtatgctaaaaaatgaacaaaaaattaaaacggaacctctctttttatcagaataacaaaaacaaaaactaccatgtgcatctgtgcaatgtttgaattatttgtagagaacatgcatactctatttgagtcacatggggattacaaatgatcctgataaacactgaatcataattatcttccacatattgtgttttaatatcgtttttgaaatttttcaggccaacaatcatctccatcagcactctagtgtaccccaccaagtagaagtgtagtgtaattcatttcaccaatatcctactaatgaaaatacaggttgttggaaatgtaagctttccactaagaaagaggggaaagacagtttggagcacacagtgtctgggaggaaagggcaaggtccccaagaacctccgcaacaggcgctgaggagggagctgtgctcccctggctatctgagagggtggtacctcccagccccagcccctcaagttcagccatcccccatctagtttctgcaattccatggccaacatttcccacccagtctgctctttggcatctgaaatatttttcctcttttctgaattttacaacaatccatgcaaagaaaatttttatataaatatctaacctagagtagatagaaaattagcctaaatcatacaacagtgggataatagcattcccgtggtctttgcacctttgttgtacacaactagacactgttgaagtgagattgtgtaaataattgtgttttcctgtccctgtcttcaactattttaaaacttcagtaaatactatttttttcatattctagactactctagtagacactctgtagttgttttcaactttcagacagcataaataatgatcaaataaacaccttcgagcacaaaactttgtccacatttctgattatttgcttaggatccctagaagtagaaggactaggccagaggccacgtgcacttttttaagattctagatacacacagtcaaactcttcttcacacactcacccttctacccggagtggaggcaaccgcctgtttcataacacccaagccagccagtgactgtttatttttctggaatttttttctggctaattccagaggtaagcagtggccccaccctgtggttttaatatgcaggtctataatgctgaggttgaacatttttcataagcgaattagacctttatatttcttcttttgggctatcctttaacaggtcagctagactagatcctgagggcacaaggggttcccagtaaaaaatgtccatgaatgaatcacaaccctgatactcatcagctaagggtttggggccagttacctggattctctgagtcaatctgctcatctgtttatgatggaaaacaagccaggctgagccctgggtgagcacccatccctggtggcccgctggcctcccaaccctctgttactgaacaccgacttgcttccacttctcccatgacgagctttttacgcagtaggcaagtaagttcattcacatttgtagcaaatgtttttcccactttgcatgtctttaaatttaattatacttttgattcttaaaagtataatccaatgtagtcaagtttattgaccttatctttttggctcatcatttaaccgtgaaaatgatttgcagcttctatcaagaaaactgaaaaaccttcatttgtgttttactctgattcctcttctgacttgatgtattactctttcctcttcctgacatttattttggaggatagtaaaaggagagaaaatacaatgactccttccccccaaaagtagttgatcagttctaccaggcccacttagcacccaagccttccttttgtctgatttgggaggtggtcaccctgctcacgtgttataatcttacacacatccaagtgtttctcagccacctcctcaccggttccacagagctgcccgctcccgggccggcaatcctacattttccattctcacagcctgccaacgtgttttctcatcagcagaacatttcccctcttgcttcttttatatgaattccttagtcattttcttccaagcaaacatcaaaacagtttcaaagtttgcttaaattattaaaacatctcatctgaaatatttactgctatgtatgtgaataattactacatactgctaatacaaatgttgctattgggttgatcccacaagcactgagagactacattcagaagacatgctaccccacgtatttcaaagggtgggtgggaccagcctccagatcacccagggcctgcacagccctgctccaggcctgtcctgcaaggagccctaaggccctgcaggttaacaagccccttgcgtgcttcctgtgcactgtgaggtatgaggcccattcctctgtcagatgactgctttgcccgagacctcctcttttaagtgccaaccaggctccactgagacatctatttagaagacaagtaacttgcaaacctaatttaaggcaaccttgtctaaacagtgtcaccagatttagcaaatacaaatacaggatgtccaattaaatttgaatttcggattaataactaataattttttggtataagtatgtggcaaatatttcatgagacttatccttaaaatgtatttgtagcttatctgtaatttaactggagatactatattttatcttgcaactctatgcctcaaacactgttaaaatctgacaggcctgcatgacaaagtatggcagtaagaacaaaatttcaacaagtggctcatttgtttatgaaattccaaggtcaaaacagaaatgtaccttctttaattcaatagatagacacttcagacatgaagtctgttgtcttgagaagccaagaaagatttcatggtatgacaaatgatggtgattgtaaaataaagccaaaacacaaaaggcagcagggaaaaagttagccactgtggcactaaagatcatccggacagagctggaaggtaagcggcaaatgtctacccaccattcagaggcaaacagtggcgctctgccaggtgcagggtaatgaacacagggacaagaataaaaggtttatcattgtgttagcttggtttcctctccaggttagtttttgtttgtctgtgtgtctgtttcccagcctcgcccattgtgggaaggactgggaagggaatgggggaggccctgtgagtctgtttttttttttttttttttttgagacagagtctcactctgtcgccaggctggagtgcagtggcgtgatctcggctcactgcaatctccacctcctgggttcaagcaattcccctgcctcagcctcccgagtagctgggactacaggcacgcaccaccacacctggctaattttttgtattttagtagagatgcggtttcactatgttggccaggatggtcttgatctcctgacctcgtgatccgtctgccttggcctcccaaagtgctgggattacaggcgtgagccacagtacccagctgtgagtccgctttttactcagagcccttaatcactatgctctctacctctaggggaaggtgaaaggatgggagagggcagccaagctccttaattaaagtcccacaggtcacttcactaatgctgaactttcccaaatccacatgctttagaaaaacttgccaaagtcagaacaagcccatccagcaagatcagggcagaaacaccaccttcataaagatgaacacgagaagccctccctctcctagggtgacccagtcccaggccctgtgctgagccatctcctgtaacagagccctccagtgggtgaggagaatggtttctgtctgctcctccatcctgtgccaggcagtgagtctgcctgagctgcatcgaccaacagctggtcctctggcccccagtggtgggcggccgagggagccaggccaggcaggaacatggcccgggaggccagctgggctgttccttccgtaagccacgttttggggattgcacaaatgccccctggcctcactccctctccttgctggcctcaggctgggacccacaactcagctgctttctccagacccctccattaaactctttttttttgctccccacccccaccccgcgccctccggagggtgcctgctgcagactgccgagaccctggctaacagaggcaggtggcttaacttccctcactctgtggattaagggctggaggtttcaaagagtacacataaaaagtgactcgtgggaggaagaaaatggtgagctgtgctgtggactgtgggcatgcctgttagggtaccaggtggcctggtgtggctggtcctcaccttggagaacatggtagaaatgcaggctcccaggccccagccagagctgctaagtcaggcccatgatgggggacccaggtgtctatgtgtgaactgcccttcctaatgtaacgtggctcatacctccatggcactctaggagccacaacccagctggtgttccttgactccaaagtgactgctgtatgcctctcacagcactcggccctgggtgctcactatgtagaatgttctctaccccatccaccatgcacaccccatcaacccatcctcaaggctcatccctttggcactttctctgacaaccccaacgaaaagtctacctcctcgtaccttacccagcagccctgctttaattccaagcaggaagtaacaagggtgaatggattggtgcccaccctctccccagaaacgggcctccttgactcatcctcacaaccccagcacatggcccagcctcaccccaagatcttggggagagaagcctctgcttctctgtgaggatagagggacaagaatgctccaccacccacctttcaaagcccaggcttcagcaaaaagcatcacaaggtagcctgggcacaaaacagcgaggaagcagcccctaccaccagtcattggcgttccgtttcaactagagcatcaaatgcactcttgcctctgctgggtaccaactaaacactacaagatgcacaagaggaaccagccccagagaaccagggtatgttgttcattgggcgattcaggcagttttcttatctaaaactgcaacacacggatggaggggcagcgggaaaactggatgagaggagtgccatcatcagtgcggcgggcactgcaggtgacaaatggaaggactgcacagcaggctggacactggctcagatcccaggcccccacatgctggttagtcttgggactcagggcaactgcctcaccttcggggtatctccacaccttcctgaggcagaacgaccacttcataggtcacttctgaggttcaaattaaaataacataaataaagggcttgcccagcaactaaaggtactgagtgttcggtagacagcgggcactgaccttactacggaacagagggccggcagcttgcataggaggtctctctctccctctctctacagtgggtatcacgtggctgtgtcctcagcctgccctgtgcacaatattttcagaacctggagaacggcacagaaggcacacttaataactccactaaggtaaacaaagaccaatgccacagagagcagaatgacagggattcgaaatgtcttccacctgggagaatgcccgatcataacctacaggcttaacagggatcaactttaaacattacaggtatgcaaaaacagccaaccaaattaaaaaaaaaaaaaaagcaacagatgagaacagtggatgagaactgctcctgagggtgcagttaaaaggggctctcccagccctcccccaccccctgaaaccctctcctgcagctaccctcagatttttggtgcaaaggagaagacgcaatcctacacgacccaccatccgggtcccagagctccctggggccttcctgcaggcagtttcccaaacccctcctgcccagccagggacatcagctgagacgggtggggcacattgctggagtccacccaagggcgctgagtctgcagatgaacatgtgaactgcaacagggatggggtttgtcatttcacacaggatgcacttaaagaagtaaaatgtttcaaaccgcaagtctattaagctattgcagccgagtgaagagtgactacctgtgtcacctgcattttgaaagcggaggcatcacccagctcatcagttcccttccaatgcctgataccctctctaccaactgcacatatgcctgctctagaactctgaacacacacaagccgtcagatacagtgtagttacagatttcacaactaccctccctcagccatgtaattatacttttattaaatattaatgtaaaaatggcagggtttctactaatattatagttcctgggtaccaggtacggtgctagacagtttacacacattcccacttaaatcctgtctctaatgggtactgttgctacctcatctttacagatgaggaaaaaggaggacagcagcttgcccagcgaatcacatctcgtaagcgtgggtgtgagacccattggggctgaatcagagaacatgtccttaacaaccgagctatgggtaactacaaaatctgtcactcagagaattcctaaaacatgcagaaactccacaaggctgaaaaaggctgaaaaaaaaaatcctaaaacattagtgaacttggtaaaagctgcagtatcagcactcctattctgccagttgcaaggtgtacaaaactagtccctcaaatggaaataaccttcataataaatgagccagagccatttttctcacccaaagtgacactgcctgttttgatattacactttaggtctatgcaagaggaaaggaagcaagaggtttttaagcagagatttcagtcaaactgatccttaaacaaaaacaagagctgcttccaccaaaagcctgagatgggggaaaaagaaaagtcagcaagccaggtgtctcgtatcaaggaacaagggggatgctctttacttacaattgtattcacacaggctgctgaggccaacatgaaaatatctgggcaagccctggtcagagtacaaaaaaacttttctcccaaatggtaagaatgcctggcctggcagggaaaataccaccacataaaaaatgatcacattttcactaaaatcatacggcctaaaaaacacacagatcagtggcttgtactccatattcaggcacttatttccacataactacctccaagtgcagccattcttgaattaaaagcaaaagtagtgcatgagctgcctcactttaaccacccactctgcagtgttcagcacagaaacatcaattctggttattcacaaggggaggagtctatcaatcatttacattttaaacagctctattgagatataaattacataacataaatttcatctgttggaagtgtacaaaccaatgaatgttagtataattaaggatctgtacaaccatcaccacaatctaattttagaacatttccatcaccctacaaagaaacctcctgcccagagcctgtcaatcttgacaaatggttttcccaaaataaaatgcctttgccaagtcagttttgttcctgtttttgcatctggtattcccacatcaatgaggcattttggccgaaagggggacagcactagctctagaatttctacagaagagtagctacatgaccttggggaagacattaaaccaccctgtgtgagtataacctccaaggactattgaagatttagtgtgatcacacatggaaagcacggctcagtaaatctcagctgctatttttactactgccactactgcccctgcctcctcctcctctgcggtcactacctcccctcccgacatttccaccagcactccaccccttcccaccacctccttccatctccatcacttctcctgccacatcagctcctcctctaccttctccacctcctccaccgccacctccatctcctctaccacccccaccatcatttcattaccacctccatcatcacctccagcacttcaaccaactcctctaccatctccaccatctcctctactatctccaccatcacctccacctcctctgctacctctatcacctccacctcctccaccatctccatcctcacctccacctcctctaccatctccaccatcacctccacctcctccaccatcacctccacctcccccatcacctccacctcctccaccaccacctccacctcctccattgtcacctccacctcctccatcctcacctccacctcctctactatcacatcacctccacctcctccaccatctctatccctcacctccacctcctccatctcctctaccacctccaccatcacttccaccatctccaccatcacctccacctcgtccacttcctctaccacctccaccctcacctctagctcctcctcctcctccactacctaccccttcatcaccacttccacccattccatcacctctgctccttcccaccacccttcacctcttacatctccaacacctccattgctaccaacacatccacctccacactcttcattatctctatatcctcctccccctccaccaccacctctaccatcacctctacctcttcctcccctaccttcacccctcctcaccacttcctccatccccaacttcaacaaaaaggcaactattcagacaccaaaatatccacatgtattaacataatattaatttgttagaatagtcaacatgtagcagtaccttaatcgatcatgagttctagagtaacttaacagtctgagaaatcagaagatcagaatctctaaactacccacttaataattttgacaacacaatctttaaagtaccacaagaggatcagtgacaatgcaagttatagtcaaattatatttatatactttaaatataacttgaggccaggagcagtggctcatgcctgtaatcccagcactttgggaggtcaaggtatgcagatcacgaggtcaggagactgagaccattctggctaacacggtgaaaccccgtctctactaaaaatacaaaaaattagacgggtgtggtggcgggcgcctgtagtcccagctactcaggaggctaaggcaggggaatggcgtgaacccaggaggcggagcttgcagtgagccgagattgcaccactgcactccagcctgggctacatagcgagactctgtctcaaaaaaaaaaacaaaaaacggagtgcaatcctgagccctcctgagctcccaggtggggtgcacaaagccattgcaattgcactgaacccaacttcttcagcttcaagcttctcgttttctctctgggtcccacaaccccagcaacctctacactaaaaccagagaaccaaaccatgtgcggctgtgagagtgatcaacagagccagggttgccctcctagcagatcagggccgtaggaggcacatgacacacccacattcttcccccatgagcagaaggaagagagaaatctcttccttgaactttctcaacaataatctcagaatttggaaataactctcattgtcctggctgaccaggaaaaggccccagggtttgatatgatgaatccttggtggtggcttttcctcatttctaagtccctcccacaggtagagggcagggggccaagggtaaatggcagccaatgccaagaagctggaggcggaatgaggtaagctaggtctggcctggagctccagcctggggctcccaggtgtggcagccctttgaagggcaggcgcgatctggagcagggaagggcatggagcagcttccaggtgcaagcagaagggctgggctggcagggcaagaggacggcggttcatagtgatgctccccagaggctttggataaagctcgttttattcataaaaatgaataaacagcacagatcccagggctcaggaaactcaatccctctgccaaagagtgacttttcccagtaagaccaaactcgggcagccattacagcaggaacaattggtggatcccaaccttgctgtgggccataagaaacagttcacctcgcccttcaggtatgaaaaatcttattgtggcatgagccaaatgtttacaaactgccagtgtgacaaactatgattctgagcaaataacttcactctctgggcctatttcctcaccaataaaatcaggtttttggaccatatgacgtctaaacttcttctgagttccaaagctgggtctgcacactccacaaaaatgttccaaagcaaatctactcctagaaccacggttaaaataatatcatgggtgacttctgagcttctggccaatatggaatataaaggattagatgtaccctctccccctaaataactaaaactgaaacagttttcatacatttgacaacaggcagcatgggacagtgattcctgagacatgatccacatgacgcagccctactagtgcccactcactggctggagagagcttccaagctgcagcgcagggagggggaatctcccttccaggcagagcctaggatcgtcctaaggagacagagttcaacactcaggaaggtcaaggcagagaggagagcgctcaagagagggggctctccacacacatctccagctgaggattaatgacgcatgcatgtaaggaaaataccaagactgggaagaaccaccagaatgaaggagacagagccatctggagagaagcgtgttcccaccaacccaaatggaaaacttccttacgcatgggacacaagacagccctcagaagggtcctgcctcaacagtgggggcaaattagccccaaactaaaagtgactctgggcccagctaacaaagcttataagccagcctcaaaagggtcaaactatttccaagaagcttctttccagaataaagcccaaaatatttaaaagaatagccccctcccaagaagtagccaacacccaaccaggtgaaatttacaatgactgggatcgaaacaaaaagtaccaggcatgaaaagaaaataaaacccataacgataagggaaatcagccaagagaaacggatacagaaatgtccaagatgaaacagcaggcgatatattaaaatgatgaagataaatatgctctgtgcattcaagaaggaaaagcaaagcatgagtgataaggagagaagtggaagatataaaatgaccaaatccaaccctacagatgaaaaatgcaacacaggagatgaaaaatatgtgggcaggattaaccagacattggacaccacgcttctctcccctccctccatccccagtgaccaatctccaaagacacactgtgaggctccctcgcccaacggctggcgtggtctggagaggtctagggtaggagcaccctatgaagacatagtaatagaaactatccagaatggcacacagagagaaaaggaagatggaaaagattacgataaactacctccaaatgatgaggccagatgaggggagggaggaaggagctcaggtttggggccagagaaaataaaggctgcagccagcactttctgcattcccgctatttggccgggctggataagtcaaccaaagtttctgagcctcacttttattgtaggcaaatttggatcatacccatttcaaaaagtttggtaggaaaactgagtgagatgaggtatacaaagtcctgtcacaaaacacatgctagctcccttctcaaactccaaggagacagtctcccactttgtggcagcctaacaactgcaagggggtatcaaggacagaaacacagaaagtcttcaccattccttccactcagaggtgaacctactcttacgtacttgaaaagcagttataagcacaatagtctggttactgctccagcttcaacaaacagcaagggagtcaggggcaactgggctccaccacaggaagcagttgccaggccatgtgctcctaatgctgccaccgcaaggagagacactcactcacatgagaagcttgaagagtgtgtgtgtgtgtgtgcatgcgcatgcgtcacagtcacatatatatgtatatatacataaatatgaaatttgaaccatgtgtggaaacacaagtaatacaaacttaaaatgtacacagatacaggtaatctacagatatgacaacaggcccctccttatccaccactgaagctacaaaacatttctttacctaaacactttctccctaagttaggaacctcgttcattatcagtagatctgaagacagcgtatcttctcctgtgtccatattatcaaccaggtgtttagatggaaattgctttttagcaccacttagccaaggcctcattctctgaaatgaggttcttggggtctctggacccattgaggagcgatggtcagatacacagatcggttcaccctgtgctggtaccagctcctgaagggacctacgagacgcaaccacaaggccatggccatgctttgcttgaccccactccagactgctcaacatgcagcaggcccagttctgatccccccaggcagagactcctctgtcactccagggagtccaaagggccctgggcgcccagcaaagggaggaggccagggactcagtcggcccagacaattccagcccactgactaagtgccaggacaaagaggggacaggggattcccaaggcaagatccggaggcttgcggaactgtgtccagcaggaaggaagaaagggaaggggatccaagctccctcaaatcaagaagcccagtgcccagttcaagggagaattaacagagagaggggaggccagtttggggaatgggaaaatgagtttggtttgaaatgtccttcttctgaaatgctggcattaccttcacctccctgaatgccagtcagccatctgcatgggttagttacccatgcagaaatcagtcagcctccaactcctccttatccacctatgaactgcttactgatcctgattattttgccttctacatccacttccacccacactttcttctcacggccactgcggcgccctcggctcaggctgctcactgctgcttcctgagcacactgactgagatcagtgagagctcactctcacacgaggatcccagagtatagaactcagggactctccagcctgggtcttaaacccgcactctacatctaatatttcagtttttgaggaccacagatctaactttactccaaagtaatttgtacattaagggcaggtttcaaaaacacattaacacccagttcaccaggagcccaacgttaagtcccgtgcatactgaaattgtaaccgtcgaaaccctgagagcagaggttgccattcacagctctcagggtcaagagcgcttaagcagcaagaggggtcctgcaattactgtccaatgtctaagcttgttgaacccctcaaaatctttacccaagggtgacacagtcatggataaccaatcacagagtttcagagacttggagtatccaacctcttggtcacccaagcagaagaaaaatatagtcaatcttcagagaggctgatccattcaacaaatatttaccaagcaattactctatgcccagcacatgagtgtttaaagcaacaatcctgccctatggagtttgtattttatctaaagaaaacaagtagtgagcaataaacacaccatttacttgttataatctgagaatgcagtgctatggaataaaagaacagaacagagctggataaacggggcggagactgcaatttacacagaacacaagggaaggcctcactgaaaaggggtccaaaagtgaagactgcaaggaggaagggccaggcccacaggtgtcctgtgacacctacatgaaggaggaaaacaaggcaaaagaatatcactgcaggcagagacagaaggccctgcaaagggaattcatcttaagagtgaccatcctttgaagctggaagccatcattctcagcaaactaacacaggaacagaaaaccaaacactgcatgttctcactcataagcggcagttgaacaatgagaacacgtggacacagggaggggcacatcatacactggggcctgtcgggggtagggggcgaggggagggagagcattaggacaaatacctaatgcatggggggcttaaaaacctagatgatgggttgataggtgcagcaaaccaccatggcacatgtatacctatgtaacaaacctgcacgttctgcacatatatcccaaaatttaaagtaaaatttaaaaaataaaaaaaaagagtaaccatctttaacaattacacggatgccactttctccatgaaataaatgctacaaccagctccttacatttccactacactttggaatttcctaccaagaatgacaagttttgtttttcctgtgagtttactccttttataggtttttttttttcttaagtcatactatcaagtgatcaaatccgagttcctgcatgctacgcaggatctctggcacctagaaatagctggtggagacacattcttctgccccccactccagctgctgggagcggggctgaaatccttcacagaacttgaatgcctctcaacaaacaccagagaacccctagcagagctgcaggctgaagcccatcttcagataaagaaacacggtttcctaccacttttccagaaacactaacaaacacatcaactaagtcacagaaagttcagtaagaggaaaaactaaatacaagctaaatatttactttcttctttaagatcaatgataggaaaacctcacaaaagttaaaaataatgttaataattcatatcacagtcacttcgaatactttgtttctagttaagatgataataataataaatgtaccagtagccagtttcgcagagtctgcttgaaacacacataaatatttaacaggttctggggaaactgctaaagtgacagtattgactgcatgatgaaaactggatcgcaaaccctacctaagtgaccccctttgtcgagactcataaccggtggcagcaaacacaggtgatgaggcccatctgacaccaggcgccaaaaaggcccagagagcagaggacaggcacatcccggacggggagcccagcacatatggcaacacttaaaaccccaaggaaaaataacagtgaaagcaagtcatcccaactaaacatgcatggtacaggaatataaaaatataatttaaacatagttaccaccttaaaagaccagacacttcaatcagaaagtaagtaaagaagcttatgtttaaattactctgtatgcttttaataaaaggaataattttaaggttcctctctctgccaaagtacaccattaaaaaaaaaaaaaaagttgccgtttcctaaattttcatcaatgtatttactgcttgtttaaaatagcatttttctctgcctggctgtctaaagcacgatattatccaatagcttttctcttctgcaactgagtgagcaatcacagaagctgcacggcacccaaatccagtgcaggaaattgtcgcaataaataccctcttcatccaggtgccagaaagaaaagaaaagaaacgccctgcttcattgaaaagtttcataaattgttaacatgaacaccacatacagtatttgccatattcaaacaattttaacacagtaaaggtacccaaacacgaaactattttaaactttcctggagaatacagtagtcccccccttatcctggttttactttctgcagcttcagttacccacagtcaactgtggtccaaaaatattaaatggacaattccagaaataaataattcatcagtttcacactgtgtggaggagagtgatgagatcctgcaccaacccgctttgtcctgcccaggatgcgactcctccctctgcccaggatgcgactccaagatccacgctgcaggcgctgcctgcccatgagtcacagaggagccgtcgcagtgatcatcagatcaactgccgcggatcacagagcttgaattcaagtagcccttactatactgaataacagcgccaaagtgaagaggaacaatgctggccatttgagtatgccaaagagaagcaactcatgacaaagtgagcccaccccacctgctaccaccttcttgctctgctggcccaagccccggtctgttagctcttgtctctgcccctcgtagggctctgcagcttgagaattaggtgttctgacctgggctggggacggggtctcacctcaccatgtcacccattccccactgggtaggggccaaacagaagggtgataggtctccactctgtcctcaagcagaatctggggtggctgaggatgggggaggacagacgacagcataaggaggggtcaggcagagggaggcccaggactggctgcaggaatgcaagagaaggctccatgggggtgtggcagggactgctgtgggaagggaaggtgtctgggctgaagtccagggaaatggcccaggccaagaaacggaagaagaagacagcgcgtggagcggggagaagggagcagagcagttcagtattactggtggcaaaggagagcccaggctgctggtagggaggatcaggccaaagacaggctgaggaggctggcccggtcactatgctacctcctatgccctcctctcctgtctctcctgcaccccagaggcagggtgtaccacgggcccagtagctcccagcttcccaggctgtcccccaccagctgagccccgaacccttaacctgcaccacgccacagcccctctgccctgcccactctcatgcccactcaggaggccaaggactggccataaacttacgttcaaggacttcctgcaagggtcattccaagatccaaagcggcttcctaaggtgatagaaaggtcccctggaaggccccagggtaaccccgcctggcaccaaagaagtgtcagggcaaagatgttggatggcacagacagagcagctctgagagcatctgtagtcccatgagcttgcagcaaggtgggaaattccatgtgttcgaagatttcaaagccacagaaagcacattcccatctgccaggagaacatagttgatgggggcacatgggcagcaacagcttcaaagccctgtgacaagcactcaagaaaggggagtccagggtgaagaggtgacagaaccagtgatgcgagccagggtgacagggcccagagtgaccggatgatgggggatggactatgggggagaatgccagggtgacaaggtgacagagtgatgaggtggggtgacagggtaccgccccctctccttccccgacattacttatacctggcctccaaacacacagcttgttctccataaagcctctcctcagaagctgccctcaatgtcctccttgggtagggttatttttaatcccatttcacccaccttaggtaaagatagcgctctcaggattaagttgtttctctagatgccctggcactcacccctcatactgcacaagctacaaaggccacatttacgccttagaaagctgaaaaatccatataagtaccctgcaaatgccaagaacctgacctcaaagaccaatttaattggaattaacaccttcacaatgtcgaaaaataaaatacatttatataaaatttacttttcttttagtgaagttctgaagggacaagtaaagcaaaatataaccttatagctattttttcacaataccaagtagcttttttttctttaaaaaaagagaaaagttgcagtgaagcaatgatgtccttggcagtgaaggactcaaattccaactctgtgtccacagacagaggggtcaggtgtttccttatttagagtcattaaacaacaggtacaattctccttcctctattacttgggtacatcctttaagccccggctatgtcttacacacttctgtattcccagaatgggcaaccacaaagaaactgccaatcatttcctcattgtccaaagaacgaaatgttctaatgttgtttggtcccatcttacaaattagctgggtttcagctgaggtctggaaatgaaggatgaacccctcagccagtaccccagagcctgctaaaccagagtctgggggcaaaggaagacgatgaagggtttttagcgatccagccccttggatcccaggagcaaaggccctgttcagggttccagcgaagtgcccctggtcaactgggatttcctaaggccccactagttgggtggtccctggaggctctcatttcataacagtgcaggtataactgtcagcctcacacgcctgaagcggtactgggattcaaacctggggcctgcatgcctcctgggctggctcacctcccgctggccacatgaccctccaaaacggtgtagactcttgatggagaaaagactagaacagctgctcaaggcaaacagacataggaaggtgggaggtaggtcacactgagagctacagagggacccacaggcaccctccaaccttcacgccctagtgcagtggcaaggagctggttaaggacggttagcaaaagcacagcggagtcacatcaggcctatagggaagagtggacaacacagtgggagggcacagatgctgtcccccatgatccgccactggctggaggcagtggactcgcacgttccagcagcgcctgaggaaatctcaccatgcacaaatgacacaccaaggccacaatgggtcataaacgcaaagcttcaactttgcaaactggagctgccaaggacagaaaaaccacaggcatgactgtgatatcctgagatagccaagactagtgcttcaggagccacctgcggggaagaagcagtttttgctgtccctgtcaacctgtcaagcacggatacttcacaactcacatagcaatgaattgccagaaagtaaaataaaacaaaaatacgatacacacccacatttttattcttaagttcaacattcaaattgctataaaatctctaaacacattttctcaatgtctctacttatcatgaactggaaataaacacgacctgggacacagcagtgggtgcatgaagagaccttccttcaaaaaagtcaacattgtgctacaatgagggatgggaggatgggtcctgaagggagagcgtgagccgcccagctctgagctggtcagtctcatctgaagtgttgattagttctggtccttccccttgaagagggctaggcaagacaggagaaaggaaacaggaaaaagtgccacaaaccccgacaaaggaaggatgcctgaaggagctgggggctggctgggtaatgacacataacttcaaacgcagagagacggaagtgatttgctctgcgttactgacaaggccagaagggagcacagtcaatgttacaggaggcccatcttctgaccacagataaacagcctgtccctgagggtcatgagttcccttccctttggtaatcaagtaatatgactctgtgcaaagaaaacagttgaatcaaggattcatgctccaaccaggtacgccatgatgcctttccaagtctgcgtgcgcttgatactgccatctctcctggaaaaacactcccggcaaggtagctgtgcctgctgcctgctctgctggttacctgcctgctgcctgccctacctgctgtaatggcgactgatatggtttgcatttgtatccccgcccaaaatctcatgtccatccccaaggttggaggaggagcctggtggtaggtgacgggatcacaggggcagatgtcccccttgctattctcatgacagtaagttgccacgagacctggttgttggaaagtgtgtagcacctccccttttgtgctcttttcctcctgctccagccacgtaagacttgccagcttcccctttgcttctgccatgattttaagtttcctgaggccttccagccatgcttcctgtacaggctgcggaactatgagtcaattaaacctcatttctttataaattacccagtcccaggcagttctttataagcggtgtgagtgtggacgaatacagtgacacacacacagcaggtaagttttggtttttgtaggtctagtagaaactttgacactttacaacagaaaaggcaaccatctggtctcataagtaaaacaaaaacaaagactttgataagtgatttcacagtagcttctgggcagatagatggcaaagggaaagttgattactaacattgaactttcatgggatggaaaattaaaagaacacaaatatttctgtggggatttaacccccatgataagtaggaggaaaacagaagtgggatataggtatccctgattagatatgtccttctaaaaggcagtgcaaagtcatagaccaatattgtgttctgctcctccactgcttatgaaatcttatgaaaaagataatcaactctagcacccccaatcaaatagatatctgcacagccaagcacacggtgccaaggaaaaaccagacagtggaatggttaaggacataggcttcaggcttgaccccgtacgcctgatccctgatctatcccattacaagctgtgtgaccttgggcaacttaccaatatctgcaagccctggtttcctggaaaaaagaaatagaaaaaataacacatccagaatatttgccacagtaccagagagaggataaaaataacacaggctgggtgcagtggctcacccctatctataatcccagacctttgggaggcagagatgggcagactacttgagaccagaagttcaagaccagcctggccaacatggcgaaaccccatctctgctaaaaatacaaaaattagccaggtgtgatggtgcatgcctataattccaggtactcgggaggctgaggcaggacaatcgcttgaacccgggaggtgggggttgcagtgagctgagattgggccactgcattccagcctaggtgacagagtgagactctgtctcaaaaaaaacaaaaaacaaaaataatacatagaaaatatgtgataaatatagttgtttatattattcaaaaaaaatcagactttaagcccatacttgaggatgatgatgtttgagaagatttaggcattaaaaagaaaagcactgagaataaatatatacatatttatgtatttttatttccatttatttacttatctgtcatatttcattgattttaagacatgccccactccccattttaacattttaaaaatgcaaacaccttacgatcagcacacatgacacatttagggacaatacataataatctttatttcaactgaaaagctgttgttaaaactgacttatggcatttcatgatcaaagaaattcaataagtccaaaattgcaggatacaaattctatgttttattataataattctgaggaggagattttggcatttggacaaaaacttgttctcctcagtctcaccaacattaaacataaacacacttcacagagacgaatgtacctctgttactcagtaggagagatggtctttttctgctttgataatctcatctgcaaaggggagaacatgaaggtccccaccgcgtagcattggcaggagagaaaatccaagtaaagtcctcagcatgatgaccagcatatagtaaaaacctcagttttctcatttataaaatgggtatcatgaaggtacccaattcacagagtcggtggaaggctgaagacaagggaagtaaacaggaagagcttaatcttttccccactgccagcctctgagtggtcagcttgcaggctgtcgaatatgttagttttacagttctagcaggaaatgacatgggatgggggattaatcaccctcccctctacttgtctgcacaaagcacaccactgacagcatcccaggtcatggtggcccatggttggttgttgtacctgtctgtctccctccagggctgggagctccctgcaggcagggttgacatcttgttcacctggtaccctaatacccagccatggtctgccaatcaactgttcataaaatggtaagcgaacaaacaaattagtcaaagttacttagaacatttaaagaatagagttttcaactgattctgttagttacagaaagtgtaaactatttactaatatgtaattaactacctaggatttaaataaataaagccagttaacagcaatttgccagatcaatgaaaagtattttcccaaaccaaatgccatctatttgttttaagtgaatattcacatgattttaaagacttaaaaagattataatctcaaatttacataagtatcgcacaaatcacttaaaaaaaaaaaacttacattcttaaaaataattctacactctaaaacaaaaaaatcacataccagctcatccaaacagtggctcacatttaacagggtcttttgtgtgctaaacacaatgccaaagtttatataagtgtcttccaattttcacaatgacgctgaaaacagaagaaatgtggagaatttaaacaccatgcctaaagccatgcaggtgaatagtagtcaacacactgcctgttttacctcacaaaatatctccataacatagctgctgttcctaagttcagaatcataaccttaaatgacttggaaaaccattttaggtaaatgtcctatcagctggaacagtcaaataaaatttaaagagagacatttcaaatgatcttcgtaacttcccacctcaagggttaagagtggcaggtactatcaacaaatttcttaaagaaaatgtagtctaataaaatgttctttagccaaagtatggggggggggtgtagtacttaaaaatgaaaaactacagaatcactctttcactaaaaataataataataataacaacagtgacagactttgggaatggaattcatttccaggaactgagcccaaatcaactctcggagatgatgtcatctttcagctcctccacgcactgccaaaagattaaggaatctagggcacccaacagaaaatccaaagctgtatgtgatcagcagatgaagtctcatctgaggactgtttctaacccagaaaatggggaggagatgagctgatacaaggaggcccccttgagcctctgtccatccaaaaaggttcattctagcagtcagtgtcccagaaaaaactttcttctgtaaagggtcaaacactacccaactctgctgatggggcttggaagcagccacagacaatacaaaacccaatggccaagttccaataaaactttaattttattttttgagaccgggtcttgctctgtcgcccaggctggaatgcagtggcacgatcttggctcactgcaacctccacctcctgggttcaagcaattctcctgcctcagcttcctgagtagctgggataacaggtgtgcgccaccacgcctgactaatttttgtattttcaatagagacagggtatccccatgttggccaagctggtctcgaactcctggcctcaagtggtccacccgcctctgcctcccaaagtgctgggattacaggcgtgagccaccaagaccagcctccaataaaactttatctgcaaaagcagattgcagttcgtcaagccctgcactagaagagtaggttccccgcctgaagcttcagggacacagcactgaaatggaaccacaacacacatcttgtggtgtcctggggctggacagcgtgtatgtgcactaatgctgttgccattatctccaccaaaagctgaggctctgcagggcaggatggcaaggagagtttctaagatggctcatttctaagcatgattgtttttaattcagaaatcagaaaactatgaaaataaaaacattgcttttggaaattcaacagtaaatttaatcacctacataaaattcacatgcaagttgtttcatttctaatgctcagttcaacattgtgtacggaagtttgtagccaagcacattttatttcctattttgcatttttctgaaagataataaatgttgcttttatttaccataattttgtcataggtgcataattccttcttcaaaagcctggaggctggacatggttaagaattaagagttttggggaatggagaatgataacacagtgtccacatcaatgaacacagatgtgcagggcccagagggagctccataaaccccatcccacttcccaggcagaccctgtgttcggcaaagctctggactctgccgtggcataataaatgaggaaatttcttgcttcagaccttttgattttaaaaatggcagacaatgagctataggaccctactaacggagccccccccgaagaccaaggcagccggccctctctccccccgttgtcccattttatttgcttcagaattagtatcattattcacagctatctcacttgccagttgttccatgtctgtctcctccactggaatccaggagccccaaagatctgtctgccgagctcaaagctggctccctagcccaaaacatgtgcctggtacctggctggtgctctatcaaagaattaaagatcacagcccttgactcagcttctaaaggatgaccaggcgccgggtaatttagacatatttcctctaatccctgctacaacccagataccactaacccttttctaccaaaacttcggtatggaaactgcggtagggaaagttgcaggatttctccaaggtcagagaattatgatgtgtcacattctaaaggaaaaacttaagtcttaaaagtgaagtgggtcatccccaaccttgccagaacccctccccaactgctgccctccaacagcaggatgattaaatgcatacagtaattttggtgcttctgtgcatattttaaaaatcacatcagtgactcacggactgaaccatctatctaatccaagccactgctgcaagtgaacagctagaattagaaaattatttgtatgttgaaggttttaagaataaatttttctctataaaactctggagatttatctaattattataatataattacgactgctcaagactggaacccattgtaaatcatcccatattctgagaaattctggaactgtcatcttattttccaggaacaagggacatatgccgccaagtcttgctgtcaaattttttaaagagtaagacagtgctttcaaatggccctgagaagcaatgagtatttcctcaaagcatgacagcacatagcagggaaagcccacccttccttcctgacttcctggctccaggaaagcagcctggggcatcggtgactacaaacacctaacaaggccatcaagggaggaactgacacagcttgtaagtctgccacttctgtaggtaccagcaggaaactggaaatgccaggaagggaagggaagctgacagaacctctgtggccattatctggccctaaaagcctattctatacccagccgaggacagcactacgaaaatgacctcaagagagactttcccttggggatgttctttgagctcactgactgcactctcttgggactgagtaggaagtggcaggcaggggtgaagggtgcagtcgggcccggacaactagctaacactaactggccacacgagaactggacttgtgacctgtgggtgcagcacagagctttaatcaatggggggaggcaaccacagcctctttaagaacaagaagacaattatgcagagggagaggcagatgcctgttccagagctcacaaactacacagactcaggggtcaccaccaaactttgcagttcgctaaggttttaatcctcttttctggcttgtaaccaattttggctttgtgtcacattcgacgattagaatgaacggtattcctaatcttcagcctttcttcgaaggcttgcttcacttagataccaaaaaaaaaaaaaaaatgttcaaaggcatctttttgcagccataatgctgtaggcaatttctcatcacagtagctaaaaagagacttcacagactaagagagaaaataagttcaaagaagtgcaaaaagctgaccacagcctgaacatataaaaggacttccaaacctaggactgctccagccgaaaagtcacaggcctgggagagatggtgtaagtacttccaatgacaaatcacgagtaaggatgaaccaggattcgcgaatcaaatctaaagaaccaaagaccatcccctaacaatgaatctgtctacaccaagtgaaagttcaaataaaatctgtttcagaagatgaagggaacttgcagatgaaactgttctagcagcccatgaagaagagctagagaaagtgaaggaacagaaatgaacttgttctcccacaaaattccacctagggctctcaggaaaggaaagagccaatctgtggagaggactccctctagaacatctgttaagacaccaagccctttctccttcccactccctcacgcgtgagcacatgtgtccaggtgaatgtcccgacaaccaccatcactgcagaacccgtcatcaggagtgtctggcccgacccagaaggtgaaaaacacagtgagtgcttgcttcattccaaacacggaagcccggctctcagggggcaactctgtactacaaccaaactcttttagaaaagtacgcacagtcaaacgggaatatgaccacgctatcttacaaggcaaagcaagacacagaagaccgaggcagaaagggcagtgggcctctgcaccatgggacttgtcaccagcccctgctccagcgtgtcctagtgacctgagagctacagaaacgatccatggctgctggcgacatgtgtgccctggccctcgaccagcaccatcgggccaggatcagatatatgtgctcgcccatacctggtagtacggatggtgcaaaaaggaatctgggcagccggctaaagccatgggttccttctgccttcttcaaattacatttactgcgctgcagcacctggaataaagacagactgtgagaagccaagccagaaaaaaaaaaaaaaatccactacttatggctggttcaagtgtgacatgtctgaatgggcagctcttggtcttagcttgtaggttcagtaaggacacttgctcggggcaccagctttttgctgacatgcagagatggtccccaactatggtgccctgagaggtcatctgtgaggtcaaaagtctgtggggtagaagggtgcccagagtggtgagggtgacatcagaccctctaaatttaactcacacattcccagcactctcctgcactgcctcacccttcttccctataccatctattaacaccctgcaaacttcatcaagctttcgcaaatagggattcagacaaattccaaagaagcccagaaggggttgtgtgtgtgtgtttggggacaggaccacagaacatcatttgagtgaacactagctccacaagccatagaacaaatcggaattctcagtggacatccaacctgacaaactcattacatactctcccctgtgggccacggcacctagtaccgaataaaatgagggatattaattctaacaatcagaataacaacaacaaaaatcaagacaagaccctgttatgggatgaactgtatcctcccaaagttcctaagctgcagccctaactcctagtacctcagaatgtgactgtatttggaaggagggtctttaaacacgtcactaagttaaaatgagatgatgagggtgggccctaatccaatacaagcggtgtttttgtaagaagagaatattagaacacagacttgtacagagagaagaccatgtcaggacaccttgagaaaatgaacatctgcaagccaaggagagaggcctcaggagaaaccaaatcggccgatacctttgatcatggacttccaatatccagactgcgggaaatggatttctgctatttaagtcccctcgccccctccccagtctgtggcactttgttatgacagccttactaaactaacacagacccaaaatataaaatcactagggaattctcatcacagctaaaaggaacagaagcatcccagatctgtaaaatttactaccaaccatgttttctgcaagagtttctctagaatccctcaaatcaccaaagaacgccccagaacactttgctggggctgaaaggaagcagtcaatagcagtggaagtactggcacaatgaagggagcaggtccatgacctggctcagacgtccccaacctactcagtgagaactgtgcccgcatccacccttcacctctgccatgatcagcagccccaaggcctcagccttctccggctcacagtcagcctgtcctcggggtagctggtgttacacgtcaacagtccaggctctaattcccagtcacttagtcaaacaccagtctggctattgccatgaaggtattctgtaggtgtggttaatgtctacagttacttggcttaaaggaaatgacccttaacagaggcattacccaatccacagaaggccttgagagcaaacactgagatttcctagagaaacaagaatttagcttaagactgtagcaaactcctgcttgagtttccagcctgcctgctctgcagatttcaaacttgcaagttccttaaaataaatctttatatattgaatacatatgaatataaatatttatatatttaaacatatatttatttattttcatacacatatcggtttgggttcactggacaggccgtcacccctagccgttgaggtggatcagtgccccaaatcatttgctgccagatcgcaggaccatgcctggatgtctcctgcgggcagccaggcggcctctgccttccacaccagcaaacacactcttgtgcgactcctcactctctacctcaccccaccacctcccatgtcctagccccatctctaaacactctttctgccttctcccctaactgcaaggacctgtttctctccccttcgcccacatctctgagggcctgggagaggaaggagtgtcctcttggccaccttgcccgctgggtgacagttctgccacatcccaccaggctgcccacaccccccacgcacgccgcacgcctccctgctgtggtcatctcccagtctcccagctcatccgtggagactcactggccctcactaatatgccttctggaattcctggatgtgtttgacatatagaaatatgttcttattttctccctgaagtttcaaacttaatgtgtgttaagactgtcaaaaatatcacttaatatgccaattttattacctaaatatcacctttgaaagtatttgccaaaggagatggcttctccgccaggaaaatgtgtgtcccataagcccagtggaacagtttccttgggacaagtaaactatagttagatacagtaagagggctgggctatctctggtctctaataaaatgtaaccaatccacagctaacatcatgcttaatggtgaaagatgaaaagcttctcccctgagatcaggaacaagacaaagacgccaactttcaccacttctattcaacatagtattggaagtcctcgccagagcactgagacaagaaaaagaaataaaagggatccaaattggaaaggaggaactaaaatcatcaaggttcagagatgacatatgacataatcttatatgtaaaaaccctaaagattccataataaaaaactatcagagctagtaaatgagttcagcaaaggtacaggatacaaagtgaacacgcaaaaaccatttgtgtttataaattaagaacaatccaatagataattaagaaaacaattccatttacaatagcatcaaaaataacaaaatacttagaaatacatgtaatcaaagaggtgaactacttgtacactgaaaactaaaacattgctaaaagaataaagacataaataaacggtaagacatgctgtgttggaggaactaatattgttaagatgaaatactacctaaagcaatctacaaattcaatgcagtccctatcaatatcctaatgatatttttttttgcagaaacagagctgagggtgtgtgaagggctgatcttgtgaagttctgtgagcaagctggctaagattgaaaggggatgatttaggtttttctgtaggttgaacatgaaaatgaaagcacactgatgcagggccagaatgtgggcccatgtgtctgagtaacagggtttccttaaaaaaagtgatctgctattcaatgaaaaactgtaaaggactctaaaaagtttatgaaaatcttaccttatggtcaaactcattaaaactaataaaaactaattaaaactagacagatttaaaaaattttattaaaaagtagctttagcattaaagatgcactaatacaaacatgaaatttggttttctcttttgaaaaagacgtttatataatattgtgatatatataaaatgaaagattttttgtttgccttttgagtaaactacaggaaaaaaaacaaaacagaacaaaacaaaaagccatcctaaaattcatatggcttctcaagggacctgaacagccaaaacaatcttgaaaaagaacaacacggagaactcacacttcccgatttcaaaacttactaacggctgggcatggtggctcacgcctgtaaacctagcactttggagaccaaggcgggcggatcacttgaggtcaagagttcgagatcagcctggccaacatggtgaaacctcacctctactaaaactacaaaaattagccaggtgtggtggtatgtgcctgtaatcccagctacctgggagcctgaggcaggagaattgcttgaacctgggaggtggaggttgcagtgagccgagattgcgccactgcactccagcctgggcaacacagccagacttcatctcaaaaaaacaaaagaaaacaaaatgaacaataacaaaaaaacttactaccaggctacagtaatcaaaacagtctggtactaacataaggactaacatacaccaatgaaataaaacaaacagcccagaaataaatcctcacatatatggtcaactgattttcagtaaggatgccaagaccattcgctgaggaaaagacaggcttttcaataaatgaatggttctgggggctgagtatggtggctcacgcctgtaatccccatactttgggaggcagagacaggtggattgcttgagcccagaagtttgagaacagcctgaacaacatggtgaaacaccgcctctaaaaaaattagccaggcatggtcacgtgcactgtagtcccagctaattgggaggctgaggcagaaggatcaaattaagcacaggaattgaggatgcagtgagctgtgattaacgccactacactccagccagggcaacagtgagactgtttcaaaaaaataaaaataaccaattttttttaaacggtcctaggaaaactggacatcagcatgcaacaaaatgaagctggactctaaacttacaccataagcaaaaagcaactcaaaatgtatgaaagacctaaacgtaagagctaaaactataaaactcttagaagtaaagacagggaaaaatcttcatgacattaaatatgacaatgatttctcagatatgacaccaaaggtgcaggccgaagaaaaaataaactgggtttcaccaaaattcaaaatgtttgtgcatcaaaggatgctatcaaaagattgtaaagacaacacatagaatgggaaaaaatacttacaaagcatttatctgataagggattaaaacccagaatatataaatgatatggtttggctctgtgtccccacccaaatctcatgttgaactgtaatccccagcgttggagatggagcctgatgggaggtgaccggatcatgggggtggtttctaacggcgtaacaccatccccctagtgctatctcatgataaaggtctcatagcatctggctgtttaaaagtgtgtagcacctccctcttcactctttctcctgctccagccacgtaagatgtgcttccttccccttcaccttcctccatgagtctaagttccctgaggcctccccagccatgcttcctgtacagcctgcggaactgtgagtcaattaaacctctcttctttatctcttctttataagttacctagtctcaggtagttctttatagcaatataacaacagactaggccgggcgtggtggctcacacctgtaatcccaacacttcgggaggccgaggcaggtggatcacctgaggtcaggagttcaagaccagcctggccaacatggtgaaaccccatctctactaaatatacaaaaattagccgggcatggtggcaggcacctgcaatcccagctactcaggaggctgaagcaggagaattgcttgaacccagaggcagaggttgcagtgagctgagatcacgccattgcactccagcctgggcgacaagagcaaaactctacctcaaaaacaaacaaacaaacaaagaaacaaaaaaaacagacgaatgcaataaagaatgcctacaactcaacaacaaaagacataagcaacctcatctaaaaaggcacaaagggcttgaatagacttttctccaaagaagatatacgaatggccaaaacgcacatgaaaaggtcctcaacatcactagtcgttagggaaatgcaaatcagaactgcaacaagataccacctgacactcattaggctgactgatataaaaaataaaaccacaagtattggtgaggatgtggagaaactggaacccctgagcattgctggtaggcatgcaaaatggtgttgctgtggttgaaaataatatggtgattcctcaaaaatattaaacatagaattaacatatgacccacttctaagcatataatagcaactccacttctaagcatataatacaaactaatcaaaagcagaggctcaggtacttctatacccatgttcatagcagcactattcacaatagccaaaaggtggaagcaacctaagtgtccactgatgaattaatggataattcatcaacagacaaacaaaatgtggtatatacatacatggaatgttaagggacacggtctccctctgtcactcaggctggagagcagtggtgtgatcaaagcttgctgcagcctcaaattcatgggatcaagcaatccttagcctcccaggcagctgggacttatgggactagaggagttcaccaccatgcccagataaaaagctcacttctgaacatcctacagttatacaactggatcatctactgtgctactttaaagagttcagattctaaatcatcagctgatttatcaaaatatgtgattcatattcacagataatgaggaatagttttataagccagtagatagatagcagctttctgtctataataactaaagactttctcattaaccgttgtcagatgattaagaaattgtatcaatatctgttgtctttttgcttcccttgattaaaagggcctactaacaagtttggcttgctgtggtggtttcacattgttcttttaatgtcgaaggttaaaccctcctttgcaagattatcattataaataatatattaaaatttgtttattttaattaatgaaaatttaaataatcttcatgataaagcttaaacttctttattggactatagttcagaaaaatcgttcaagcagagtcaaaagtttactcattctaaagtcaacatttttcttaacaatgccaatatttacacttctggatccagcagctgaagttgaacgtctttgtgtttccgattatatgggttgttttttgtttttccatgttagggcaacttgtactagttaaattaaaatgatacaactgtcataaacttcaaaaatgttgcacccaataacactttttctgaaaagtacattgggtgttcctaactgaaactctagagtctagcagactgtagatgatactcttaggccctcacctcgcagctaattgcaaattatgtttatggtggatttaaactgtagagcgtttaccctcccttctgaaaagatagtcaaatagacatcttctaacccaatgccagtaagcagatgaccaaatgacacatccgtgaccaatccatgctcaccttgtctatcccgcatggcatgtggctcatcacacatggcaacgtactaagtgcatgctaagaacccatgcaatccactctcatatttccttttctgttctactgtatttattaaaaacgcttttcatgacctactaacttgatttcaagacccggtaacaggttgaaacctacagtttgaaaatagggcagggctgtgtttgggcttgtggtcaacatcggggtcaccaacttcagttggagggcccgctccctcacgtcccctcccatgcctgccccttcacatccaagtgctgtccagggcacagagaggctggcccactggcctttctctttctattccctcttcacccctcagtcctcatttctctcctccctgactcaggagagccagaaacattcccagcaaacaccacagctcttatgccacctcttcctgtgactcccgctctttgaaaacacagctcatctgcttaaaggaacctagccagcccggaaactgtgtgaggctggagggaaagtcatgtgactgtgccacatgaatcctttcttttgttatttagccacaaatccaaaatgtgcatttaacagtactagaacattttactgcattccttaggaaatctacattgaacgtgtgtttcagaatttctcctctctcccccagaacactggcccccacttgccagtcactcagatgacagtcgcatgtctgccacacctgacccattcaagtggcacaccattctagctcatcgccctggtgtatcttctccatggcaacaaccacttcctgacagcttcacttttgagacagtcacaaaccccatcttgttcaagaactcagtcttgttccctgccatacccagaacagcagatagtaacagggacccaagaaagatctgctgactaataagggtaagttgtacaattaatgatgattgggttaaataataaaattcaattcaaaatttaaaattttagaaagacgttttgagtcttaaatcatcatagaattgtttttttaaaagctgtaccttccataaaagccagaagatcctactctttattaagaaaaatataattgagcaatgttcacggtatattaaaataatcacatgtagaatggaaaacaatatttacattctaagccataataaaaacattaaaagaaactcataattctttaaacatcaaagggaaaatagatgaagacacattcattcgaaacccaaacaatttgcaacagaagagagaagacatagcagtaaatgtcagtcatccaattctccttttcaaaataatattcaaaaccattctaatgaaaaaaaaaaatacccaaggcaaatagaaaagctttaaaaagggagctagaaaagaaaaagacagaatggacagatataaaaaccaaacacaatgcaaacaaaataaaagcaatggtagcaatgatagtcaagtgtcacttaaagcaaagaaacaataatccaaatactaaaaagcattgataaaagcataattgataatgaataaaaacagtattatcctccaaacagcaaagtatcaaaatacaaagagctaaaattagaagcaagtttaataaaaagtttacacttcaataaaaagtttacattaaaaacaaacactatgagagtctcaaggagaaaacgaggaaaactagttgttgcagatgttggtctattatgtaggacaaagaaataaaattggaatgagtaatgagaaggcattaattgatatttatgaaaaacaggcatttgcaaatatttataaacatttgcaaaattattattttttaaaaatactaaaccacaaagaagagtagtgcattttacaaaaatgcaaagatctctggagttgcagaacacggccccaaggaaaaacctgttacatgctgcctcctcccagcctgcatgcagctgcagacaggaccccaaatgtccagcactgagacagggaccgtaggccaatgtgccaaggggctccatgctacatccaaataaagaaaaccagaaattaggaacatgtgtttaaaaaaaaaaaaaaaaaaaaaaaacgaaggcacttgaaaattaaaaacaagctctggcctaaataagtggttcaaggaggaaataaagatacaatacagtcctagacaattaggacaatgcacacccccatgtgtcaagacaaataaaatgaagcaagagaaataaaagaagaaaaactcatgccatgaaatgcatattttataaagacaaaataaatgaacaccaacccatccatcttgaaccagaaagagggaaatatacagtcaaaaatcggaaagcaaagcatgacaaaattgaaatccaagaaatataataaaagacaaatctcttaaatgtatagtcaaaaaaacatacaaaattttaaacaatgaaatacaatgatttttaatcacacagtaatttttatgcacaccagtaaagaaataaattttgaacattactgaaattttaatttttacaaaaaaaaaaacccaaatcagaatcatctaaagtaaaaacacttaaaatataaacagtgaagatgaaactgagtaaaacccaaactccacccacctaccaatataaagaaagtgaatggacttggatggaagaaccaatcaatgaccataatttgtcaagggaaggaaagaaagattctgaagcacctgttaataacaggcacttggctcagtgctttttatgtatttgtctatgtgtaaacacacgcgcacgcgcgcgcgcacacacacacacacacacacacacacacacacacacacacacatacacggcatccattcccactgatcacaacaagaaaatgaagtgctgagatgaaggccaagggctggtgatgggactcaatgaaggagacgaagctcagtgcaggagtccatgctcttaaccaggatcctacaagtcctagggttttcaaatgatggtccccggacatacagcatgggcatcacccgggtgcttgttaacacacaaattctggagcccagaccctgacctactaaaccagaaactcagtggagggggtgtggtcccataacatgtgtttctgcaagcccttgcatgattctactgctgacatagtcccaactactggactgcatattacatcactagggggaaaggggaagactctgcatgcccaggctgcatcccagaccaaggaaaatgaatctcggggatggggagggggtggggggtaatagtgttaaaagctcctcagctgtttccaaaggtaagcaccaccactcttttctttaaattactgttggtttctatgatgtctgcagggggaaaatattggggaaaaaattcagtaacgctttgaagaatcatatctcacttcctgggggctgggaagggggaaactgctgctactacactgcttgaagtaaaaactatactcggttcctcaaaatgccctaactgaatcctaagtactagatccctaactaaaagctgtacctgttctgcttcctgcctttaaaaaaaataataactcttgggttttttggcatatgcaaatacaaagaatgccttttagaacaccaatttccgcttttcttccacaatgcattgatgggagaagggggagaagggacagattcaagagctattttaattatctgcagcaaagcatgacctcattgcttccaactgcacattattaggtacaagggtctatatgtgaccataggtatgaggatgacctttgattttttattctcagcagtttgaaaaagacttgtgtggcatattctattcaagcatctacagttccttccacttcagtagtctggtcagcctcccgacagaaaagagtaaattttttaaatcaatacatgatcttgaatctgtttcaatggctttgaaacgtaagcgtgggtcagatcacgcagtgctgcgaagcacagcaccactttacggtggccacatccctactgtcatttgtgggaagcatcaagtcccctcaagaaacctgtgcagacacactagcagcatccccactcaaccgatgagaaagaatccaagtaacttggccagcagttactcctgttgcacagctgcatagttaatttgagatatgctctccgcaaatccagagcctgagtcctgaaggggacagcacagaaccccaacagcaagatcctactcaggagaaccaggagaggccgacaccagaaactaattttcactttctaggcaccctcaccactagcactggtgtcagagagaaggtcttcccttttgccgtgctgtggtccacacacagacatgaatgcccagggcaggactgttaatgcagtgatccaactgatctgagacccagaaagtcaacagaaaacttgagcaaaggtaaccacagaaaacagcctaggctatccacaggcaggaggtcctcgaatccctccatcctaaaagcctcaccagaggaaaacaccaattttctagccctgaaaagaggtggggtgatgaaggccacctccacatgcagccttctcaagccgcattcaccgagagtggatacccctgctctgtggtaggcatgtgcagagaagaggaacccatgtgcacaatgaagtctagacacactgtggaacaggtcagagtactgcctcaatcgtagagattaggacgcaggcgctgcaacaccacgaccacaggacttcatggaaaagaaaagaaaccgcgtagaaccatcacaggccggcaggctggagtcaaagaaaaggacggcagggagggagcagtatcaggtgctccagagatcaaagcatcctacctttatgcaccctgggaatattggcatggagaaggatggggagagaagaataaacattacacagctgagcactgaacaaggtaggagttggagcacgaacatcccatgcagttaaaagttcatgtataattttttactccccaaaaacttacctactaatgacctactgttgactagaagctttatcaataacagaaagtcattaacgcacatgttgtatgtcatatagttattacatactgtattcttagaataaagtaagctctttgggagcacttccagtttcactagtatgggtcccctgtgttattcaaagtttacggtattgcattaaacatgaaaaatacacaagacccacgagaggtcactttttaatgcaatgagcaatttactgggatgggagcttctcacatggagatgattagcatcacatggcatttaaagcgtatacttgcaacatttgagctcacagcaacagtggaattattacagtagtacagtaattttcataactatgaaattaagtgcagtatgtactacagttaattctatgcagtgatgatttcatacagcaccttcatgggtttttttacatttctgtcaacaaatggctccatgtatggtctgtgtttgtgtaagttttgacaaactttaacttttttatgatttgtatatattttagagtaacagcctagtcttctacatatattttatgcattcatgacatagccttttcttaatttttttggtatttctcggctatgctgtaagatttttcaaactgttgcaaatctcaaaaaaattttctagtaattactgaaaaaaactccacatataaatagactcacacagttcaaatccatgttgttcaagagtcaactgtaattttaaatttgcaatgcgtattacttaaatatagatttaaaattgggttccttttaaaagaacttattgttctctgatatattaatatttttctaaattcattaaagatttgtttctacctttggaatccttgatacttgaattttacaaattcttacaaattaccgaatgcctttgggtgtcttccaaggaatagatctttgtacatttaaactataaaaagagaaacaaaaattaagacaccaaatcaattaagacaaagaggggaacaattgccatgacaacacattaccaactataacccccactggtccggaagcactgtcttcctttgggaatagataaagccaacgggaaggaaaagcaaaaccactcagatctgtctttgccgcctaaaaatagtgaatttcataactgttgggaaaacggctagaactttatccgaaaaataaaagatgctctataaaacagcccttggatttaaacactttataaactaaatgcgctccaaagtcattccaatcaatattagatggtaaaccatttgtccctataataaaacccaaataactcacagaagacatctttttacctaaagaaaactttttaaaggcctcaaaaagttaatcactctttctaaacgctaaagtagttaatcacactttctagatgctaaagtaaactctctggctaaattaggaaatactgaagatagtggcatcagatcttaatctcattcttttggcaaatcttgaacaaggcctgggatttgctctcttcccaattaggccccagagtccagtatctgagctgtaaggacgctgtcctgggtgccactgagagtaggatgtggcagtgtgaaaccatacaagctccacaggcagcctggtttcttcataatctgtacagatggttcccaacttgacaatggttcaactcaggatttttcatctttatgatgagttgatgaggatgtaaacccatttttagttaagaatctccttacaacttaccattgggttatagtttctactgaacacttgtcgatttcacaccatccaaaagccaaaaacacaaagcattattagatcaaaaattaaaattaaaacagtcaaaccgtcattaaatcaggcaccatgtaccgtgttgccagcactgaatgcattttcaacttacgacatttgtgtcttatgatgggtttatcagaatggaaccctgtaaaccaaggagtgatttattttcttttatacctaagaccgggattctaatgaaataagggaggagcgggcaccctctggtgacactgccagacccaggaactgtgtggactcctgtgagggcctttcctcagcagcaccaaagaggataatggcaatcaccaaaaactacctgcagaccctccctgctgtgctgcaaatcttcattcaccctcagctactcactttctccacaaaagaggctttttgcctactgccctaaacctcccatccccacccttttcagtgcagcatccccaaaccccttcctgcagaacacccatatcacttcagggcctgcacaccacccagtctctgccccccgggcctccagtccccagggctcccctggcctgtccctgcgtgagccattctgtgctctcgcctcaattcatgacctcttcctgcccatgtcctccctcccttgggtccatgaacatttgtgtgcatttcccacttcaggagggaaggaagggaggaagcaaagtgacatttctcttaagcatgtcctcctctagctctagccctttctctctctgcatccctctgcaagtgttgacaaagcatgttcgaaacccgctgcctcctacccctcaaatcagcagtctctccaaagccccagtttctgcagcgaaattctctctaaacttatttgaatcattaggagtttccatcatggtctcttctcactctcacagtcatggtcgctgctggtgggcactacaatgaggaagccaggctaaggagagacacacgacctatccctgagccatgagcccaggcgcggtagctgaacctggcctggggctgggattcctgcttttgaggaggaaacccgcgaagcagagcaggtccccaccgttccctccaaatccacaaaacaaaggcgcttacagtcaaacaagttcaggttttctataaagtcaaatgttttcctttcttccagtgcttctttgagcctttaatctagcaaggcagctctctcaagaggaaaagtggggtgaagcattttcaaagatggttttaccctctctccaaccctttgggatttttctccctccaccccgcttctccatttcacccccagagctgactgggcagacacccaccacgctcactgttgagggctctgctccaacgctgagagaaatggcatgcaagcatggagcagggcagctccatgggaccccagcttctctgctgaaaacaggccgcctgggaggagagaagctgagaaaccagtcagcagaatcctgcacccaggccttgatggatgctcaggagagaagtggtgcattctgaatctagcaggtgggacacgtgaaagaaaagcggagtggagacctcgggcctgggcaagtagaaggagggcgtctccagacatcgagataggaaaggcgtgggagatgatgaatgggcaggatgcatgtgtgcagataggaaattctagaaggcaagatgcatgcacaggtgggattccagaaggcaggaagcatacctgcaggtaggaaatcacagaaggcaggacacatgcgtgcaggtggcaaattctagaaggcaggacgcatgcgtgcaggtgggaaattccagaggataggattgttctcatccccgcctgatgatgctggtgacactgttatttcaggatggggagggagtggatctgctctaataactgaacgtaatcactcaccccccgccccatctttaacggggtcctgtggtttcggattaattaaggaagccctaggtaggggttttcctcctctctgcctagcaccctggaggaggccccgtggcccatgacggagtagccatgtgctggtgttagagatggacatcagacagtgcacacctacctgctataggccaagtgccatgcagatggacacgagtgggcaccacaacagccagggagagcgtcacggcagatgtgagagctgagctcgggaaagtgttggaaattaggagtggagaaaggaggtaggagaaacagcataacaaaaccagaggcaaaggcacacacaacaggctgggagaatgcggagaaaatcagggtaccagggatggggtcgggtaaaaacaagcctttgtggaacatttataatgggccaggttctcagctaagcgctgacttccattttccttctcattcttcctaacaataccccgagtgtcactgaggaggagcctggagttcaggaatgtaagcaaccccagtgtttagctgctgtggcggggaccgaggcctttggaccccatagtgctccaggaatagggaccagttggggtaaagggcaatgatatccatcttgaccacaaagactctgaagtaaaacaatcgaatttcatggagagagtgagacccacgtgtgcaaaatgtaatttctctaatcctcaaaacagggaaaagctaccaggacatttatttccaaaaggccataagaaatcagaacctctactttataaagaggtgctacattaaaagacatattaaataaaaactcttgttctctcacctgtaaaagggtggaatgggtctagactctacaatctagaggatgccacaatttgtcaaactcaaatggtctagatgtttacaaacacgttagtcaattctatataaaatgttgggtttttttgttttgttttgtttttttgtttgttttttttttttgagatggagtctcactctgtcatccaggctggagtgcaatagtgcgatcttggctcactgcaacctccacctcctaggttcaagcgattctcctgcctcagcctccagagtagctgggattataggcactcaccaccatgcccagctaatttttgtatttttagtagaaacagggtttcatcatgttggccaggctgatctcgaacacctgacctctggtgatccacccacctcagccttccaaagtgctgggattacaggcatgagccaccatgcctggccaaaatttgtattgttataaaattctttaatgtataattgtgagatggaattttaaataattttgctttgataaaagtagatttttttctactctggccacactcatcctatattaccagagcttctataaataatctccaggagttcttcttagaaactttgtataatttgtggaatttgtcattttcaaagcatttttcttccattggttctaaacactgcaataactaggtaatcatcttctaatgcaatcatctacatcaatcatgcacactctggacccccagtcatcaactcgttggtctatgaagtaatccatcaaaataaccattaacagtataaagagagggcacctttgaaatgttaccctcttctctcctccatcccgtctttgggcccacagctctattacttctgaaagcatgaaatgctttaaatgtaggtattcaagcacagtttgtacttatcataaatcttattgcatgttattacattcctccatcttcctttaattgaaactgtaacttaaaaaaaattaatcttcttttcaacttaggacagactgtaacagcctgttgatcctgctactcccttggtgagattgctgccaggctggccccactctcccaggtgggggcaaagaaaaaaggagaacctatttcgtgaagacagttggaatgtctggcctgcagattgtctacagaagcacagaggagccctccggcagctctccgtgggaaagcaccctaaaaccagctccctctcaacctcaggaactgaattctcttgggagctgccaaggcagcaagttctttgcaaattttatcttctttttttaatcataaatttcaaggatgatcataagcaacatcttggtcgactctgctctcaccactcatatataaaacctttctgaaaagttgagttaactttgaatgctggacaaagaccaaaataaataaaatgaaaggggctttcctgcaccgtttcttgtcttccacctaagcaggtgcgcacgcggagatatccaacggttgccattcaccctccatttcagggcaatcctgttcaatagaagctccaatgatcacagcacacgttgagcctgccgagagtctctcttggggcaagacatctagaagtgctagggaacgcagtcccacaattccaataaccaactgcagacagaactatatagatgagtatcacgcttaggtttcccacgcccacccccatctgtgaagtcaaacagcctgttgtcaataccagaagagacaagtttgtacatcacaaaagacaagcaagtccccaatctaattatgccagccactttagaaggagagcaaagacagcagacactctgggcaatgaattaccctaagtctcagcatcaagcctgcactcatctcctgggtccccagataactcaccactggtcagaaggatggatgggcccttccaaatcacagcctgggctgtctgaggacagctctcccaggaatcatctctacccacctaggacgtgagtggagtcaataaataagggtatgctctgagggtccacagtggcttgcttggcccccaagcctgcaaatcagactcgccaagaatgaatgaaggcattgacccacagggaccgagagctcactgaccaacaagagagacgccatgtcccagcctcgacttgccttggacactgccctcctcaccactcctacccctctgtatcaggccagagctcagactccaggtagacccacagccatgtccaaaccagacacccaagacctcagcaggaagaaatccaatccaaaaagaaggaaaaaaggaaggacactgctttcctagaagcctagaaagaggctcagatacagaaagaaagcaatctatagaagctgtgtctgaaacagcaaaaacctggaaacaagccaaatgcccatcaagaagtggatgaatgagccaactgtgatgcatctatacaatggaacactactcagcattaaaaaggagtgaaatattgatagacgaatctcaaaataaatagccaggggccagataaaataaattgattcctttatgcaacactctaggaaatgcaagcaatctatactgagagaaaacagaccagtgaaagggtgggaaggaagaactgcaaaggggcactgggaagtgtgggaagtgatgaatattttcattaccttggttacttgatgatggtttcacatatgtcaaaatgcatccgtttgcacattttaaatatgtgcagttttctgtgctcaatgtattgtatctaaattgagctggttaaaaaaagaatgaaaacaatttgggggcaggtggatagcaaggaatttggtgaccaagaacaagtggagtgattctccttatttgtggtatagttaagggctttaaagtcacctcaaacactgaattagtgaatggtgagtctttggccctaggggaaatacagagttaggtttctatgagccagtcacattttcatcaaccaatcaatatgtaacctctttttatgtgtttctgtttaaagacactttacttaaatatactgttgaggtatctcgttggctgatcaaggatgccaaggggcatgaatgatgcctgacccaagcttcccagcgcaatccagtggggagaagctcatacaaaaccacagagtcagggtgtgcaggttaagtgccccacgtgaggcagaaacaagacaataagaactccacagaagaatgtgagagggctctcctatggggaggacagtgaagcaaagttattaggggggaaaaaatgaggggctacaaaaatagaaaaggataaacaggagattcagggaggctcaagttacagaagccaaaagttgagaggatgtcaaaaaaggaaggctgaggcaacatcaaggtacttaagagtttctctttcctacgggaaaggctatgggacaccttgaggagcaaaacggttgtgtggcacaactgtagaagtttcctgcccttggaaagagaaaggtgaaaggcataccattcttggttagtttctgaaagttttttagttcaaactgtcctataaatgggaaagaaccatgcatcagagcatctgggccagagaaatggtccctatccttagccaagctctgtgtcgctaaggtagattggtgtcatgataatgagccctcccctgactgcattccaagggtgagcagggccatgagagttgccctcctgtgtgagtaagagcccagcaagagctgtaccatcgcagctgggccggtctccacaggccaagagcaggagaacagagctctttccttgaggctgagccccgcaaggcagaagctgctgcatgaacactgagtttggggatgtgatgctttgaaccccaggcaacccctaaaacttctcccatgagaacaagacaagtaaccaaaaatggggacagaggaaagctaagctatggtccccaaggaaccacaggcctgagggaaacgctcagaggtctctttgggcccaagagctaacgaatagaaactgagaccattgggaccatttgagtatttctgcctctccctccttgaccccaaaacaaacagggctggctcttagaggcagtgagcagcgaaggacagtgggagggttgccctgaggcccagctgattcccccaagtctagtgccatggcccgtcactatagggtctgggattcccacctcaggccccaccacatccaggcctgggtgccctcatctgagacactctgcaaactgaagtctactctgacaataactagctcttctcagactctattattttgatttgtagcatctttctgaaaccccaggggattgggcttcaactgttaggtcaagcaaaacgtgagttcttaacaggatatctttctaccaaaaatacattccttgcaggcaggagctggggccatcttgtgaccatggtgcccggcacctggacagtgccaggtaccaaatgggtgcccacattcactcattctcttgttggacaagagggagcccatctgagagtcccaagtcaaggaaaggtttcatggcttataaagtttggaaactacttcccagagcactccctggaagaccatgcctcattcaatacctgctgacccctcaaggggctcaaacttgtcaagtgggaccacagatgaccacagactcagcgtctccctcctggaggacagaggaagcaccccaccaaatggagccaccacacaggtggacctgctctgtaagctgccagtgatcatcagatttcaagccaaaaactcaaagactaagtgggaaacgaagttttgtttcaatgccatgtccatgccaagcagtccataatcaggcaattggaatgcagaggctgggaaggagatttccctttgaattatatgaccagtaagaaaaggcaggaagcccaaggctgtcaggtgatccaggaagtgggcgctggggctggtgagagatggctttttgcctttttcagatgtgtcccttcaacactgtaaagccttgccagaaagaaaactcgtcccaaatctcaaggaatctcagcatcactcgcaacaaatctatgtcaccaatgaaggatcttgggcaatgcaaaggggcagacgggtccaaggagggcgactgcctgcccgtgagcacggcactccctgattcagcttcgcagggctgccttcctgaagctcgcacacctgcctgatggttcaggcactgcacatcgtctacaatgagcagtcaagaggcaagacgagggacccagctgccctagagccctgccctgggtctcaggcatggaagggtctgcagagctatcactggccacaaagcgtggctttttctctgacccattctgagatagggaggtctgctaccttcactcaactatgctgtgaggagaagggtgaagggcctgttttacaaaagacaatccatcccaacagcacagcccacttccctggcaaggcagtggcaggtgggggaggtcacggttcatgcatgaccagggcgggagctgcaggaggctccagctccctctcctcactggcgccaggaccctctctctgcaggggcacagactctcagaaaaaaagcaacggcagtgtgagctgtctggagagaaggaaaatgtccacatgcgcaccttctgaatttagaaagggatgtgtaaaatgtcattcagcatctaacacaaagctaacataaggcagacatttgggaaaagatagcccagaaacttcctaccaagggtgtggatatgagggaaggtgaccggcagtacccaggtcccccagcctcccttcaggcctttgacctgggctgaactgcgttcccaaacattcctatgttaagccctaacccccagcacttcagaatgtgactgtatttggaaacagagcctttacagaggtcactaagttaaaaccgggtcacaaaggtgggccctaatccaatacaaccggtgtccttacaggaggaggagattaaaacacaggcaggtccagagggaagagcaggtgaggacaccgcgagaaaacagccatgtgcaagcccaggagagaggcctcaggaggaaccaactcagctgtcaccttgacctcagacttccagcctccagaactataagaaaacaaacttctgttgtgtagccagccagtctgcgggatactgcggggaagcccgagctaacagcatcctccactctgcaggcaaaggctccggcaggtctgtgtgctgaagccgttctggcctcagctctctgcctgcatctgcagctaccatctcagacctgccaacggcactgtaagaatcccacacccagggccaaccaggacaaagagaaggtccattcccagaaagggccacctgaggttgacatgccaaaggaaggcaggggtgctaacactgccctggtcctccgttagttacagggtccccagtctcagtactgactgaggcaggggcacactaacacacacatcagcaacaaggcacaggtcaagaccctcccacactgtgttctagcccaccttcagaacaacagctaccaactcctgaggctcacgaggagtgcccagagtgacccaggaggcaggcagcatcacccccaccatatggaagggcacaaggagaccagtgaggcccagaggcatgtccgcgaggagagtgtgcgcagcccggctctgctgcagcccaggtcctcccatccctacccgactcagcccggtgttcccaggcagagccgagccaaggaggagagggagagagaggacagagacgggagactctctttgggaaccttggaataaaggttctagtatcaggcctctacctacagtgacacgcattcactgaccaccttaatcaatactgaacaggcgactctcctgcaaagaaaggcactagtgactagtgtcatgcatagggcttacctgtcaggagttggctctgtagcactgtctgctggggcggccaccctggcttcactgagaggacccaggtgaggacctggctgccggtcactgggctgctggtcactgagctaccagtcactgggcctgcagctgctgcttcctgctcagcattgtggtcagcgccaaagctggaaagtcaaacgggccatcactgaacttccgtagaatttatacaaatgaacttatactctgagcccaggaataaaacttttaaaacagacatgaaagaatatttttttccaagaagatcatttaagagtgttctgaagaacaaaacaaggacgtgactaagtaagatgtaggtttctagttgtcacatgatgcccagagacagaggacagagggaagatgcactgggctctacgctcactgcccacacatctctgcgtctccaaagcacgctgcctccaaggcaggcggggtacaaagcacacagacctttgccctcttgcaaggcaaagttacctagaattcacttcgggcccaggtcagggtcctcccaggctacaaccttcggcccacccagcaggaacctgcctccatgtcagacctggccccagcccacaatgcctggtactgttctcagcagagattccgctgggcactctgcatggagcacatgtgttccacgagaggggtgcagagcaggcagacctggggttccaattctggctctgatctttgattcatcactcaagtcctatgaactgagagctcaaggcgcagagccctcagttcacaggtgggttctaggcatggagaagagggtggagaccaattgaaacccctaccggaggagactttatagtgacctgggcaactcactggtcttcccaggctctggtcccactgcagagcatggggatgaaacccacctcactgaggattttaatacactgcattggaatgccactggattccaacatgtttaaatgaaatacacagagaatggcttagcagtgtgactggcatgcagcaagggtgccatccaggagcctcctatcgctgttgggctggaggaggtcccctgcctgcaacgtgggtgatctcaacagatccctccatggaagagtcagaagctaaattttcctaattgttaaacggtgaaaatgaaacctgcccctgcctcttacctgacatcaagaagtcctgggcccagatataagaagaccagtcaaatggctgttttttgaaacaggtcccgctgaacatgcttgctaaaaatccaggcaccagagagtcttggttcatctccagatgccaccccttagcggctgatgtctgggcaaattattgagtcattggggttcagtgttcccagctataaaatcagcatgaaaatagtatctctctcacggagcttttattaggattaaatgagctaatgcatataaaggcttaggacagggttcaacgtatagcaaacgttaaacaaatgtatactcatcattaactacaacatgccaaataattctcccattttcaggtgtgaaacacaccagccacctgcaagctatgaagcttgctaatgtttaaaggggatgctggtctttttaggaccaaaaggggagatatgtgatacatgattatgagactgatcaaagttgaacatcacctgcctatgcaaaagcattttattaagggtatcgctttaaccgtctcaaagaatttggaagtttggaaagtatcaagatgattatgtcgactagaatatttctaagttctagtagcttaagtgactaaaagataagaaaaaagggtgcatgggcaaacaagtatgagggtctgtgacatggcaatgggaacactgggaaatggacttacggtcaccatcacaacagcatacgaatcactgctaattctcatatcctgatgtgtgtcccatctctagagagcctaatcttttccccaattctgattcaaatgcccaggaccacttcccaaggcatcttcaggcatgtggcttcaaatgtaagacatgtgcttgaaaggtttgctttttctcatgggcacgataaattaaatacatcactgaggtaaagtgaaatatacttgtcctgtcaaacccatcatcacttcatccatttttgtctattttctaggaagttgatattagtctttacagttgacaaaacaaagacaacatgctctttgaacctgataaactgaagagttagtaagatacaatgcctcctcaataacctcagtgtccgcccatcaacacacaggggaaagcctgctgcaaacacaacctctcggctctgtttacagtagcctcatctggcaccgacacccagaccaccaacaccccgagagtagaccagcacacttcacacgctgacccggaccactggacagaagttacagagtctaaagggctcactcagctatttccctatcagtcaggagagatttcttaggcagtttccagttagatacgacttaaacttgagatcttaaagaatatactaacctggggaaaaataaataatgtcttaacttacttccaaaatatcccagaaacaaagggcctcttgatttctgtttagtatctttggtatcttccaaaaattcctgagctaatataaagttttccttctgcctagttttctcacactaaatatttagagtaataacagtgactatttagacactcaacaaatcctaactttcatgacgagggtattcagcctgttcggccagagagctctggagtgaagtctaggccttctcagaaggggacagaatacttttagttaaacaaaaaaattaaactccatattgtactgatatcagagactcagagatgactgtgttttcccagagtaagagggtgcttatgaagacaaattgagaaatatgtaaatagaatggaattaaaaggaacatttctaaaaagtaattataaaatttcagaatgttattgccaggacctgtggacagcttaaagctgaaacaacaactatgaaatacaggccaggcacagtggctcacacctgtaaacccaacactttgggaagccaaggctagaagactgcttgagctcaggagttcaagaccagttatggcatatagcgtgaccctgtttctacaaataaaaatcttcttttaaaaattagctgggtgtggtggtgggtgactgtagtcccagctacttaggaggcttaggtgggaggatcgcttgagcccaggaagtcgaggctgcagtgagctgagatcacaccaatgcactccagcctgggtgacagagtgagactctgcctcaaaaaaaaaaaaaaaaagaaaagaaatgccaaacttcacaccacttttatcaggtgtatcttctggcctcttcattcagtaatgcaaatccagcagccacagctcctttcctggtgaagatgatagaacaggaggcccacagaagcgggcagcagatggaagcgaaaacagaaaccatcccacctcactgccaacatcatctctcagcacctatggcggatcggttccaggacaccagagacaccaaaatccatcagaggatgctccagtccctggtataaaatggcgtagtatttggatatgacctacacacttccattcactttaaaacatttctagattaattacaatacctgacatgatgtaaatgctatattgtttatgctgtattgtttttatttgaattattttattgttttattgttatatttgattgtttatggggggactgaatatttttatccatggttagttgaatccaaggatgtggaacccacagacgcacaagctgtggaatagcagagcggctgtactttcaaatcaccaaacatacagaaaggctcagcagcaactcagctgccagggacccagtcatctgcccaatcccaggaaggcccttcttccctcactaacctgtccaccagcagacaccaggagagggccacagagacagtgaatggccagggggcagagcgcggacaccccgggagcagcttctgaactgccaccatcactgaaaccaacaaaacttagccaaaatgtgtaaacaggcccagactccatctaggtctcaatttcagggtcaagcaggaccaacaggcccaataatcctcagtgtggggcctccaggagccaccagccgagcaagcacaaagatgggttagccagagagcgtgcttccctctacggccatgcagaccagaagcacagggaggtcagaggctgcctacctgaaagaggcagcacacagctctaaaactagccaaaggccagcagagcggtgagaggcaggataaatatacatgcacacatgcacagaacagcgactgagcagaaaacctacagaaaagaccacactcacaatagtttatatacataggtatgcatattttaggttagccctaagaataatcctatacaaaccataaaatatcatagcacttaggagatataaaaagacctaaatgaatggaaacacgctaagttcctaaatggaaagattaaacatcataaggattaattctcttaaaagtaatataaatatccaaaacaactttataaatgaaatgtagtatgtatctatctaaattcaagcagtttttttcttagaactagtggaataatcctaaaactaacaaaataaaataagcggtaagatggtcaatcatagagcattaagggagaattactcatcatctagtaaaatgcaccctaaagcaaaagtagttaaaatagtgtgtacttggcacaaaaatacatgctactgttcatccagaagagtcaaatctgcaaatacgaacatgagtatttttatcatggcaccatgtgctatacaagctacactgaaacaagagtgggcacgtgtcttcactccacaatcgagcacacaggatccctgggactagaatcccagggctcacagccattcctgactctccagatgatgccacccaagatggtggtgacagctatgataactgtactcagggcaatggcagccacccttgattgacaacctattacctgtcagaatcttaccaaatgctttacaatctctcatgggagggctttttgaagatcaaattgaaggaagtaaaggcatgtgagacacaaaacacaacatgcaaagataggtgggttttaattaagaacaactagatatcaatcctttgaggcagcactgttacctcattttacagatgcagaaaccaaggctaggagacggtaattatatgccaaggccacacagttaatcaatggcagagcgaagatgcaagtcaacagatacctggatgtatgaatccctgccacacggtttgtgattttaataaaatatcatttctaccataaggaaaaaaatagaaaacttttacaataattgtaaagtttctcttcattttgattctttcaatcacttgctggaacagattttatcatttccttttagggaaaagaaaatctactagagtgagcctgaaatccaaagcatagaagataacagaatttcttttaaaatcccctgcatgccaggaatgaaagattttagtggtgaggtataaataaggaacccccttaacctgataaaaagcatctatccaaaacttccagcaggcaagtggcacaggtaatgaagaagcaaaaatgacatccccattaacattagggccggaaagctcacaatggcagtatcagatgtaactgttctagggttctagaaaacacagtgaagaaacagaaacgaggtgtaaatgttaaattgaaaaagatttttaagaactgtctgatatggtttggttctgtgtccctaccaaatctcatttcaaattgtaacccccagtgttggaggtggagcctggtggaaggtgactggactgtggtggtggatccttcatgaatggtttagcaccatcctcgtggtgctgttgtgatggagttctcaagagacctggttgtttaagtgtgtggcacctccccccacttctcttcctcttcctccagccacataaaacatgtctgcttcccctgtcgccttccaccttgattgtaggtttcctgaggacgcctcagaagccgagtagatgctgccgtgcttcctgtccagcctgcggaatcaagagtgaattaaacctcttttctttatgaattacccagtctcaactattcctttgtagtagtgcaagaacagactaatacaccgtcactatttacagatgaaatgtaagaccatgcactgaaaaataattagaaccgatctgaacgtttagtaagattgcgatcccagagcaaactacaaaccctccccagcccttctgcacagcagctccaagacacctaggaagtctaatggtgaaaatgatttaattagcagaagcaaccaaaacaacacacttaagaatacatacgagatcctttgaagaaaataaaaaatttttgaggaagccaaaagaagatcagaagggttagaaatgcaccacctcctttaaagggaagccctcacattgctgacggacactccacctccacttcagtaagttaaagcaatatcatcccaaggaaggccctgtcttcaaggaactcagcttgctgatttacagatacaggaacagacatgtccatttacagaataaaagtaagagaatgcagccagaggtgaatgatgacacataaattaaaaataagatcatggatagctggcaacttatgctcagtaagatcccacggtcatatcctcaccttccatatgtgccttaaacattacaagaactactaaactactaagagatagtacagaagaaaaatgttataaaatctgagtgaggaagatcttcataagcaagattctcaacctagaagccatgaagaaaaaactaacttctgttcagcaaaagaccctatagacaaatcaaaagacaggcaaaaagccggcggggcgcagtggctcacgcctgtaatccctgtactttgggaggctgaggcaggtggatcatgaggtcaggagatggagacgatcctggctaacacggtgaaaccccatctctactaaaaatacaaaaaaattagctgagcatggtggtggacgcctgtagtcccagctactcaggaggctgaggcaggagaatggcatgaacctgggaggcggagcttgcagcgagccgagatcgtgccactgcactccactctgggcgacagagcaagactccgtctccaaaaaaaaaaaaaagccttgggacaaaatatttccattaccacacagccaacaatctgaatttaatctcttctttactgaaataagagataggatgtaagcagcccaacataaaaatggggagaggatagaagcaaacaatttgcaaaacagacatgtgaaacatgctaaacttcactaggagccagggagacatatacaaacacatgagctataattgatagctgaaaattaaaaggactgggactacccagagttgaggatggctgaacagcaacagggctcccctaaaccggaggtgggatcacactgtacaggcatggggaggcccgctggagtgggggcagcagctttcagactttagtcttaggcacaggcatccttcttggaatagcttatcctacagaaagactcacatgcatacacacgcgtgcatacacacacacggaatgtttactacacactttaagacagaaaaactggaagcaacctaaatgtggctgcccaaatccctcctctcccccagttcatggcacccaccaaactgcacaaggcagaaacaagagctctccattcctaactttctcttctgccttccatccatgtaatccgctagcccagctcattggctgcggaagcatctgagagtcatccactcccttccatctctgctgccaactccaggcctctgcccctcatctgaactgggactcagctgccctgtctctaagcatcctcactgcttcccacttaaccagccctagctctggggagcccatgaggtgacaccattgccctctgtacttcaaatgcacccaaattctcagcgacagctgccaggcctgacgcgtgtggcccctgcctcctctccaggctgcccagacactgctgtcccatgctggagtcacctcactcaccagcctggcctcctccaggttctcagactctatcctccctcatggcctttgcatgctctctgccttgtatttggaattttttcaaacacctgtggccccagctgccttccaccttcccctgctggtagcctcctcagagaaccaaggctccccatccaccctgtcctgtccctgtccaccctgagggatcaggccgcctgacccactccagaccctctccacatgggtctatagctcagcccttggctgcctcttctgcagaacacatcaggcttgctagtgctgttcttcttcctgccaactttttttgtgtccctttcccaagaagaggtagctctgaggccgagaactctatctgtcctgactactgctgtatcccatctcttagcacagggccaagtggctcaaatctttgctgaacttatggaaaaaaatgcctggacaggagccgacttaaatatagtagagcacagtactcctccagcatggaaagcagcactggaaggcacgcaaaagctctaaaggagccacagggacatgagctctggtctgtgggaggcagctgtgaaagtggctcagaacccagcctccaccagctggggtgggggcagcctgcacaagcgctcagccactctctgcctcaatttcctcaactgtaaactgagaacaaaaccgtcccaacttcatgcaaggatgaaatgatgcaattcccacagagtgcttcacacagcactgacagaaggcaagtgtttaataaaggaggcaaagagctaagcaccaggaataagcaacactgccgtaaaaaggggaaagcagtatatctgtgggtgtctgcacccaggaattccaaacagagaaaatgagagaaactatttgcaaactactcatctgacaagagattaataaccagaatgtataaggagttcaaacaattccatagcaaaaaaacaagtaactcaatttaaaaatgggcaaaacatgtgaacagacatctctaaaagaagacatacaaagagccaacaggtgtatccaaaaaatgctcaacaccaatatttatcagggaaatacaaatcaaaaccacaataagatatcatctcaccccagttaaaatgactattatcaaaaagggaataatggatactggggagaatgtaccaaaggggaccccctatactctgccggtgggaatgtaaattagtgcagcccccatggagaacaatatggaggttcctcagaaaactaaaaatagaactatcatatgatccagcaatttcactgctgggtatatacccaaaagaaaggatctgtatcaaaaagatatctgcacacccgtgtttactgcagcattattcacaatagccaagatatggaatcgatctaagtgtccaacaacaatgaactcatttaaaaaaggtggtacatacacacagtggagtgctattcaaccataaaaaaggagtgaaattctatcatttgcaacagcatgcattaacctggaagacaggcatagaaagacatatgacatgttctcactcatgtgcaagctatgaagtggatctcatgaagacagagagtagattggtggttaccagagacagggaagagtaggggggtatggaggattaaaaaaaagttgattaatgagtacaaatatatggtcaccttattgatttatataatactaggccttatttctgctcattcttgaaataagtacacttaattaaataaatcaataaggtgactaccgtctacaataatctattgtacacttcaaaatagcaagaagagaagaatttgaatgtttctaaagttaagacaaatatttaaggtggtgggtatattaagtacactgatttgacctttacaaattacatgcatgcattaaattatctcatgtaccttgaaactatgtttatctattatgcatcaattaaaaagtaattagttaattccgcagagcaaaaggagccaaaagaaccctgaacaccaacctcaaaggagggccatgagaagtgaagtgagaatttcactctctacagacttctgggttcgactatttaaaataaagatcacaaattactcatgcaactttaaaatttatctaagaaagaatgttttcatccagtttcaggccaagggtcctatatgcttctcctcacacaaaaacctatactcagggtcccttgtgatccccctctgcccttgtggagggctccccctccctttctaggaattccagagaaatcactgctctatacctaaacacaatgaggctattaagtgcttgaggccaagtcacatgaatattaactgcacaggcccttttctatacaggcagcttctggaaatactgaaagactttgcccttctattttcttttctttttcttcctttcttttccttttcttcttcccttaaaggagttttaaaaaaagttaaaggagttttaaaaaaaaggggcgggttaaagaaaaaaggatacacctcaaaagtaaagaggaaagacattcttgcttgtggaggaaacataatgtaattgtaatcgttaaaactgtgcgaggagtaaatagtttggagtggagaggcgtgcacagttgataaagatctctcctctcctcaatgaagaaagctgtagggaaacagtcaatgtgctttggacgctttatcaccacccccaaacagccagttatcaacattagcccatcaccagcacacacaccagagcccactagggcctggcattctattctaaagatgatgatatcttttcattctctatatcattagtacattcagtaagtaactactgtgtgttctaggttttcagggtaatgtctatataaacatgaataaggaaaaccaatcctcaactcagaaaatcaagaattttgcaaagacaatggaaacagagggttcctacaaacaggaatggttggtaaacaatgattaatggctctgaaatgcatcactatcatacagtagcacaagattgaaaactgacacagggtatggacacattaaaaatgactttatctagcaatgtaatcgaacttttctgcagtattcttttttaatgagtgtgcatgatctccagtatttagttctcttggtctcctgcacagactggtgcaacatcctcccaggtacccactgcctggctgccgggaagtccaaggcaggaataccagaatgcccgcacagatgcccaaggcaggagtaccagactgccggcccctctggctcctgatcctccagttccaaaaggacacctggatcctgaaggtatagggcaggcaggtgcaggcaagcatgggacaccttaagagtacacttaacaactgcagggagtcctgtgttgtttcctgcctccaaatgcagacgacttccatcctggtacggcctcttgtcatctgcctgccccaagaccatgctctctggccacacggtcacaaggacttcagggatgctccacaggaagcagaatgctctggtctgggcagagctggcccactttgaggcccacatccacccatcgcactcttgagtcacagtatggcagcccccatgccataccctccatacctacaagagtccctgcggctcctggccagcagggggtacatttcagctcccaacccatccttggggacccaaagacagttcttacatcgtcctatccaggtatctttcttaaatcagacccagcagtgagccactaggcccgccatgttggggaccctgactgtgtcctacactgggctgctcacacctcgttcacagacatgacccatctaccactttgctcctgtgttgcaatcgagaagcccaagctgtgcctctcaatgacctgttctgccttcctggaactggggagaccagttgaggaagcagcagaaacccatgatgctctccaaagctggttccttctctgtgcagagggcctcaggtaatcatctgcctcctacactggggttctgagtgagagctcagcattctgcttcccaaaaatacctacccagcagccctatggtgctgcccagctgggtccgctcaaacctctcccaacacccccagctccactccatcattgacacctctcaggcctgcagccacctagacacagcctcagctcccatgacctggcgacaaactgtgcaacgataaaggcaaaccctgagtggtgccttagctaaagaaagtaaacaacctgtaatttggcaaataatttagaaaaatcgatgcaggaagctcaaataccagattctgcactaattctctttttacctggctcttgtaacttgggtagaaaagtttaagactccattgctacctccttcaatccccaaattaagacttcaattgccctaataaggccttcataaacccccaggttcattgtggtcagctgggagttctgttttcacttcctttataatcacctctatgtttccccttagtcctgaaattcagtattctttcattaattcactcagtacacacttaccatgtcatcactatgttctcaatcttagcattgtcacttacagagccacctccaacatgctccctaatctggtttctgtaggtctgtgaatgcaagatgccaaaagtgcaaccaaacttcacccattggtcaagatcgtagaatgatgatctcaacagaagcagcttgtggcaagcatgaccgaccattgcttttatcagttctgcaaaagctgcatgcaaggattctggaggagcttgttcacaagtgtctgaaagggggccctcagctgttgatgaggcccacagggaaccgccctccacagttggtaactttagttctagctattctcaaatcattggccaaagaacagctcctccttttctatttcaggacgtttacttcttggaacagaggcaaagccaaagggagaaaagtggagccccattcactgggctgatgaacagaaagctacccgggaccacagacacgactggtatgcaggcaaatcattctgatgcccacctctgaactcaggggaatccatcttaaagcatccactactccccatgagaatggagtccccatgatgaggctgtgttctaatcaaagctaattcaaacttccttcactccatcaaaatccactcttagcatttcattacacatcctcctctccgcaatttgagccattgaaagagtcacaacaatcgaatttcaaactgtctcctgttaacattactaagtttcctctgaatctttttagaattccattgtcctccactgttgtgatgctaagtagtcaggaatctgaccagagccatggagccacacaggaggtcgggcttcccaggaggaaagagagtcctgggacccgagaaagaacctgtccttcatatccaccaaaaccacctgcttagcttctcttggcaaatatagatcaggtcctcttcacttcccccatccttcctgacagaggaaaatgggtccacggtcatgaatgtctcaccctccctccaaggctgcccttctacaaagtcagctcatggccagttttgtgcaccctgtaccccatggttcaggggtctctgagcaccacactaaggacctttgtgcttcaggaggtggtgagactcacagggcctctgacagggcacaacacagccacatctgtgtgtgtactcaaagactgtcagcctgcaacagcagtggggaggaagagaatgcagatccctgctttctctgcaacacccttctctcctcagctcctttacatgtcaggtaaaaaaaaaaagccagccttcttattctcccgttgctgtcgattaacactcctttgttccaaggcactctcgggtggatgatcgaatgacgttggtatcacagtttcttttacaaaccttcagtcttccccccagtaaaggtgacctgaggatagaaacggtcgtatatacctgggcagccaacacaggacacatcacactggctcaacaaacactgggggaagagacagagagacagctgcctatgcttgtgcatcacagcccccacactcaagctgtgccaagcttcccaagagtccctcaaatgctgctgccctgcctggtcccaggctctctagactcaggcgactgaagctaatcacttcatctagttccatcaaggtggtatgcagcatctagcattaccacttccaggctgcatccacgttttaacacaaaaagggataaaatttttctagaagactgaagaagtaagttccctcatttggcacataatagttacggaccaagtatcctcaagatctctctgaggcctaagctgctgagtttctgattcaaacaacagacacaagagaacaagcagaggaactggtggttcccaagcatctatctgaattcagtgagggggtgttgcagcccctggcctccaaggtctctgcctaaatccccacacctgtgcttccacctgtggtagcctctcacatggtaccctggtatgagtgacctcacccctatggcaagacctccaggagtggtaaagccaaaattatcttcaagatagtaagatacgatgtgtccttgtcccttgcattccgtcgcgaatgcacagcggagttttctagaggccaaatagcataagactgattgcaggtggcagggggatggggggatccaactaccttctcttaaagcagacattaaagggatttaaaaagtacaaaacaatgacactcttcccattttttttgtttttgaaaatacagcttttttccataaaagatgttatgtttacatataatgggtgaatattctttttacatggagaaaaaatattttttaaatgcctgtcaattcctaaaatagtaaatttcaatatatacagccacataaccacagctctttggggccttcagtaatttttaacagtgtcaaggcgccctaggacccagccctgggggtgctcccctgggaatctcagccctgcccagcacccaggacttcaatgtgccctgtggaacagtctgacagaagccaaacctccacccctagacatggaactgctgcccagtgaaactctgcaaagaatcttagtttttatggagtaagagtccatggagacttcttcattcagaaagattttcttaaaaacaatattgaatttgagacctggccacacaaatgaacatcactggccagaaaccatgtgctactcagcctgctccacacaatcagcaggacattccattccggtccactccaccagtctactcctccagggccagtttgaagtagggggtcccagagggtcactgcctttgaaaagtggctcaactgttctccccaaaggtttgtcctgcttgttgattctggcaagatgcatagctccaggtcatttagaatgttcctcccctgcctcctgcataagccacacgaacagcgagagtcagaaggaaaatgtcatatgtccagtatttccagttcaaagtacagccagcaggacggactgcccccctggggttgccaacactcacaggtggccagagcttcaccatctgccctctccctgtgttaaaacaggagccaaaactaaacagcacacatcagcgcccaagattcgtgctactctcaactgatactgctcttggctatctgtgccattttgtttaaactggtagaagagaccagaacccgcagcccagtaggaatgaaccccaggcctccccacagcttcagggcaacgtcctcctctctctgcctgctgcaggattaccactctcaggattcagcacaatgcttaacaagaggaaagaggatctatttctgacctggcaacatgagacttactcttctaaacggggcatgggccttcatcatatctattgtttcaactcatgagtcaggatattacaaaggtagaaagttcttacctgtaggaagccaaaatccaccctgaaaagtcattacaaagccaacctcacttgaatggcacatgtgtcccctaaacctggtactgaagtacaagaggcgaagtgaaattgtgatgcggatgtggatctattcaggcgacctccttcaacaccaccacggccctatggtctcaatcattttaagacaaaaagggaaaaaagttgtgagaaccttggtataagaaccccccttgcctctgaaagacactcaaaacctaaggcatttgctgtaaccctcaagaccacaaaatggccactaggtctggaaagaaaggtgaactgacgccacactataacataaaacaaaatcatgttacttgtgtctcccaactccccagccacctcgttctggtcttctagaccacattctcgatgcaagagtcccaggacagtcaaagaatacagaatcattcccgaaacattccaccaaggcaagggaattaaatatctgttaatgtctgttataaattccacagcaaacatcatactcaatggcgaaatagtgaaagcttttccccaaagagtggaaacaagacagaattcttgcttttgtcacttctacttaacacagtattggaagctctagccagagcaattaagtaagaaaaagaaatgaaagccatccaaattggaaaggaagaaataaaattatctgttaaactcttagaagaaaacatatgcaaaaatctttatatggacattggatttgacaatgactactcagatatgacaccaacagcacaggcaacaaaagaataaaataaatgaacttcatcaaaaattaaaaatttttgtgcgtcataggacactacgaagacagtgaaaagacagcctgcagaaaaggacaaaacagttgcgtatcacataactgataagagtattaatatctagaatatataaattcctacaactgagtaacaaaaagcaaatcaaaaccacaatgagcaatcatctgatgccttgtattagtccgttttcatgctgctgataaagacatatcagagaactgggcaatttacaaaagaaagaagtttaatggactcatatttccacgtggctgaggaggcctcaaaatcatgacagaaggtgaaaggcatgtctcacatggtggcagacaagagaagagaacttgtgcagagaaactcccctttataaaaccatcagatctcatgagacttattcactatcactagaatagcatgggaaagacccaaccccgtgattcaattacctcccaccaggtccctcccatagcatgtggaaattatgggagctacaattcaagatgagatttgggacacagccaaacgatgtaacacctattaggacagctataaggaaagaaaggggaaggggaaggggaagaaaggcaagggaagaggaagcggaatgggaagggaaggggaagggaaggggaaggggaaggggacggggaagggaaggggaaggggagaaaggggaagggaggggaggggaaggcaggggaggggaaggcaggggaggggaggggaggggaggggagaggagaggagaggagaggacaggaaacgaaaaatgccaagtgttggcaagaatgtggagaaactgaaacccttgtgcattattattgggaatgtaaaatggtgcagctgctctagaaaacagtttggcagttcctcaaaaagctaagcatagaattaccatataatgaagcaattataatctagacatatatacaaaaacatggaaagcaagtactcaaagatagttatacaccaatgtttacagaagcattattcacaatacccaaaaggtagaaacataaatgtccatcaacagttgaataaacaaaaagtagtatatacatacaagggaatttatttgtttgtttatttatttatttattttgagacgaagtctcgctctatcacccaggctggagtgcagtggcgtgatctcagctcactgcaagctccgcctcccgggttcatgccattctcctgcctcaacctcccaagcagctgggactacacatacaagggaatattattcagccataaaaaggaatgaagtactaatgcatgctacaacatagattaaccatgaaaacattatgctaagtgaaagaagacactcacaaaaaccacagacgattctattcacatgaaatgtcctggacagggaaatctatgcagacagaaagtagagttccttagggttgggaaagcagggggagcaatgggatggcagggagtgggggtatgatagctaaagggtgcagggtctctttttgttctaaaattgactatggtggcggttgcacatagctgtgaatatattaattgaacactatatacaatgtatgtgtgtgtgtttattcatttctgcagttataacaaaatacttgagactggataacttataaagaacaaaatctatttctcacagttctagaagctgggaagttcaagatcaagatgccagcacttggtgtctggtgagggccttcttgctgtgccctcacatggcagaatgcagaagtgcaaaaaggggatcctagctagttctctccagccctttgatgggggcaagaatccattcatgggactggagccctcatgaccttatcacttcccaaaagccatacctcttaatagagttgcgttggggaagtgataaggccataaggagacacaaacattcaaaccatggcattccaccccaagtcccccaaatttatgtctttctcacatacaaaatacattcattccatcccaatagccccaatgtcttatctcaggccaggatcaattcaaaagtctgaagtctaaaatttcatctaaatcagacatgtgagactcaaagatgtgtttcaacctgaggcaaagtacttcagacttcagcagtggctcactcctgtaatctcagcactgtcggaggttgaggcggccggacttcttgagcccaggaggtcgagaccagcctgggcaacatggcaaaaccccatctctaataccaaaaacaaaacaaaacaaaaaaaaaaactagctgggcgtgatggcacacgcctgtagtcccagctactcagcaggctgaagtgggaagatagcttgagcccaggaggcagaggttgcagtgagccgagatcacaccactgtactccagcctgaatgacacagtgagatcctgtctccaaaaaaaaaaaacaaaaaaaaacagtggaacagacaaagaacagacattcccattacaaaagggagaaataggaaagaaaaaagaggtaacatttcccaaccaaatccaaaaccaaacaggacaaacattaaatcaatggtaaggctggagaataaatctttggttccatgtcctgccttccagacacaatggggcaggagttgggttcccaaggacctgggcagccctgcagccaactgctgggcacagccctcatagcagctctcacaggttgcagttgggtacctgcagctctcccaggctggcactacacacgggtaactctacagttacaggctctcgagggcagccccacccccacagctccattaggcattgtccttgtgggagctcgctagtgtgcccccagcctcaagactctgctggacattgccctagtgggggctctttttggcactcctgccccatggctctattaggcattatcctagcagggagtctctgcagcagacctatcctgcagcaattctctgtctgagcccaagactctctgaggcatcctttcaaatctaggtgaaggtagccatgcatccacagctcttgcactctgcatacttgcagacttagcgccatgtggatgccacctaggcttatgccctgtgccttccacagcaatggaactagctgcacttgagcccccttgagctacagctgggatatccaaggagggctgcactgtaatgcagagagcagagaagtgatgccaggcagtgaatgctgaggtcctgcagacgcccaaggcctctcctttgacataagttctgttccctgggccttggtactctgggcctctgatgggaggggcagcactgataatctctgaaatgccttcaggatcattcttccattatcttgatgaatagcatctggcttccttctatccatactaatctccttatcaaaaggtcacttggccacacccttagtgttttctcccaaacatgtttttacaacctgggcaagctaaaaattttccatatccttaaattctgcttccttttcttttttggaaacagggtctcattctgtcacgcaggctagagcgcagcagcagaatcatggctcactgtagccttgacctcccagactcaagtgatcttcccacttcagtccccttgagtagctggggctaagtgcacaccaccacactccgctaatttttttttttttttacttttagtagagataaggtctcattatattgcccaggctggtcttgaactcctgagcttaagcaatcctctcaccttggcctctcaaagtgctgggattacaggcatgagccatagtgcccagcctctgcttccctttggattataaattccattttcaattcatttctctcacattttactgtaagcaattaagagaagtcatgcagcatactgaatactatgctcacggatttcttccaccaaatatcctaggttgtcactcttaaattctgccttccccaaagccctagagtatgggcacaattcagccaagttctttgcgcctttgtagcaaggactgtctttcctccagtttccaataagatattcatttccatatacgaccacagcagaacgggctttactgtctataatactaccagcattctgatcacagccacttagaagtttctaagaagacactggttatctctacggctctcctcttcttctgggccctcaccagaatcattcttaatgctctgttcacagaaatttaggctttttctagcaaacacttccaaactgttccatcctctacccattacccaattccacttttcttttaagtatttgctataacaacacccactctcagtatcaatttctgtctgtgctgctataacaaaatccacaggttaggtaatttataaataatagaaatttacttctcatggttctggaagagaggaagtccaagatcaaggcactggggttcagtgtctggtgagggcctctctctgcttccaagatggtgccttgttgccacaccctccagaggggaacaaatgctgtatcctcatatggtggaagagcagaagagagcaaacccattccccctcaggcccttttaaaagggccctaatcccatctatgtccactcttatgacttaaacacctcctaaaggccccacctcttaataacatcacgttggccattaggtttcaacacatgaattttgggtgatacattcagaccacagcaatctgtatacacacacacacacacacacacacacacaccattgcacatatctgtaaatatactaattataattgaattatatacttcaaatttaaatgagtaaattgtatggtatgtgaattatacctcaatacagcttttttttttaagagaggactgtatgaaaaaactagcccataaagatacatgcacacctatgtttattgcagcactacttacaaaagcaaagacatggaaccaacccaaatgcccattaatgatagactggataaagaaaatgtggtacatatacaccgtggaatactatgcagccacaaaaaggaatgagatcatgtcctttgcagggacatggatgaagctggaagccatcatcctcaacaaactaacacaggaacagaaaaccaaacactgcatgttctcactcataagtgggagctaaacaatgagagcacatggacacagggaggggaataacacacaccagggcctgtcagggaggggagagggactgaggggagggaaaacatcaggacaaatagttaatgcttggggggcttaaaatctagatgacaggttgatagatgtagcaaaccaccatggtacacgtatacctatgtagcaaacctgcacgttctacacatgtatcccggaactaaagaaagaaaaaactagcctaatgaaataatcagcacaagaggggttctaactccaccccgaccccccaaaatttggaaccaccatagtctagccatcttcctcttaaagtgtcataatacattgtggcacacaaaattttctgaaatgttgtgccataaagaaaccaactttatctaatccaaagtttcctcacttatttggcaataaattattagctcctgtagtatctaaaaccttcaggaagcattaagttgcccaacatcaccaccagcctaggaagactgttaatgaaagatgacaaaggaatgggtccaaagtcccatggagcccatcaatgcatttactgatcaactagggcaggcacaaatacaaacattcaaaaatgtctttgctatccaaggaagaactttggtggtagaatttttcaaaaggtggcattaagtagaggtgatccacacagtggagccttatacacagaacagactcacagtgcaagcaagacaaaagctgctttaataccacctaccctgacagggaaataatgggacaacccaaccctacctccaagggtagggtcgggctaacgctgacagaaacaggcaagggccccagccagaagccccactgggacatctttattgcttctttctatggcttggaggccttccaggttccaggctgtgatgctgagacatgaaggcactgagcaaggaccttggaagaagtggggtgttagcatgcacaagctcaaagcagatacaattcctacattcttaaaagaaggcaggtggggcttccaaatccgctcaagattcaaaaggtttcaaacctttctaaaagtgttctatcatcataaacaaaagagaaaccactaaataaaatccacaggaatccaaacaaatgtcaaagcaggacactgtacaaatatttgcccctggaataaagtatggacacatttaagaatgtcatttacaacaatgtagggctaatcactagaaaattcttggtacaaaaattcttagattaagtaatagcattattaataatagttcttaccaggtaaagtgtcctcttcagagaatttctagagaaaaagacactaaagtgaacacagggggaaatgcattaagaccttactgcacaaagtgtgggccactgaccaactgcaagcataacacctgggagctggtcagaaacccaaaacctcaggtcccaaccaagaccaactaaattagaagctgcattttattatcagccccaggagattcccatgcatattaaagtttaagttgtggtattttcagacattgttaatatttaacttgtatcagaactgaaacgtgccagctccctttaagaaaataaataagcaaaatatattaacatcactattttattgttcagtcaacacaggccatccctctactcaccctcccttcctacacagatttcattattttccatctaagtaaggcaggaacagatgacggagacagactggctcctcaaacacctgttgagtgaatgacaggcggggtcccttgtcaaaagccacccagagcactccttgccattctcatcccacttgagtgctgaacaactgctcagaattacacagccattgttggcaacggcacatcaccagtctcaagccaccaggactaccttgacaacactcagaagctggctcccagacactgcacaggaaaggaaaaaaattatttgtaggtgacttacaggtaccatttacacatttagaattttcttccctcactaatatgagatttgagcctgaggcatctagagttcagcccagactcttccagctgccttcaggcaagtctccacagaccagaaatgcccctggagagatagtcctggaccccctgaccgaggaggcagagaaaaaaagggaagaaagaagcaaacggggccaataaatgcctactggccccccaatcctagtcacagctcagcattttctggcccctttaatttaacctctgccggccgtgagaggaacaaagcccattccacatgaaaacagaagaaatgtgtctcctgaacaaatcagaataaaccgtcatggaaagggttccagggtttgggatgggttaggactttgtggatcatgcccagccagtgaattctgtgaaatatgagaaaatatggtccatcacaccagttctgcacgtgatgcatggccatgcccactaccagatgtgccaagttatttaatctgacagaagcaaaaggcccacataaaggcctcttttgacatgtgctcccagacctcctagggtccacaggactcatactgcctcaaggcctcccctcattctgcccttgacccttcagacaggagctgctaactttctaactgaatcaccagaagccccagtagttacaaggcccagaacaccacatcagttctcagactttatacttgtaagaatcacctggcatgctttacaaagacaaagaattccaggtcccaagcccagaaagtcagtttcgtagctcagagctggggcctggggatacataccgagaggcagtcagctctgatgtaggtggttcagaggtcacaccttaaaaaccctggtctctcctatacattcttcctcctgagaattatcagaatgcagcctcccaagtctgaaagaaaggtaaaaccattctagtccaagcgagtttcctaagacattcttactaagtcacaagtacatactccaagaagctgcctggcttttgtgggaacacaagtgtcagtgaatttaggctgtggcctaaatatgcaaattttggagcctaacctccaaaattcgaaagatgcagtgttctctcgaagtttggaagcctagttctggggtggtaattacatgatggctggaggagcaactggtgatggaaatccttaggagacactaaaaataactcacattttaatcgaccaatctggaacttctctcaccccttcatgccaatcgtgcaattaccataactccattcaccatgttcctcagcagttagtatgcaccattctcagtcctacaagatagtaactattatccctgattcacaggtccaggtacaacggcaggtagcacaagatggggaggggactgaaccacactgcactcacaccccaccctacaattaaaaaccgtccttcagcgcgtggctgccgagcacctcaaactgaaacaagtgttctttaccacctttctctggagtgacagagagaaagaaaatcccagtaagcccttctggccctgcccaccacctcccctgttcccacccaggccaaagggggaatgcgtgggccctgctcccacccccgatgctgacatcaaaggagcagagacacgcaggagactccaggcagcacccgaggccctggccgccagcacgtcataatccctgcagtcgctgcctttcagacttaaaaagaacaatgaggaaagacacccacgcttcccctcactgggctaggaaggagagctttgcgggtttagactgcagtctcccccgcccatagccacctgtgtgccggctccgcagacgaggtccccccagcaccctggcagggactgtaccatcaacagacaaatggcagccgaccaaggaggcgactggcgtgtggaacaggtgatccgattgtttttctaaagagcaagggctaggacgtcctacgtgttcatatgcacaattttttgaactccatcaagaacacgaaccccatgcccacatcttcactgctcaattcacattgtctgatatgcaccttccagggagaaagaggttttcatggagaaagaggcaacgttgactatacgtgtttactcaaagcttttttataccggactatatgccatccaggtttaagagaattccaggcaggctctagcattatgtttttcacagaaaaagccggtgcagtagcccggatgcccagatccactcatttcccaaaccggttcccacacccgctgcccaccacctggcgaggaaggagcgggcgaggttcgctcgaatcgtcgtcacgggtttccgtgggtacagttattactcgttacataatattaaacaattaagattaaaaatggttacataatactgtcctatggctggcggcaacgaagctcgggatctcggactgcagcgagcccgcggcaggcgggcagggggccgcgcggcaagacctccccgcctccctcccgggccctgtccgccgcggccggggcctctgcagcctgcgcaggccgatccgcccgccgccccggctcgcgcccaccgcccaccgcccaccgcccagcgcccgcggcggagcccacctgagtacctggagagcgggcggcagcactggccgcacggggtcgctgcgtgtgcgccgccggcccgggtagggcttcggggcccggcccccgcagtgcccggcgcgtggacagcgctccgcatggacagcgctcggagccgggccgggctggtcctccacggctccgccccggccaggggcctgcggcgcagaaaaccgacccggggcctcggggccaccgcgcgccaggcgaacgcgctagcacgaaaagcgggccaacgccgcctctggggacgccatccgggcgagggtgggatgccgcgccaccgcccgagcgtgcccgggggctcccagcgccatcaccacgcaggtgcccgggggcccctccgcggagccggctgccgcccggctgcaatactcagcctccgagggactgggcgctcctgaggagcgggaggacgacggagcagcgcccggtcctggagcacaacaggaatcccaggaccaaacccatgtgacgcggccacgccccaacgcccggcgggggccctctgctgcccaatccccggatccctggttctcatggcaaccctgaagaaccccttgttccctccactgcctcctctcctcccccacagcccccccgcctgatgggcaaggacgcgcacactggccactctgacgatgccgaaagccctccatgtctacccgctacgccgcattcgcagacaggcgggggacatcgcggccgcggcaagctagagatgccgcctgctcgagcaaccttccacctgcagggccggccagttctactcttccaggatcactctcgtctcacccttctccccaaaatgtcagagcaagaaccaggaagggagaggctctttctggaagccacaggcataacgttactgaacaacgaggacaaagtagggtcccatttaaactgagagtcagcgagggaaagaacagatcctatacataccaagcatctgctatgtgctagtcacttcacacacacacacaccccacacacacctcacacacacaccacacacatcccacccacccactcacatacatacacaccacacacatacatacacaccacacacacacatacaccacacacacacatcacacatactcccccacccccgcacacacatacaccacagacatacacacgagcctgcaatgatggaagcaaaacagaacgtttggagatattcactgccgtttacaaggccacagtaagcagtaagcagattttctactcccctctagcagagaacatggtaggaaaagctagacattgtagacagcagtaagaacctaacagtcaacagtggacaatggattctgaaactgagatcctatactgcattcacacacgttaaggggcagggcgctgggaaaaccccatctcagtctggggttcaaagagtggaaaagctaccctagtccaactgctcggaggccaggtcaggcccctgaaggtcactggaggaggaggctggaaaaagtgcagatatgcactccaaaaggagaggttccacggtggtcatgaccacaaaattccaatatgtttaagtcgatcaaacaaaagcagagttaaggctggttctgaaagcagccaagagcagttttcaacacaacacaaagggtaacacaaggctttcttttctcacagtccgggctgaccacatatggcctggctactgcaagaaacattgaaggtgttagcgcttttgactctaactgcgcacccctcagagaagatgtcacatagtgaacatcgcaaggcacagaatgggaaatggaagcacagaatcaaaccctgagattcggggagaaaccaaagtgtggagaaattatgtaacttatccaaagtccagagcaggttactgactgggagaacttggctttccttccagactccagatatgagacttttctgcggtctgacacagtggcttcttccacctctgcagtcaaccccacaaaggtggctcgagtgttcctctgcctccctgcccagcagctcccagcctggatggtgaactcctttgcctgaacatcccacgcaccctgccatctcctgggctagaacaacaggttgtgcaggacagagggcttccctgccacactcccctctattacaaaatgccagaggtcccagttcgaagcagctgttcctggatgtgggaagagcaagagagaaatgatctaatgatggacaaggaatcttgaaaagccagaccttcactgaatggctgacaggacacacattttgctttactagaacaagaacagaatctttgaaaaggcataaaagccagtggtcaagaagtaactgacagcaaaggcaaaagagatgaaggctaagctggaaagtggagatgaagcctgatgatatactcagtggaagcccagaaagtctcaggaatgagaactaccattcacctctggaaatgggaaacgtagagtccaaaacaagaagattaatcggaagtgtcaggaatagctgggccccatttcatcccgggtcctctccccagctccatcagctaggtgacttcttttctggaagcagggacacaggtctctggaccaggatcagcagacacagccatgcctttagtcccagaaagatttggtggatcacatgctagctgccatatgaatcccaccaccatccccagcagctcctggagcagcacctccaacagaactgaaagaggctcctgcagagctgagaagagacccaaaagcatgagccccacaacaagcaaccaggcgtccatccacagaggccacagttaaatgctcactcacacagggctcctgtcagcttctgagcaatgtccttttgaaagtgggaagaccccagacagctaagcgaagcctctaaggtgaaagatgtggccaaattgcatgggacaaacacttcctatgcctcacctccctgggccctgtccacagctctattgagccgcatctgatgggacccctatgtcctgcagcacagcctcctcctaccagggctctgaagagcctgtacacccagcacctgcagggatgtagcccagatgcaaccctggcccatggtgacgggcactgacaggagatacatcctccaccccaaccccttcccagcactgtctggaggactgggagctcgtgacacaagccagccccacatgtggaaccattggcttcactcaattctaggcactgcccaccgcgggcaccccgcctcaccctgcacccaggttccctccttccagcctccctccaccaggctggcacaccctcctacaatagaagcacagaaggctttgccataggctctgctttccgggtaagctggacacaaacaaacagaaaaattaaaagtaaatcatttacaaatgggagagaagaaacgatacacaaaaagtttttaaaaattaatatctacaaatgagatagacgtatctatgaaataagaatattatgccattaaaaaaagaatactcactttgaatgtcaataatgtgtcaatagtcaactgtaacaaatgtacaggattcccagtagtgggagaggctgtgcgtgtgtggggcagagggcatgtaggaaatctctggaccttccattcagttttgctgtaaacctgaaactgctctaaagtctgttttttaaaaagaatataaatatatatatagagagagatcctaagaaattcaaaatgaaaatagaaacaaaatccaacagaaaagttaaaaggtcaaattgaggacatatcccaaaacctaaaaacaacacaacagacacagactattagataaaaaatacagagaaccaatccaggtggctaaaaaccaaataactgccatcctagaaagagagaagaggaaaatggaagaaaagaaatgaaaggattaattcaaaaacatgtccaagaccagaaagatctgagattccagcttcaatgggccctcaacataccccacacacaaagtggagacccaacaagactcatcttcaaggaacttcggaacaaaggcacagagaatatcctacaagtgtccagacatgacaaaacaaaacaaaaaacaaaccaaaaaaccactctggtactctttcatacacagaatcaagaatcagaagagcttctttctcaaccccattctgcctaaaggcaatggaagcctctaaatgttttagggaaaactatctttaatttagaaatccatattcagacaaaccgtaaactgtgagagtagatggacattttcccagacatgcaaggtctcaaaaagttgacatcttgtgcaccactttttggaagcttctatagaaagtactccatcaaattttggaaataaaccaagaagaaaagtcatgagatccaagagaaaggcaaaggggcattcctgggacaatggagaagaaagactccaagacaacagctgtgcagggagcctcagagcaacccagcctgctgaaagcagaaaggcacacaaggaactgcttccaaagataaaactgcagatcaccttaggccttggaaaagagattcacacaactctgtaagtttggagggaagaatggtaagtacattttaaaaactaggcaaaaacaactccaggagaaaacaaaatgtcctaggagaaaatcacagttatcacagtatactacatggctcagctatgagcagcattaggggaccatcccaacactgcatactgatggagctgaatggaccagaagagacgatgaagagacaagagtgagtgtagggtggggatgggacaaagggcatcatcctcaccttccatggagtttgaaatcaagaatcacatgaaaaatggggctctggagagcaggaggaggaggaggaggaggaggaggttgccaggaatcgcaatctattgtctagacctcttcagaaatatggaagtacgtacagaaaaaaatctgctgataagttacttctggggaattatttcatctttaacctatgtctacatatcactctgattttaaaaatccaaactaaattttaaaatagtttgctctgggtgttgaggaattaggaaaccaggtgacccttcagacgaagagaacagaaacactgtgtgatatggacaggcaaggacagcagggggacagtgccctgggcagggacggtgggtcaggacagggacagcctgtgtccactcactgccctgcaggcctaggtggggagaaggccggggagacctgtgatggagagatgaggcgacaatgacactaggaagccctcctgacttatccctcctgcgtcgctccatcacctcactaggatcgcaggccaagacactcaacgttctcctctctggaggggattctgtgagatgcacgtgattttcttcagaagagggagtgcggtaccctagaacagacacctggaagctcaggtaacacccctgcagcctgtcctgggccagggtggtgtggccagggtgaaaagatgggcgggggaggtgccctctggctcaaatcagcccatacgggacaattagagggcactgaacatgacccagccagctcaacttcccacaggatgtgaagaccgtctaggaacagcgatctcaagcagggccccaggctcagcaccaggcactgtccctgggcaggaagctgtggtacaaacttctgaatttaaaagttactcaattcatggtagcttctcaaagcagggaatccaaaaattattctatgaggtatgtggtattataaaggtttttatactaaagggaactcttcacttacaaaaggctggaagccactgcctaaatactcccagggatgaaagttaaaaatcaaataagtaaactaaaggccctgcacatcagagaagtggggacctgccatctcagtggggcccaggtagcttgcagtgagcagccttggaggttcctgaccctcgactcccatgtgaaaggacaagagaaggtagaaagcgggtcttcagctatccctcatggtcctctattgctcagacgtccccttggagctcccagagtgagacccctgacagctcacagacaggaccagacagagagcagtccccaacgcagtgccacctgcactgacccagcacatgaggatcccagcccccaaccccacattagctctagtgaccttaatgacacaatgatgaggaccaacacacgccaaagtgccaagtactttgggaaacccatgttaataggcaagactgccactgttcatgcccagttccatttacctaatacaaaacctttcaagaacttcagggagaagcaggactgcccactagcacagccctggatagagctcggagccacatcccaggggcacatcagcctgaccaggataagcggtccacagtcatttcagtcccagctaggataagtgcctctgtaagagtccagacaccaaccgtgggggcctgaagacaaatgccacaggctccacaggcctggagaccagagatctgtctccacacccaatgctgctgcccatcagagcttacgcactgcaggggtcttcacaacttctgctcctggttgaaggaaaccaatttttgacacctgctattcactattatctggttcaaatggtttgcagccaagtgaagtctgcagtacaccagctatctttgctcttagaattctacctgtgaggagttcaaactgtcacgctaaacacagtcaacaaaaggattcttctgagcactgactgtggctcaaagaacattcagataaattcaaacaagattttgtgcaactagcatgtacaaagcactggaagacaaaaatacaaaagccaagtcccctttctaaccaaccttataaattaatagcaagcaggatatcaagtccacaaactgctctaagacaaggctgacggcaaagtgcctacagacatcgccacaaagactgcatgagctctgcatcgtgccaatcacacacatcacacctcgtgctaccttcccaacaagccgtggggataaacacgcctatggcttccattttaacggatcaagttggttcacttgttcagcctggccaaactagtaagtagtacaaccaggagtcaactgaggcagtgtgcctgctgccctggtcaaatagagcagaaaagaaacgatatggtgggaggggttattcctccccagcgcccgttctcaggcttgacgttaacaacaaaaagtccactctgttgctgggtccagcccaaataataagcccctcaaattagggatctgaaaagactagaagaatctccccagaaatccatatgtaaagtagatggttcaaaaatatgaatattctaatacaggggaaaagaaaaaatctccttagagtcactatatcctaaaagcaaaaaaatcagaaccactcatttctacctctgagattatttttgataaccccaggaaatggcttcttctgttgccatctcaaaggacaatcacaccatttttcaatccattattaaagaagagccatcagcctgcctttccacgagtaagcgggtggttttaagctttgactgcttttatctccctgcagttagcaggccctgtgatcaccaggagcatggacaaaagcctccagaagacaaaagtgcaggaaagctcatttctcagagatcagttcagaagtggtccaggttgggggtgggagtctgatgcaaaggtgtcccagccaagaggaacaaggagtgaaaacagatacagctccctaaaagtgtgcagctaaaatattcacacaaattaaataccagccaggggctgaatggatcagaccagttatacccctaatagtatgcaaactctgaaagtgatccctagaactccaaagtacctgtctgccaagtctcacccaccaagtagttggacgaccttaatttcttccataatctcccacacttctgtacttctacagttatataaaaaataaaatagcacaggttaaaagaaaagtctccactaccaggaaaaaaaaaagtttatttaaactttgaaggactgattactcaaatgaaagacaaggcaaatatgttctcctcacaagccatacaatgccacgttggtttaataaactgagaaacagacgcggggattacggagcaaacgtgcaaaggcacaggcttcccctccagggagcaggaccaaaatcccctgcatttagctctgagctctgacaggctggcaacctaaccctagatacaagctcaaatacattctacgatcccgtaggtttctcttccccttgcagttaagagtcggacagaattccaaggaaatagattccattccttaaattatgccacctttaaagcattcggttttaccagataaaccaatcaagaatttctacagctctaaaatgaagctgaaggcacaatagatgactgtgttcaagctggagtttgatttctacacataatatagcctgtacccggaaagatcaccaaaatcaagttctgagctaactcttcgagtctgactctgctctcttctcctactggaggctgagtagacacagacatagctctttaaactgggtcagggctgcccttggtcccagtcctggtggccatcaccatacaaagctctggacaagtagctggcatgaacctgcccagttctgggttcctgatccacaaatgaaaagcattttgagtgggccaacgctgccccaaaagtgaccaaacagataatatgcaatagatgactttaggggtacacaacttttctaattacagtaaacataactaccacatcaaaactcatgacttcatggatatcaaaattccttcccaaaataaatgtgtatttaaatgtaaaaagtgagtgaactaaaaggaaatatctagaatgctctggtaacatggcattaaccttgaaggctgggagcccccagaccaggcaatcatcattctccgagtgtgtgactggcaggctatacatacctgacccacgccatttccctttcagaagtggatgtacttttgcaaataaaacacaagactaaaatgatccaaagcttaggttctagtgacagctttgtcacttgctgacagtatgacctcgggcatgccaattaacctcctgagccttggttttcagacctgtaaaatggggatcaggaggttgtagaggggattaaaagcaacaaggcttttgaaagtgccttgtaaactgtgaaatgctacagaagtatcagtcgctacacttctcagttacaggagcaatgcctgctgggcgtgtaactctgtcctcaaattccctccctgtaatctggggattggcctgtgttgcccttctctttcaagtgctcccagtaaaactcaaatattacatgcagtgatcctagagttttgatttttaagagaaaaacctagacatctagaatcattcctggaaacatagttggttttcagtgcttttacttaaaatactctcctaaaagacacttcaccgctgtcacagccagaagtcccactgctgtagaaactcttgattctaactctttcctcctggaaagagaggaactcggggtcagctcgttaaaatattgccagcattgtgttgtaaaccctagtcaactccggttgctgcgctaacaacatgtgttcttggtaaaactgcttgaaactttaaatagaccaccatttctgaaactcgggggctccaaacggctgaatcagcattttcagaaacaaagtgttctaggcctggccttttaaacagcagcaacgagcaagttgtgcaataacgcatatttactcacgagctctccttgttttggtctttcccccctcccccccatctcttgaatgaaactgggcaccaagtttgcaagaaaatattctttcaaacgcattgtaaagatccaggaccctgtaaaaatcacctgtggctctcttacattacccaacgtttcggtgaaagcaaaccataaaaagttcgcgtttcttccaatcccaagaaaagacgcacacaataaaaagtaaaggataccctaatttccataacgcacatgctccaaggcagtcgtcaggcaggcgtttggagaggcaatcagcaaaggcgaagagttgcatcagaaatttccttctgcaaacggtaccgctcttatcacatttccacggctggcgggcggctaatccgcgagccctcaacttggtgttaggccccagcggcggctaacgggtcaccaacagaaccaaaaaaaaggtcctccgtacgaggctgggccggctcgggatttgggagtgtctggcaccactgtcccggacgcccggacgcccgggcgcgcgcgccgcggccccgccgcgcagtcggagcacccggggctgcagggacgcctgggcgcccaccctcccaggcggcggcccccaggagcgcggccttgaccgcagcccccgccacagcccgcgagccgccggcgtctgacaagatggttcaagaatgcaccgcttggactccacacctccccccaggggtcgggaacgcagcgcggagagccccgcggggcgcccggctgcctccgcctccgccgcgcgcccgcagccccagtcccgcctccgagcaccgcccgctgcgggcccggggcgccggagcccccggcccggaggcgacgcccttccgcccgccgcgcctccgcggggcccggcgtccccggccgcggccgcccagcgctcagacaatgacggcgcggggacccgcctggccgtcccgggccccgcggggacgccaaccacaaagtaacttgccgccgcgctccccgcccaactccgtacctgccgcgcgcggctccccgccgcctccgcgtggctgcgggcgacactcggcgtggccggcggcgggcgcgggtccccgcggggcgaggccggcgctcaagactgtcccgggcgccccgcgccgccggcgctgccgccacccaggggctgcgcggaaactttgggctccaccgggtctccgagcgccgagcccgcccggccgcagctcgcttccctctctgcctcctcccgacctccccaccccctcgatgggctttaaactcgcccggccccgcccgccctccccgcctctgccgccgccgccgcctccgcctccgcctcctcccccggctacttttcctgctcctcctcccgccgccgccgcccggaccgctcggcggccgccagcgcgggaggagccggggcctgggcgcagggcgtggcgcgggggcgcgggccgcgggccggacggccggggggccagaagctcccggaggttcctgccccgggctgctgagcgggttcccccctcctgctgtcctcgggactcgggcgcgggaccacgaccgccgcggctcaggaggcttcgccagtgaaaggacaaattggacctgtcccgaaagacaatttataagcgaactgtttgaaacgcacaaagtattaactgcgcagtccagatcctttatcctgggcgcagcaggacgggacggaagagctggggctgccccgtactctgtcgtgggctgaaggcacccggcctgggaaaaggaaacctgggtttgctcacagccagccaggtctggggcctcacctctttgagcctcagtttgccccatctgcgtatgagtatcgaagtgcgggtggagtgagaggcccttcattttttcttaatgctgccaagcctggtgtccttatctttacaatgggctaataacgcccgcctgagggttggtgtcctggggattaaatgaggtcatactgggaacataaagtgactgcgaaaaagactcccctaccccccaattgacggaagccattgtcgttagtgtgattcttaatatctctaccgagtcaaaactctaatacacatagcataacgataagtatgtcttttcctgggtcttggcgttctaaacgcagctgcgacaatatcttgccttcatagagcgtgcactttgtgcaaaaccttcatgaatccttgcatgtaacccccactgtggccctctaggtgttactgttagagtcccactgtgtacggactgggaaactgaatcttggagaggttaagtgacttgctgaaagtcaagtagctggtaagtgcagagcaaggattggaagccatgtacggtattgtaccaaagcccctcgtaggcacctgcttctagcaggagttattccaccttagacagatgttactcatggaaaggtcatccttccctgtaactgaaacagacctccctaaatttttgcctattggtccaagctcagaaacacgtaagatgaaaatcaagagaggatgatatcaaaggattttagattcctagaagaaaggaacacagaggactcctgttgcagacaaaggactcaaaagaaaattaaagaacagaaaactcagtttgagccaacttctcacaaatgcatcagctttgaaccttctagcttctgctgaaggtccaaacagcaatccatgcctacaccagtcagatagcctgataggcaaggaggctttgatagaggtttcaaaagttccttgatacatagacatatgttcttttggaatcacttgtgggtaaattccatacactatggcccctttacccctaaatacattgatgtgtctttcctaagagtagagatattatgtgcataaccacaatagtcaccaaattcgtaaatttatattgataaaatacttgtatccaatctaggtccatattccggtatagtcagttgatctgactatgtcttccatagtatttctttccctctgttacaagatccactattgaggtctagagtcaggtattgcatttagttgtctcaaaatgtatgggttttcagacattactattcacagagaagtgatcaagataaatgtccttaagtgttttcctgctagcataggtctctagaattcctaggacaggccctcattccctacatttcctggctctctgtagacatcagtgggcagaacccattcagagacactttctgatgcaagttcatgaacttgtcactcttgtggctgcagaagctgcagctgtcctctgtgcagtgatcctggatgagccaatcctatatacagattgtatcttatagccttcccttcccccaaactccagatgcccctgcccacgcacaatgctccctctcaacagggtggcagccacagtggaatctagccatgcagcctatacgttatcctggagagctcagcatactgggcaagacagggaggcttgtagttcaagcacttccccaaggggaaacatataagctggaattaggtgtcaggacacaggattccgtgatagtgagaaattcaattatctaaacatgagctagaagcctccttcagctgaaagtagagaatctgatagactctaatttttaattagtaatgaattgattaacatctgtcttcccctgttgactgtaagcatggtgactgtggcaactctgtgccccttcactagtgtccttccagcaggtggagtgcctgggacagagagggcactaagtgaatagtcattactggggaatactgtccagtgaattaatttctcaggagcctctgagacctgggcactgtctcaaacattgccagtaaccttgacaaagggaaagtagtcagggtgaatggcaccctgacagctaactgctttgagcagcagtggccctcgcctctgctctcatgagccactgctagtcacacggcccagccaccatcccatgcggcccatgtggacatgcgagcacatgtctggaaagcagccgcctgcccacccctgcaaggggaagggggtagtctatagtcataatataatcatagtgcctgccccagaatacctgaggagcctgcttgcactacacatccctgggcccacccaagctctggagagttcacacttccagggttcatctgcaattttttttttgagacggagtctcactctgtcacccaggctggagtgcagtggcgcgatctcagctcactgcaagctccgccttccgggttcacgccattctcctgcctcagcctcctgagtagctggggctacaggcgactgccaccacccccagctaattgttttgtattgtttcagtagagacgggctttcactgtgtcagccaggatggtctctatctcctgacctcatgatccgcccacctcggcctcccaaagtgctgggattacaggcgtgagccaacacgcccagcccatttttaatagactcctgcatgatgcacgatctacatccacaccagtattccaaacactccaaaacgagatggacaggccaccctggagtctagaggtggggagcctggcagcattcaaggaaggcttcccagtggttgccatgcccccatggcaccctagaacatcaaagatggtaagttaggcaaagagaactgaagaaaaggcctttggggttgagggacaggcgtgtctctcagaccaaacccatgaaagaccttggctccctcagggcgcagtaccaagtagttgcatttagtcacagaatgttgctgctgggtctggggttagagttttgataacacaccaagctggaggggtaagaagggacttatttgtcagatttatatttaactatttatacttatttgtcaagtataggcttatatggcgatgagagcaccggatatgtctgttatggggcctaccagcacagtgccccccagctagccctgctctgtctagagtttccccacaaccctggttttccttgattcctaagtaccaattaaattggtcagggatgacgcttggcccagagattcccattctgtaggtaggtgggccagtgggcggaagggtgacccaaccaatcagaagcctgcacctgggattctgaacttgaagtactggtgggatctgcacaatggagaccaggtgaggaacggcgagttgggctcagcataaggatggtgtaaagtacaaagacccaaacagatgccgtcgtgcctcccgtctctctgggcccaggctggtacagctattgttttgaacttccatagaattccattttccgtcattgtttatttgtttgttttgttttgattttggtggggggttggagggggtagggacagagtctggctctgtcgcctaggccagactgcagtggcgcaatctcagctcactgcaacctccacctcccaggttcaagcaattctcatgtctcagcctcccaagtagctgggattacaggcatgcgccactatccccagctgattttttatatatgtagtacagacagggtttcaccatgttgatcaggctggtcttgaactcccaacctcaggtgatccacctgcctcggcctcccaaagtgctgggattacaggtgtgagccaccacacctggccccattttccttatattgtcttaatatcaactctccttttctgaagttgcttggatcaaaatgtctttacaaccagaacagaggctcacagaaagatgtttattcaggctggttacttaggtataatttgctgaccagaaaatttatcattttttaatgtacaatttgtggagtttggaaaggtatatagttatggaaccagtaaagacattaatacaaatagttttcaccccaaaaagttttctcatgctccttgtcagtcccccttcctactccaggcaactgatcctctttcagttcttaggttttgcttttcttttctttctttctttttttgttttttggagagatggagatctccctgtgttacccacgctggtcttgaactcttggcctcaaagcaatcctccctcctcagcctcccaaagtgctggggttacaggtgtgagtcaccacacccagccatgttgctctcaagattgtcatctgaatggaatcacacagtagttaacttggcataatgtccttgtgaatcatccatgtttagtgactggatagcatgatactttaattagggtaggtgtacatccacttgttcagccattctctggctggcgaaaatttaggctagtaccagttttgggcaattatgaataaaactgctatgagtatttgggtaaaggtttttctggaaatgtaagttttcatttctcttgggtaaataactaaaagagagaccgctaggtcatatctcagtatatgtttaccaggaactgtcaaactattttcaaagtgagtatattatttgtgtctgcaccaaaaatgtgtaagagttccagttgctctacatcttgcccaacacttgctgttgtttgtctttttcatttctgccatcctgatattgtgggggcagcttctaatgttgtgtagtggtatctcattctgattttaatttgcatttccttcatggctaataatgttgagcacttcttcatgtgcttatttgctgtgcatatacagtgttttgtatagtgtctattcaaatcatgtgcccatctttttgtgtgtttttttcttatcattgagtgctgagagttatttatattaccaatcctttagtagagatgtgttttgccagtattttctccattcttttcactttttaaatggtacctttcaaacagcagaagtttttttatttttttattttttatttttttattttttttgagacagtcttgcactgtcgcccaggctggagtggcactatctcggctcaccgcaagctccgcctcccaggttcatgccattctcctgcctcagcctcccaagtagctgggactacaggtgcccgccaccacgcctggctaattttttgtatttttagtagagacggggtttcaccatgttagctgggatagtctcaatctcctgacctcatgatccgcccgcctcggcctcccaaagtgctgagattacaggcatgagccactgcgcccagccagcagaagttttttgttttgtaagttaaattatcaatttgtcctttcctggattgttttttgtatcctatctaagaaattctttcctagaccaatactgcagtgattttcttttatgttttcttccagaagttgtatagttttggctcttacatttagagatataattcaattgtaactgatttttgtagaccgtgtgaaacaagggtgaaggttcttttttgtggcatatggatgtctgcttgtcccactgggtgatttgaagttgttaggtgatcccagttttgttttagaatgctcgatccagctacagtggagccaacagaccagttgggagactggtaggtgaggatgatgttgagctgtgacagaggggaggaacaataatgaacagattggggtgagtataggacgtatgtatcacagcaagtctctgcccttctggtggccctgggcttagatgagactgtggcagtgagcacagtgcctggcacagagggagggaggcacagagcagggagagcgcatggccatgttgctgcaggaagattccatcatggagcaagctcagcaccctcccccgggcactctggctgagacgtctccctcttagttgaaacaacactgcacccattaggatgctttgggctgcagggaacagagcagagcttaccagccttgtccaggatttctgtccacgtcattctcagggccatggctttgcctaatgcttgccccggtagtgtcaagatcacaatgcagatgcagttccaggcgtcagttcccctgataactgtgtccaagggcacaaaggggacattctcctcccttgcctcatgccagaatccactaggagatttcttctcacatttcaggatctagaacatggtctcaggcccgtgccctagcgggaaggaaggtgagaatgtaagcatcacgcatctttaacttctgtattgtgggggcagcttctaccagcaagaaagaaggatcagggatgggggtggctggtaaatggaccaccaaaaggacgtggccaatagcagatggcctttttggcaatgaagagctgagaacccctctagtttagaaggagcttcctaaataaatgcagcctgggaattaggatcctagggatggcatgcaattctaaatccctaggcatccaaacctagttatatctctaaaacacgagctcctttccagccacttaaaaaaaaaatcatttcagcaccttaaccccattagaagttaattaaccatgaatgtagcacaaactttacttaataaaatatatctccatcccagtacacttcatgattttaataaccaaagttccagagctagtaggagaatccaaaataagaacaaaaacttttaattggtaaaaattatttagagctactggggatttagtattagcataacctgcacggtgtgtgaggggaagtgaatgtatgtttttgagacagcaccttaaagttaatgtttaagatgttaaagccagaagctgcttcagttagtcagcatacattctttaagaggattaatctgcctgcatgaggtacgagactacacagaaaatagaacagctaatcctggagatgaacctgttagatatcccacaattcgtacttacagcagtgaggaaccctgtccaggtggagggcgatcacgtgagtgtttgcattcactttgggctcgcacttctgttagccaagtctggatgttcagttgcacaggagagaattatattttacaataatttgcagagagtccttctcattcatttatatgtaagtgtagcccagggtcattattttttaggactcatcagatttaaagatcgagtgactgtatgtgacagatttttctaggagaaacagtattttttcttcttcttcccttagctattatcttctcctctttcttctcctccctcttcattctcaaaacaagcaccatccctaagtgcctgcttcagcataaacaggtgatatatgtttaatgtgtaccttacattagacactgtaccaggcactttatatatgtatttcagttaatcctcataataaatttgaggcaaatattgttttcttagttttatagtcaaggaagcagactcagggaagctacatggcttctcaaggtcacttaacaaatcagtggcagggctggcatttgaagccccctttgtctgactctcagtcccttctaccttcttcccactattcctggctgtctctactgtcatttcttgtcatttgattattttccatgtaaccagttatttaagtgtatgacctaatgggatgtcttttgtgcaaaagtctgcaattagatttcagtataataaagttctccctctttaggaaaggtgttctcgtttatttttggatcctaaaatgtgatctcatttctatttaagcatgtgtccctgaatccaaggtggaggaaggggagggtcatgggaggaagatattaaagtcttttatttattcaagttagggattttaatctcacacttaaccaccctccttgccctcctactgttagggagtttgacttacttggctctgatgctaccttgggaattctgacctcctggagaccagagacacccacaggatggggatggcaccatgacaggcagctccagaaatgggcggtgggaagagccaaccctagagtgggtggagctgggtcagtgatgatgcagccagacaatatatccaaaaagtgcaaaagaggtagatgtcctgcagatgagtgaccctcatggtgatgagacacctggtggacagaaggagctagcaaggtctgctcacagatggaagtccagtggcagatattcagtccctgggaaagaacaagatagggcttccatccagcaggaagtgagttaggagatcaagactgttcacagtaaaagttggtgccccactgcaagaactaggaaacaagtctgtagaggacctgagtccccgagcaccccgtgacactccttcagtattcccttaggagaggaatgccagtgtctgcagggactctttgagggaggagaggaggaataagggggaaggaagtaatgcaactcagaatgcttgtactaggccaggtgcctagtacagctgtaatcccggcatttgaggaggctgaggtgggtggatcatttgaggtcaggagttcaacaccagccaggccaacatggcgaaaccccgtctctgctaaaaataacaaaaattagctgggtgtggtggcgggtgcctgtaatcccagctacttgggaggctgagacacaagaattgcttgaaccagggaggcagaggctgcagtgagccaagatcgcaccactgcactccagcctgggcaacagagtgagagtccatggaaaagaaaaggaaagggaggggagggaaagggaaagggaaagggaaagggaaagggaaagggaaagggaagggaatggaagggaagtcctaaagaccatcagtgataactcattcaattaacagacactgattgaatgctgactacctgcagcattgcaggtaggtgcaaagcagtccagaggcagtcaagatgttggcattgatggccttacaaaggctcctgcaacaggactctgagaggctgggacagactctttgggggcctgtatgatgacaagggcagatgtataccagaaagactcttcccagggagggatgcacagactttccaaactgcccaggggccctaagtgtctcggtcgtcaagagtccagggttccagctggggctctgagagaccagtcggtgagggcagcagttagcagctgctctgtctctcagagcctccatgtctgcatgtctgaaaaactccatgaggactttttgtatagaggccatcacctgtggaggaagtttgtcacaatgccctagtaaagcattcggttgggggctccatattcattcagttctagttaaggacatatgttttggaaccaggaatttgacccaggttcaaattctaactttccttcttgttagttgtgggactgtggataaattacacagactccctaactcaacttcctcagctgtagagtcaggatgataattcttacctaatagtgttgttttagtggatttttatacct

SEQ ID NO: 513 - DNA, 47366 bp, Homo sapiens
gtttcaaaggagaatttagagaagtttcaggatgacagatccagaagtaattatcaaaggcatagggggacatccttctactgggagaagtccaccttggtccttcttcaccaacttgaagcaaagcttcctgctgaatggaacctgtcccctcaagcaaaagtctctatgggaaaccctattggtaccagtggtgtaaaggcaggagcagagctagggtaggaaacacgcagatgtggattgggtctggacatgtaggcaaaagtgcttggaccaagatctgttgacttattttactactaacagggtcaggtgcccacctcacctgtaagctctgactaattttgcatttctgaattgtgtggtgtccgcatccctgctaatgagcctagtcccataagtacatatgtatgtatgtagacctgtgtgtgcatagtcattcatccaacaaaaattgactgagtgccaggcactttgctaggtgttgggagatatggcaggggtcgggaggaaagacatttcacctccttcatagatgtcgctatctagatggggagacagtaatcaagtagacaactaaacaaaataacaggaaatatgtactgtgtgggaaagaaacatggtgttgtgatcaataataatagcagggttgggggtagcaatctatcagatactgttcaggtaaaggctttccaagaaggtgacatttcagctcagaattgaaggatgggaagggaccagccaagggttcctcctcagcctgaggccaggtgagaggagttctggggtagagatgggggtaggatggcagggtggttggagtactcagtaagcttgggttctgctcctgttctttctgttccattccatccttgaagggccttctctcccttcctgtactcctacctgcctgtcccacctcattccctccaggggcaaggtacgggtgtatcttgtccccatcttgagctgttcacagttcttccctgcccatccctgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttcatacagctgacatggatgttctttccctatgcacccatggtttggttgaaggagagctattctgttaactcaaggccaagggtgggcacagagatccctctcaggcttctaagaccataactcttagagttcaattccttccacctggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgtcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttggtctagagggagggggacttatacaatcatctgttttctggagaaagagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgaccagccttcatgggtcagtttgaggggattcccacatatccggacgtgaaccgcctgtggagcattgtggacaaatacaaggtgaccaagttctacacagcacccacagccatccgtctgctcatgaagtttggagatgagcctgtcaccaagtgagacctcttcccagttgctgccctgtgggtatccctcagagctgggtgctggcctttgtacagtctcttcttttccattgtcccaactctctgacctggaatagaggatggggcaagagaaaagcctgggtatgtgtgtcttccagtagtactcagagccttcctctctcccattcccctgccccaggcatagccgggcatccttgcaggtgttaggcacagtgggtgaacccatcaaccctgaggcctggctatggtaccaccgggtggtaggtgcccagcgctgccccatcgtggacaccttctggcaaacagagacagtgagtgaagggtacagaaggctggggcccagggacaatgtgggaagattgactcaaatttctcatctctgacttccccagggtggccacatgttgactccccttcctggtgccacacccatgaaacccggttctgctgtgagtgatgcttccctggctggtcttgggctaggcagggatggtgtcttggggcacttggcctagttagatagtggagaactggactgacatgtgtgaagaatttggggttctggggccccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctggtgaggccctggcccttgggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggaggctgaggtgggcggatcacctgaggccaggagtgcaagaccagcctggccaacatggtgaaaccccgtctttaccaaaaatacaaaaagtaactgggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggtgagccttagctatccccctcttgcacctcccactaagacatgtaccttccacttccattttcaggaagagttggtgtgttgctataaaataatacctgagactgggtgatttataaagaaaagaggtttattttggatcatcattcttcaggctgtgcaggaagcatggtgctggcatctgcctatggtgaggcctcaggtagcttccaatcacggcagaaagcaaagggaaagccagtgtttgacatggcaagagaggaagcaagggagagagggaggagataccagcctcttttaaacaaccagatcttacatgaactcatagagttactgcaagtacagcaccaagccattcatgagggatctgtcccccccgccccccccacctccccggccttgaccaaaacacctcccaccaggccccacctctaacactggggatcatatttcaacatgagatttggaagggacaaacatccaaactatatcagttggttaggggtaaagaaaattagagaagaatgtgtcctacatgtcagtatctggtttctacgcagagctacaaagactgtaagggcaggaatgagtatagcaggaggggtctcagaatggtgccatccgaactttgatgtatgaggaaagatggacaatgtatgctcctgtgttgaaagagatggggcatgtggcagtgcatgactattatgtcatgtttgtctttatgtctggagtctgtgtttctccatctatccatctaccaatccattcatccataagatctgagcactgtgatcctgtgcccaggcactgatcatgaataatgtagtcaaaatctcctccctcatggggattctagtaaggggagacagacaaacccaacaaacataaataagcttatcttagatagagataaatgctgttaagaaaaataaacagggtagcatgatagtgtgtgcagggatggctactgtacacaggatcgtcggagaagacttctctgaattgacatttgagcagaggcctgaagggtgagaaggaaacaggcatgggaaaatctagagtaagagtgttttgtgcagagggacacagcttgagatgtctgaagaatggactgaagcctgtgtggctggagcgtagcaagcaaagggaagaatattacatgacgttggagacgtacataatacagggagggtcttgtgggccatggtgaggagtttgaattttattcaaagtacagtgggaaaccttttttttgttgttgttgttgttgttgtttgttttttttttgagacagaatctcactctgtcacccaggctggagtgcggtggcacgacctcagctcactgcaacctccacctcccgggttcaagcaattctcctgcctcagcttctcaagtagctgggattacaggcgggtgccaccatgcctggctaatttttgtatttttagtagagacggggtttcaccatgttggccatgttggtctcgaactcctgatccacccaccttggcctcccaaagtgctgggattacaggcatgagccaccatgcctggccaccttttggggttttaagcaggggagtgctaagaattgatttactgtttagaaaataactttgctggatttatggagaatagagtttaggtgagtatactattggcatggaacaaattatcccaaaagttggcagcttaaaataacaaatattatctcacacagtttctgaggatcaggagtctgtgaacagtttcactgggtagttctcattctgggtctcttgtgagtttcagtcaagctgttggtagggcctgtagtcatctgaaggtttgagtgagcctggaggacctacgttcatgcttactcgcatggttgttagcaggaatcctcagttcctcacctcaccataggactactcaatacatggcagctagcttaccctacagcaaatgatctgagacaatgcaaccgagacaagctaggtgtcttctacaacctaatctcagaagtgacatcctatcacttctgccaaatcctatgatgacacagactaaccctagtacaatgagaaagaggactgcagggctatgaataccaagaggcagagatcagtggtgccctcttggaggctggctactacagtgggcaagagtggaagcaggaagacttgttagaaggctattgcagaaggtgtagcagtttggtaatgtggatcaggtatcctaccgtagggtttttatttattaggttttgcatttcttcccaggctgccagcgggaccaggatggctattactggatcactggcaggattgatgacatgctcaatgtatctggtgagggccaggggccaccttcccatcttattaactctgctcctctgacaacacccagccgaagccttccgcaagagcccaggagtgtcctttggccagaccatgtactaagtgtagcattcagttctgggcccaggttttagaggagtaatgaacactggaatgtgcctagagtaggggaacttggatggtggggtgactgaaagcatgtcatctgaggagtgaatgaagggtcttctccatttggccagaccaggactgccccatgggtacagatggagcatgggctggggcagagcctgggatctctctcatggcacttcctttcccttgacaaggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactctagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaagaaatgcttgatgatttgttggttacagttagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtggtgacttgttttcttaggtatctgtgccctgaggctgtatattcattagtggctctgatttgtgtggcagatgggaagggaggggtatttcctaggactatccccaatatcttccttctagaacttttggtttgggcagagcgaaggaggcttcactgacagggcctttgacaagcccctgagctaagcaggaaagtgactgaagccagttcacaactgttatgtatgtcccatcttggttgccttccctcctgggctcctgccagggactctcattcctccctgtgatccagtaagagcattagtgggtggctaaggattgaaacttcagggttccacctgtagagactggtctagggggaccctgattacagaccagtcacttccctgctctaatacatcttaagtgggctaacgtagattacagctcccgcctcccctctatgcacgaagtaaggaatcatcactgaatcagcaatgcagttttatttaaggcagaattagggaaaggctatgcccctccactccccctcctcctaccactcagtcctatcccaagtcaggcactggaacctgctgaaaaggctgatgaggggctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagaggatagaaggtcccgtggcctggttgtgccctcacacagggtatgggttgtccaggactgccactcccgctgccacaccaccatctgcatgctcgatggctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacattttcccaaggagatctctcctattcctgagtctccatctataccctaaaaattgttaacttccggccgggcatggtggctcacgcctgtaatcccagcactttgggaggccgaggcaggcagatcatgaggtcaagagattgagaccatcctggccaatatgatgaaaccccatctctactaaaaatacaaaaattagctgggtgtggtggcgcacacctgtagtcccagctactcaggaggctgaggcaggagaatcgcttgaacctgggaggcagtggttgcagtgagccaagatcatgccactgcactccagcctggtgacagagcgagaatccgtctcaaaaaaaaaaaaaaaattgttaacttccaaatatttaatgcaggctccctgcttagacatcatatgactggcccccaaacaaactcaacttgtccaagcagaacttattacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttcctggcttaaaactccctaatggcttcccactgcccttaagataaaatccaatttctcagtatatattcaaggccctttataatcaggatgcaaaccatttttccagcctaaatccctgtcccctcccagctccccctccagcctcaccagtttctcattaacctccaaacatctcacactttcatggcccggtgccttggcttgaggttgtcccttttgtatggaacactcttcctcctttccacctgggaaattcctacccacctcttaagacaaagattaaaaaaatcctctcctctggagaggcagacatgacccctgacctcaaggagtttcaaactagaaaggaaaacagacatgtattctctccagtctcctaatatgaccctactctacttcccaacaatctacccacaggcacctcaggtaaaacttgtccaaacccttcaatgctggttaatcagattcccctgtgctcccggacttggtcacagggtcttaggggacactgtccaacatgtggcctgtgtcagttccaatagtttcccccatgcccgggactgtgcccagagtaagtgccaatgagcactggccacagcctgctagtccctctcattgaggagccctgcaaagggagatccacctacctccaccctctctctggggctttagcacaaaccggctaggggcagcaagggcctcggcgatggcctggtccccttcttcaccctggcaggaggcagaaagcagttatcaaaagtttaaaggctaaagaggcaagaagcttaggtccagctggttatgcagagcagcatcagaggaagagcaggagggagaacagccacaaattccttcaggcaggatgctactatctggatgacactcccaacaaaccccctgcagcagccgatgcaatgagaacaggcctttctttagcaacagctcagggctctgcagcaggcagcctgatacacttctcaattcttgccacctgccttagtcccttccctctggttgccatcctcatctctacctttgctgagggagcttacaatggattccagcccccatccttccattatgaggctgcccttctgctcagagttctaggggttctccagagcatcaccaaccttgccagctccaccttccccttgtcacaatgccagctccaccctccccaacacattgggctgtaggtctctgccacctaggaggcctgtggtaggagaaacaggctgcccacgtaccacatccagtgagtagaggccagcaaaggtggcgcggaggcgggccacagcctcaggctggccagggagcaacatctccagcatgcccggcctgcttagctcctgctgcaccttcttagtcccagccagctgggtggcaatgtctgggcacttggcagcatgtgacctctccagcagtagacgtgcttcccaattctgcagagggaagaagacaaaaggaattcgactttattttacttcagctgacgtttactgaacatccatccattaggtgccaggtatcatgatttgtatcttcaccctcattatcacccaggatcattctaacatccttgtgagccaggtgtgatatgttgtagttatgtatcattgtgccagactgtgagcccctgcaaaggcaagaatcccccaatctgtgggaaacaatagaaggtgtaagggtagaacatttgtctacgtgctcagcttcccactgtgttccatactccctaccatggccttcaagatccttcaggagctggctcctgtctactttttcaaccttgtaccatccctgactcctagtctctgccattctactcacacaggcctgtcattcctcaaatcacaaagctctttccctcctcagggcctgcactgcttttccctcaacctgaaacccccttcctttcggcttttcccatgcatagctggatccttaccatccttacatctcagctcaatgtcaccttttcagagaaggcttccctgtccactctatttaatgtggatttcccataattctctttttacccagttgtttcattgaaagcagttacctgagactaaaacacacacatgcacacatacacgcacacgcacacaaacatacacacacaaatcccaatttttttttcctatttttgtttactttttttttcttttgagacgtgggtcttgctctgtcacccagactggagtgcaacagcgcaatcttggctcactgcaacttctacctcctgggctcaagtgatcctccctcctcagcctcccaagtagctgggactacaggtgcacgccaccacacccagctaatttttgtattatttgtagagatggggttttgccatgttgcccaggctggtcttgaactcctgagctcatgcaatccacctacctaggcctcccaaagtgctgggattacaggtacgagccacagtaaatggccatatttttgtttactttctgatgcccatttctctgaccagactgtgagctccatagcacagggctcttatcattttcctcattttctgttgtatctccagtgtctaacacagttcctggcactttgtagttgctcaataaatatttgttgttgttgctgaataagttgaaatttgagtggggttctgaaggacaggtagagcctgacaagtgagactcaatagggaagggatactcaggctaagagaataatatgaacacaggtctcaagtggatgatcacaggatgaatggtttattaccacaagagctgagggtataaaaggcaaggaaacagcaggggatcatgcctcccaactctggttcccattctcatgcaatggggagacagtctgtccttggctccagaccactgcaaactgcacacagcaggatcaggtctctcctgtgacccccacccaatgctgtccttcctttgatactactggtccacctgtagcaccttgacctgatcttcatcaataaccccaggaacccaactactagtctggcattccacgcagaatcacacgtgaccagaacatcagaaataaacccagagaaataccccattatggtagaagcaggaaagcaaaaccaaagataagcaaggacttgcccagggtcatctagtaagtcactaagccttctagatctctctccatgtctaaacctgctctgagctgctcagttccctaaaaatgtctacctcttggccaggtgtggtggctaacacctgtaatcccagcactttgggaggccaaggtgggtggatcgtaaggtcaggagttcgagaccagcctggccaacatggtgaaaccctgtctctattaaaaatacaaaaattagctgggtgtggtggtgggtgcctgtaatcccagctactcaggaggccgaggcaggagaatcgcttgaaactggaagtcaaaggttgcagtgagccgagatcgcaccactgtactccagcctggtcaacaagagcaaaactctgtctcaaaaaaaaaaaaaagtctacctctttaaacactactttccttccttgttatctcaaactcttctaagttttctttgtcgtgttttgaaatctagacccatttcttttttttttttttgagacagagtctcgctctgtcagccaggctggagtgcagtggcatgatctcaacttactgcaacctctgcctcccgggctcaagcaattctcctgcctcagcgtcctgagtagctgggattacaggggtatgccaccacgcccggctaatttttgtatttttagtagagacggggtttcaccatgttggccaggctggtcttgaactcctgacctcaggtaatccacctgccttggcctcccaaagtgctgggattataggcgtgaaccaccgtgcccggcctagacctatttttctaatagacagtttatctctcctgtagtcagcaagttgccaccactgctaaccacctatctaaagaaaaggatgttctatcgagataccacctctatagagcctcctcatgtggagctcaaccctcggggggagtcctagatgaattacagacctagaaggagccccctcagttttctagtgtagctccccccgctcatagaaacagacctagaaagggtcaggaacttgcccatcatcacacagaggcagtcaagctcatgacctccagctcactgcccatggtatttctaaacttatttcctcctttatcatctcccagctgagagcagagcttcttagcctctccatgatgtggatgttaggagcagaggagaagaatgggaataccatcggcctgaaagtcagaaaacctgggaacttcctgtagggccttagagaagcctctccatctctctaaacgttagtttctccatctgtataatggggataattatatgcctcaccgagtggttgtgagggttaaatgaaataatggatgtggaaactaatgaaactacatggtaggatagcaaaatgaggtgatataactgtcattaacatgaatgaggagatgataaaactttctgattcagataaaggaaaggtaagagttggcaggaaaaaaaatggtcagcagtatgctggaactggcttatatcaaccagtgagagctgattgttgttaaacatttgccagcacatctctggaaacagtgtaaatggctgaagctctgtggattcctgaggattcaaattctagaagactgtgtagagtgataggtagcaaaaggcttgagggaggataggaggttctagcagcaagctccctgagaaagaagtgaagtgaggactcggaaaacccaggttgttataagcctgaattgggtctctgtggagctcttgtgggtcccaggaggcaaagaatggtctcacagaaaataccaacctgtagactgtactgacgaggcatgtagccatcccggaagtaaaccacagcaatttcctggccatccctggaacacaggatggagaaggctgctgtgttaaattataactgatttgttcagtggttcaatctatttcagggtgcatcaagatgaatttggctttttcaaaattcagcccacagtgggagcctggtcaggggttcactggaaccagtgaaagtagatatccacactaccagggcttccactgaaaacagggaggtgtgccatacagaatactttagaatatgccagatttagagtcattctaagaaggccagaaggaacaagaaggtcactagaatcaaatttggtaaatgcatacaaatgttggctcgaaattaccgagcagcagaatcatactgccatgtgtagtaaaacacactttatatttccactgcttaaagcagctgaaaccagaatgaaaaaatttttaatggcaggggtgaaggtgaaaacgcaaacatgtaaaatgatgagtctgattaagacacaggctttttaaatgtcttttccttttctttgacctatttgatattgtctagtttatctgaaaagtaaattaactactttgtttagttatgataaaagcacattttgaaaaacagtgagtggtattgtgaaattccatggacagttttaattttaacaatcacaaaggtctaggtctaaatatatgtgctgcaatgctacccaaatatgtagcaccaaatctacctggtggtggcccctagagaaaaggataaggcttggcttggaacacaaatccaggctcgagctcagacagtggcatccagaccaatcacagcatgagccagctgctcctcttcctccctgactgcccagctcagcttctcaggcctgacctcaccttactaggagaggcaagaaaacttttgggaacttagggcatatgaaaactaagatgatctctaaggagaccctgatccagaatgtcaacagctctgatagaagcacagcgtggctggctttctccaaaatttcctgggaggatgagatatttcaggaattatgagagaaggaagcaagccatcacatctcccagaagaaagaatcattttggggaagagggtggcaggatgagtttcataaaccagccttccactggattcttgggaatgcttacacaaacagccttcggtcttggtccagagaccccttttcagagatatcttcaaatgttcgtcggatcacatggatgttcctgggaaaaatgggcaagagccagagggaatggatgctatgttctgagtgccccacccctaatcctggagccacacctagaagtcccccttcctttacttacctggccagtagctcattctctatggcacgctggtcaaatatgtttctttccttctcttgagcaatcagtagcaccagagcactggggaaagagcacaggtggcccgaggctactatagaacttgttcttcttttgtttctcccctcaacccccataccgccccacctcctggaataagaataagaacaccgcttccctgaaagaacagatgttccctctctcaggaaccttgagattacctcaggcatagacacctgatgctatcacatatgatttcctgaaaatagaaaacttcaaaaatgaagatgcctctgacccttctccagtgggcagatgaaatattgtaatgatgtcatgggttgatgaatttctgtgcaaattaaaatttagatttaaaaccatctcaaaaacccaagaggactttttcttagaacttaacataattctaaaatctttctggaagaataaacaagtgggagtattgaggaacattttgtaaaagaacaatgcagggggtccggggctaatggctctattactagattgtaaaggatacaataaaggaatgtggttcttacacaagatggaaccctacagaaacccacagggccaactacaaacaacgacattatctcctgggccctcccaagattcctataatgtacacagggccacatttgatctcatagtattaatgagatcactagggcttatgtggcttcttcctctctgattattcatgtatttcttaaagaggcaggggcttgagggctcagggaaaagcttatgccagggaactatctgtttggctgccagctaacatatttccgttgtcaaagataggtccagtcccctaagagattcctagggctaatgctcagcagtaccaaactgcattttttttcttttacattttattttatttatttttttgagacggagtctccccctgttgcccaggctggagtgcagtggcacaatctaggctcactgcaacctccaccccctgggttccagcgattctcctgcttcagcctcccgggtagctgggatttcaggtgtgcaccacccccgccggctaatttttgtagtttgagtagagatggggtttcaccatgttggccaggctgggctcgaactcctgacctcaggtgatctgcccgcctcggcctcccaaagtgttagcattacaggtgtgagccactgcgctcagcctccaaactccatttttgctgtgactgtactgctttgtgtctgtggcttcttcctgagacccatggaaccctaggctttggcttaggattctaagtgtgtattccctgacctcctctgcttagcctctcttgtctatctctgcttctcctgaccttggctgaacctcttagtctaaactctgtttgcctgactcctttctgcttagccaaaatataggtcttagtaagtcccctctcctggtttgcctgaaatctcatgaggtcagatgtgatgttaagctgagtcttggctttgagttgggtgcctgagagacaaactaaaagtggtgctctcacaagtcatcttgccctgagagagtcctaagggccaatggctttgctcttcactttgcagcctaaactgtcccgctcatgggtgagggtgtgtgtgggagggaggcagttggcccaggctggcccacctccaaaaagaggcggaggaggaaggctggcagctggaggttaaagaggaactgcacgccccagctaattaagtcagcctgccaactgctaaacaatcagagctgggctcagaaaacatatttgacctctcctgccttcagttctgagcagttctcagcagtctgtttcctagtaggaaagttgtcagctaaggacgcatgcgggctgggggtgaggacccctgagtcgtaggtagtccaggctctgccagtgacttgtagtgtgtcttggtaattgacttgggtaaggcaatttcgttccttgggccctggttttcccatctataaaataagagtgttatggctgggcatggtagctcacgcctatagtcccagcactttaagaggccgaggcgggcggattgcctgaggtcgggagtttgagaccagcctgaccaacatggagaaaccccgtttctactaaaaatacaaaattagccaggcgtggtggtgggcacctgtaatcccagttacttgggaggctaaggcaggaaaatcccttgaacctggaaggtggaggatgtagtgagccgagatcgtgccattgcactccagcctgggcaacaaaaacgaaactctgtctcaaaaaaaaagaaaaaaattggtgttaaaaagatcacagttcccaaacttttatcaccagtagtccccttttcttattctactcattctaaccacaggccctatgctttgagagtttgtctaaattgaaattgtaagtcattttgcaggcttccatttttaagaaattttaaaaatcatgagataattgacgaaaattaatctgctctaccaatgcagtttttcagtcaatactgtggaaccatatctcttaaaggcagaatagggaagtagagagaacataggctttagaggcagatgaattctatacttaccggttgtgtaactttgggcaagttattcaaactctcttagcctcagtttgctgttgtatgaattaaaactaatacttgtcaaatgatagctattattattattatttgggtttgttttttgttttttttttttttgagatggagtctcgctctgtcgcccaggctggagtgcagtggggtgatcttggccactgcaacttccacctcccgggttcaagtgattctcctgcctcagcatcccaagtagctgggactacaggtgcctgccaccatgcctggctaatttttgtattttttagtagagacaaggtttcaccatgttggccaggctggccttgaactcctgacctctgatgatccacccgcctcggtctcccaaagtgctgggattagaggtgtgagccactgcacccggcctattattattattgaaagtaccacataatgatccacacagatttttaaaaacatttttcagatccatgatctcatttaattctcactaacacccctttaggtattattattactcctattttacaaatgaggaaactgaagctcagagaagaactaacttgccaaggtcatgtgctatgtcagcagaagaacctatctcactctcacaatgggggaagccagttctggctcaggtgccacataactcctacctaccagtgcctaattttggacacacaagtattttctgtccacgttactgacaggctggcaggcaaaaccctctgcagcatttgtctgtcagcagttccccagctgacccatcccctggcttcactctcttaaaatacaacctagccaatatacttgaaagaatatttgtctgatgacttctaaatgcttacagtctgaggtttctttgggcttagtgaggcttagcaaggacagagaggctcccttggaggtaagagcatgattaagagtggaggttttagagggaggtagactttgggatctgccaccaactcatcacttagccttaacaattcacttcgtttctcagaacctcagtttcctcatctgtaaaatgagggagttgaacagtattgacctcagagagcttattatgagaattcaatgagatcctgtatgtacagagcttagcacaaggtgtagcactagtaagtgtacattaaggactattaatgctatattaacattgcaataactgttagtatagcggcccctcgatgatctgaaaatcacttacctaacatcttcacttgagaaataggaagaaagcaaaaaatgcctctaagcagttaaaaaggataccataaaatttcgtagtcaaagcttatgcatttactcatccaagaggccctcacactcttcagacccaatcataacaatctggatcatttgttttcccaaaccacagcaaatcagaagggaggcatgggcatggggggtggaggattccaaattcaagcataccaacagcagtcaaaagtaagagctgagaattgggaaacagacaagaaaactatgaagaaaatgaatgagaggccgggtgcagtggctcatgcctgtaatcccagcactttgggaggccaaggtgggcggatcacgaggtcaggagttcgagaccagcatgaccaacatggtgaaaccccgtctctactaaaaatacaaaaattagccaggtgtggcagcatgcgcctgaaatcccagctactcaggaggctgaggcagaagaattgcttgaacccgggaggtggaggttgaagtaagccaagattgtaccactgcactccagcctgggtgagagagtgagactctgtctcaaaaaaaaaaaaaaaaggaaatgactaagaacttaaagcctagcagtcagagctattagcgcaggcaaacagccttgcgtgcctctctaaccctaggtagcactactgtattacagcaagctgcaattgttgacagtcataatgatgacctccactcaataagaaaaagttaaatcatagtcagcatctgttatttaagaaggaaaccttaaaataattttggcatgtaaaggtataagtttctattcctagaaaaatccccttattctctaatgatggctggcaagaaaagaagttgctaaacccatgaatgctgaaactaaagcaggatcctcctgctaccttttcacacccttacttgggtgagccgtagagctcccaggctttggcaattcccagggccagtcccttgctgggattattagagaggatcttgccagcttctttggtcttactcaggacactgagaacatgtctgttggaagagagatggctgttcagtaattggatggacctggaagacccctctgcccatgacctcatatatacagcaacatgactctgagaatcagctgagcactaaaaagcatcctcccatcacattcctgtaagatccacttcaggttggaatatgctgggctgccctaaccttggcccctggtgtatatgcctggaggagacctgagagcctctgtccccaccccaacctaccctagtgtcccagtgagctggagccccttactctgggcctccaggtgctgtctggaatcctgctgcagaccatctaaaatcattgcaacctggagcatcactgctggctagaaatggatgctaccaggcccagcccccagacagaagtccctgcattcctctctctggggctctcaagatattgttccctctgcctgtacaatggagggacaggactagatgagctatgaggtcctttttctccctgacataccaaggatctcattacaagtggaaactgctgtcggggtggccaggggcaacatgtgacccggggcccaggaaagcacaatcatagctggagttccctggcctagccagtgactgtacacccatcagcatgtcaccccacaggtatgccgggggctgcccaggggacccaccggtgcacagctggggtccgggaggccaggcccccaaagctggcagagatggtgttgatttcgatctgtttcagggctggggagccatctgcgctgcgctggaacatgtagtctgagcgattcaggcccaggaacacagtctgtggggaaaactgaaggctgacagtacctgcccagggactgactctgaggacctagccacagagcacacaggtaccatgaactctacacagagattagaggtaccagcaaacactcccaagcccagtggaatcattcttctggtcatcctagaattggtcactgggataaacccagtgaggaccagtgagaggcagattcccatgagctgagggcctggaccaaattcttcaagcaaaacagaaaacaaacagagatgggagggacaggttacagactggagtagggctgggaatggttacctgggcaatgccctcttttaggacttgcttgtggatgtcaaagagacgagcggtaaagtcatcctgtttgatggtgctggaggaagaaacagagaacattttgcaggcttaattggacctaaaatttcaaggagtcccatcctcagtcattgactcctgaatcctctctgagtctactggccaaaacttgaatgtccgccccaatgtggtagagaacagtggctaagaatccaactctagacctgggttcaaatcctagctctaccactcactagtaggcaacctcagggaatcatttcacctctctgtgtctcagtttgctgatctttaaaatggagaatataattatatttatatcatagagttgtggtaaaaagccaataagatattacattcaaagaattgaacatactgcaccgaagaagagctagaaaatgacatgatgtatctattctacttgaatagctctgatggttggcaagccttctggttgacctaatactaactctccatagcttttcctaccctctgcgacctcccagggtgagccttctcctcctcctccacagcagcccttggagattagaagacagcagttatgccctgtgcaccaataagatttttctgacccaagctaaatatcctgggttttttttgtttgtttgtttcttcttcaactagtcctcatatgatgtgatttcctcagggaagccttccctatctgagtcagatccccctactatgtgttctcatagaactaagaaccactcctttacagcactgactgcagttgcaattttacattttctttgtgtgatgattagtgtcatctctcctgtttgactataaacctcatgaaggtaatggctgtgtctatgcaggctcatcgtcacagctcagtgtactgccatgacatgtgacatgtgttaggggcctatccagtatggttttctgaagtctcaacaagagccacagtaagaaggaatccacaggtgattaacatcacacttactgccctttgagattcagggtggattctgcacacctgctcaagcctgaatcaccttgttacagaaacgtcacagcagaccagtggggggaagccaagtagcccaggcctgccctgaagttcctctgctcctcagccagctctctcccaagggtgagctctctcatgccagcccttggttaggaggagagtcccagctgggcttcagcctccaaggaagttgagacacactttcctttttctgaagaggtgctccccttcatgttttgtagggggctcttctcccttaggaactagggtttatatgtgtatgagaggagagaggaacagagaaggcaggggttgcaaagatgagctgcaagtctccttcataattgcatcattagggttataagccaggctgctcatgtttcccacaatccaggattgcaggtacaaagctgggcccattccaagaaacagctcaggggcaaggtggtgggcagattcatacattcatgactcattgggtttttggctacaagtcaatggtttccaagcttcttaccattatgaccccttctcatattcacccacacatttttaaaagattttgtctccaacaaaagtctaatttctgttgaaaaattaatcaaagacatgcaattacaggttggatatcccttatccgaaatgcttgggaccagaagtctttcggattttggaagatttgcatatacgtaatgagacatcttggggatgggactcaagtctaaacacaaaattcatttgtttcatatacaccttatactcatagcctgaagattattttatacaatattttaattaattttgtgcatgaaacaaacttttgactgtgttttgactgcacctgtcacatgacatcaggcgtggcgttttccactggtagagtcatgtggtgttcaacaagttttgaattttggagcatttcagcttttggatttttggattagggatgctcaacctgtacagtatatacacatctagcatgtatatgtaaatacataatatttctagatatttaattctacaatgaatatatatacatatatatatgtattattatttctttttttttgagatggagtctcgctctgtcgcccaggctggagtacagtgtcgtgatcttggcttactgcagcctctgcctcctgggttcaagcgattctcctgcctcagcctcccaagtagctgggattataggcacccgccaccacacccagctaatttttttatatttttagtagagacggggtttcaccatgttggccaggctggtctcaaactcctgaccttaagtgatccacccacctcggcctcccaaagtgctgggattacaggcctgagccaccgcgcccagcctatatatatttaattctaaaataaataaagaaattttaagaaattgccccagaatctgaagaaaaaaaaaaaaagatcaagggaaagagacagagaagggcggatgggctgaaccatttcagaggttgcttcctcatgccctgagtgtggcccagtctgtaccccatcccatccaaagatgagaggcctgaggtgacaagaaagtgtcgctgcttaggagaagtagaaaatctgactttaacccaataaccttccctacctctgttttcctccaaaaccaggctgacttcccctaattccaaatggaaatatcagtcttcaaagtagggtgtcacggattacagaatgtcaacaataaagggatcttggatttaagccagtctcttcatttttcagatgaagaaaccttaggcccagagaaggaaagggagtggcttgaggccatataaataactggtcgagccaggattagaagccagctttcctgactcctatgactttttgttctttggaggtacctttcctctatcccaccaagtcagctgacacagtaacacctcacggctctgcaatcttccagttccttggctctggcagctcctggccccccaatgcttcactgtcccctacctggaaagagtttgctccaggaaggcagcgttctggctgacagcatccactagcaggttgaagtccatctgcacagcataggcttgctccagcagggcactggggaccagtgaggggaagagcgtgaatggggcatagctcaccacctgtgatcaagaagagagaatgggacaggggtagggcacctgtgaacgggttgtcttcctgcaaatggaatcccatggaaagtctggcctatatttactgaggacacaccaactgtagattagtggttaccttgggagagtggaagggggagagtggaacccagagagcttccagattctgtgatagtttatctctacgtattgaagagagagaagcaaaaaagcaaaatgcaaataacaaaaagaaacccacaagttattgagcacttactatgtgcaaggtactattttaaatactttacatagattcatcattcagccctgtgaggaagatactattattatccacacttaacagagacgggacctgagaaagagaggttaacagatccaaaattatattcagctaggaactggtgctgggatttgaaccagaacagttaacagatccaaaattatattcagctagtaacggggtgctgggatttgaaccaggatggttactaaacacaacacacacatacatacatggaagcctgctccttgctggttgatgttcaagcccaggcccttccatgcatcaggagctcacactccagtttccttgccttttgattttgatttggttactgggtaggacaagtgaactctggttcccttagtagaagccaggagtgttttttccaccaatgttagtgatggtgactcaggttaacaggcctagagttcagctgcattccgcattctttggactttatcatagacgagaaacccaaataccatcaaggacactgattctagaagggaaaagtgcattctgagatccctgccaacaactgaactagaacttgggtaagagatgaaaagaaaatcttgtgacttgtattataaagcattcctgagtttaacctttgagttaatatcagtttgtcattatggtggtataagtttacggtgttagaacttggtatttagatatttatttttaaagtactatttttttttttgaggtagagtctcactctgttgcccaggctggagtgcagtggtacaatctcggctcactgcaacctccatctcctgggttcaagcaattctcctgcctcagcctcccaagtagctgagactacaggtgtgtgccaccacacccaggtaatttttgtatttttagtagagatggggtttcactgtgttgtccaggctggtctcaaacacctggcctcaagtgatctgcctgcctcagcctcccaaagtgttgggattacaggcatgagccaccatgcccagccaaaatattattatttttttaacaggtaatacaaatacatgatacaaaattcaaaagagacataagaatatatagtgagaagtatgtctcactctcattccagtctcctggggaaaagactgggccccagccacccagttctcctccccagaggcaaatgacagactagtgtctcacacatccttccagtcatctttgtattgatatatatgtatacacatatattttctctttttttcacccccatagcaaactatactacattgtgctttttaaatatttccttatatgttcaaatagagcattttcattatttttaattgctgtatattattctactcttaggatataccataatttattgaatctagtatataggtggtttctttattttcctattaccattaatgtttcaatgggtatcctagaatatacattctagatattttcatatatgagaaagtccatacattctaaatttctaaaagtaaaaatatcaagtaattcaggtaaatctattttaaattttggtagataatttctaaattacccttctcagcatcttttttttttttttttggagtggggtcttactatgttgcccagactggaatacagtggctattcataggtgccatcatagtgcactatagcctcaaattcctgggctcaagcaatcctcctgtctcagcctccccagtagctgagactgcaggtgtgtaccactgccctggcctcagcatctaagataaaactgaggaaggctatttgtgagaataaggtttattcagtctgaagcctttatgagttagaatgggaatgactgcagattacataaggggtgacctaataccctgagtagctatgtgatgactacaggagcatttccttggcttgaacacatagagctctgctgcccccaacaagtctcatcttggcctcaaaaactcagagtttttctgctaagacatccctctgcctctgtcccagggctcattatgccctcctgaatttaggatcaatagtttatagctgttctctgctatctacaggctaaaggctgaaacacacagtcttctcacttttgatagagacattaacataaaatgacattactggccgggcacggtggctcatgcctgtaatcccagcactttgggaggccgaggcgggcagatcacaagatcaagagatcgagaccatcctggccaacatggtgaaaccccatctctactaaaaatacaaaaattagctgggcgtggtggcacacacccgtagtcccagctgctctggaggctgaggcaggagaatcgcttgaacccaggaggcagaggttgcagtgagctgagatcgtgccactgcactccagcctggcgacagagtgagactctgtctcaaaaaaaaaaaaagaaacatttttctactatttaaaaaaacctatagcacgtgcatgacaaaattctgctttgtagccaggaagcaacagggagtgataggaattgtggcaaaaagaagtacttgcatcttctctaaagggggcagccagaactctgctctagccaattgttgccatgcaggaaagtaggccagagttgccagatgatataatttttcaagacaagttgggttgctagattttttgttttaatttcatgatttttttttttaaatgttggctctgactttttaaaaatactctggtgaaaacaactgttaacaatgcttgcccctggtcagggaaacagtggctggaggaaggggacttactctgtactgaatacccttttgaattttgcgccctgttcaaatgtatttgaacgtattacttattgtaaaaaacaaattaactccccaaacactgcaggagccaaatactcagcctagatatggctagtttgcagctctgatctacaggataaagttcatactcctcctccacccagtagctaaggccccgcggctgtctgacgctggcctgccttctttcccactatatccacttatgcgccctgcatttcagctgcattctcttgaacatttttttttttttttgccttttcctacttttgggtccttgctatgctgttccttttccctatttgtcttttaaggtctagttcaaataccaccccccatctcaatcatctaatcataatgaactactctttcttccagctgtcctatatagtatcttgggagaggaaaaaaagcatggatgttcagagcatggactcaggagccaaattccttgggttcacatcctggctctgccaattattttaccatttaaataacctcaggtaggttacttagcctctctgggcttcggtttccttatctctgttgtggtgaggagtcagtgattccaaagtgtttagaataatgcctggcacatactaaatactcaataaatgatagttaactttgtgtagcagactgcctgtgtttcctcatagagctgatgttatttaattttgttttgtggtatgttctctaactagaccaggagccccagaggctagggctctggctgactcacctctctgtcctcagtgcctacaatggcccggcatagagcaggcatttggtaaagatttggagtaaaatcattctctctctctctctctcacacacacacacacacacacatacacacacacgtacactttctgactttttttctggattagaaatctcattgtggattacgccttttctaggctccataacctcccagaaagaccaagtgttggatcttcacatggtacctattgattaacagaagaaacaaaagcgtggaagagaaaatgcttcattttagattcatacaagtaattcacaaaatctaggttcacagcccaagcaattctattccataccatcagcctgccttaggtgacagacattgtcatttacttgggccttagcaaacaattactgagtgtggactccatcaggcctgtgtaggttctgggcacacagagacaaaaaagaatgggtctggctaaaaaaagaagagatgttggcagctctttagtcaccaatatggtcttaaggtgtactgttaagttaaagaaaaaaaagtgggcaaaaggaggctgggcacggtggttcacacctgtaatcccagcaattttggggggcagaggccagtggatcacttgaagtcaggagtttgagaccagcctggacaacatggtgaaaccctgtccctaccaaaaaaaaaaaaaaaattagccaggcgtagtggcacatgcctgtagtcccagctacttgggaggctgaggtgggagaattgcttgaacccaggaggcggaggttgcagtgagccaagattgtgccactacactccagcctgggcaacagagcgaggccccaaggaatatatttacttgttattagttacttgttatgaataagccatctgaaaggatcaacaagaaaccaaaacacaagctgcattagggtaaactcttgtaccatttgaatttgaaccatgaaaatgtcttacctagtcaccaaattaaaaaagattttatttttttatttttttttcttccctaaggatgaggttttaaaaaggtgtggtttggactcagcagttctacttttacgtattgaacctggagaaacactcacataggtgccccaacagacatatgcatggatgttccctataatgctatttatggtcataaaataatgagaaatcacctaaatagacatgagtagagggaagctaaactgtgatacacccacatctggaatactatgcctcagaatgaagatgaccctaatagaaggcattagaaagttctaagacagacaaataaaaaaccaaaaacatatcatagaataatatatatgatacaatttgttttttaaaaaagacgtatttctatatatacctatctatgtatataaatgcacagagaaaggcttgaaagcatatatcacaaaccagttacagagaaggtagagtgattatggggttttcagtaatagctcactgggcaaagtgcttcacatgaatcatcctgtaattctcttaccaaaccagtgaggtaggtcctattattatcccatttttacacctgaagaaactgcagctgagagcggttaagtaatttgcctaagtcacacttcaaaccccatatttaaatttgattactccaggacactgcctttttattttctacttctagagatcaattttagttactggaaaaaataaggcaaaagagatatggtccctgatgcaaaggagtgaccctcagcctggccggggccagacagtgggccatggtgaatgctgtggggaggagctaggggcttacctccgaggaagtgggctcctgtgaggtcctcagcaatactccctcagccagggcccggtccacggcctgccgtgccagctcctctagctgctgtttatcctgcaagaggctcccccagttggtggccatcccaacacctgcaaaagatggagagaagagagttggtaacagatggcctgaagcccagcaaccaccgaaactggctggcggccacccccaacacagcaggaccctgacctctgttggaagggaacagcgtggtatacaggagtgaacactggctggttctagctcttaacaacttccatgtgcacaaaatagaaagcttgacaaagcatttccattgccactctctcttttgattcccaacacaatggcattattctcacagtaaggaagcagaggcttggagaggtgaaatgacttgcccgaggtgatgactggtatagcctggacttgaacccatgtctctggactcccagcctaaaggctcttcattggagaaagaagcactaatatcagatgtgactggggcaagttccttcccttcccagagctacagattccctaactgtgaaacaagaagaatcggatagatcagtttccaaacctggctgaacattctggggagctgggaaagaatacagattcctgggccccatcccagagactctgatgcaagaggcctgatgggaaggaggggttgaggctttgtatttttttttttttgatatggagtctcactcagtcgcctaggctggagttcagtggctcgatcttggctcactgcaacctccgcctcctgggttcaagtaattctcccgcctcagcctccctgagtagctgggattacaggcacacaccaccacgcctggctaattttttgtattttagtagagacggggtttcaccgtgttagccaggatgatcttgatcttctgaccttgtgatccacacgcctcgacctcccaaagtactgggattacaggcgtgagccatcacacccagccgaggctttgtatttttaacaagttttcctgggataggagtcactgcagtacattattaattcccttcaagctccaacaactcatgtcagcagatctcaaataaattacatgggaagggggagggagctctttgtggaataccatgaaatgcgaataaggtgaactcctcccttatacaaaccagaaggaatcttagtagcaggaaatgactacattccatatatggacatttatcatcaaagcaccaaaagacagaaaatatttttgagaaatcacattagcaagatggaaattgctgaaacccaagtgtccaatgtaataggagaagttgtctgattggttgcccagagacatacagaggtgtacaaactcacaccctgatactcattcatttttcagcaggcctcaggagtttaagatctgggtaaaaatctggaaacacagtcactaattttgttctgccctgttgccatttaacagaacatggttgcccaactcagtggtccccaggaagggagttagagaataataggaaacctccatcacattcagctctgtccccctgtccccatgacagagccagtgccaggccaattatgaaagtctgccagcctcagcacaatgctttgaaagaatgcgcatgtgatctcaagagggtcctgataatatccctgttgagtgagacatacatgagggcaatcatagtaaagaacaaggttcaagtcagacagacagacagacctgggtttgagtccataataatacgacttctccctttcccttctttccttccttccttttccctttccctttcccttccctccttctttccttccttccttccttctttttctttctttctctctctctccctccctctttctttctttttttttttttttgacggagtctggctctgtcgcccaggctggagtgcagccgcacgatctcggctcactgcaagctccgcctcctgggttcatgccattctcctgcctcagcctcccgagtagctgggactacaggcacctgccaccatgcccggctaattttttgtatttttagtagagacggggtttcaccgtgttagccaggatggtctcgatctcgtgatcccccactctcggcctcccaaagtgctgggattacaggcgtgagccaccccgcccagccgacttccctttcaagtaagattgctgtgtggattaaaagagaaaaatcagtgtgaaatttatcagcagtgtttgaagctctatacatgagaccattttttggctgtactctctttataggtaggaggagacttgtcagaggtcacacagaagcctagtggcagagccaggacaagaacccattaccttgacattagagtaatgaaaccctccatgagcccccatcgttccacaactctgaaattccaacatctgtttgctgttgggcttttatttagttggcaaacactgatttgcatttaatgccactcccttgactaggtactggggatatggaggaggataagacataaagataatcaccatgggccaggtgtggtggctcactcgtgtaatcccagcactttgtgaggccgaggcaggcggatcacccgaggtcgggagttcgagaccagcctcaccaacatggagaaaccccatctctactaaaaatacaaaattagccgggcctggtggcgcatgcctgtaatccgagctacttgggaggctgaggcaggagaatagcttgaacccaggaggtggaggttgtagtgagccgagatcgtgccattgcactccagcctgggcaacaagagcaaagctctgtcaaaaaaaaaaaaaaagaaaaaaagaaagaaagaaaagaaatcagatgaaggtgctaagtgggccctttgtttttctcattctacagcctcaaccctcccttggctttatttatgttttgctgatgacattcaaatctacatcttcacagcaatactttcctaccttcaaactagaatatccaattttttcctgcgagtctccatacaaccagaatagaatttgttgttgtctcccacaaatctgcttcttctctgatgaaccccacccaggtacccaagccttgagtacttgtttcctacatctcactctccccaaatcctatggattttgctgcctaagtatatagtactttgaattcctttatttatctccatttccagagtttgtagcctagccccggccactgtcatctcttccctgggcgtgaaacagattcagagtcaggtgtcttcagtgaccaggatatgttggcctctgtcccccttccaggacttggcacgtgctgtcttctctttggaactctcgccaccactcctgatctgggctcgcgatttcgttccggaagctgtccctgttctccgccccgggcttctacattctacagcccatcacttttccctgtaccgtaggaacagtgtttgtcttgatcacttctctacctagtaattagccgcgcttagtactgtattcattcatcacatgaatgaatgaagaatgaatgacagacgggtcagatcaccgaaagcctcaaaacgcccacaaggaaatcggtcgcactttatcgccaggacttaggccagtgcctggaaaggccccgaggcaacgacacggtcggctgcccaggctggccccacttcacgggcccgctcgcttccaccctggacaaagtttggccctaatcgctccccgttgtagctctaactggctccagtctcactggcctacatgccccgacaccggcccgatctaaaggcagaagatccggaaagtctgggatcagtgcgcgccagcccaaccccctcactagacactagttgccccgctcctacgaagggtttcagccacaaggtctcccggcctccggaattccaatctcttgccagacccctccctcacatcgttcctcccgaggaaacgtgacccatgccggccgccgtggccgccccaacctactagttcgcctttcctccgcgaacggttctcccggccctcgcgccgctacccaggctcagggggcggggcctcgatgcgacccagtgcgcttgcgctgaccgccccggctaggcttaaagagcaggcggggcagagacccatacctttggcgctgagtcgaggccaggaaggggcggtcgatgagagggcggccttagcattaggagtgcgtcggctgcaccctggcggatggaccttgggaaggaggggaggggaccatcggggtcggcggggagctacgggtatgcatagctcatagagcgtcagagctgacgacgactagtggaagatggggaaactaatgctcagagcgggacagtcactacctcaggggcacacaattgataagggtgggggtggccgtggtaatggaggccccaaggaggggcaggggcccatagtacgtcaggggctgagcctgtattagaacccaggcttgtttcccagcccagccaagtcccagaaaaatccccctgattttatctatttttttttaacctgggataccagcagggaaagcattagaggcaaaaggaaaggattttcatttttccaggaatgctgaagtcaggactgtttgaggggagccctgtgtttctcagactctcttgtaccgtttacatcaggatctggggcagtttttaaaaatatgcggattcatgattcctaccccccacctcattgcttggcagcccccaggtgccttccctgtttcttccttctgggttgtgataggcttgtctgcagtccgaagcacctgatacgaattttagttaaatggaatgtatcagtccagcttctagggaattaaccataaataagacacagccactgctttcagtctgataagataggcaataaactgcctttctgaaggaatcagggatggtttttggggtcttgaaggatggataggaaggtataggtagtgaaggaggtaggggtagaggtgagaggctgggatggggacagtgttccaaattgcaggaacaaaagcagcaaaggctggctgggtgcagtggctcagacctgtaatcccagcactttgagaggccgaggcaggtggattacttgagctcaggagttggagaccaggctgggcaacatggcgaaaccccgtctctactagaaatacaagaattagccgggtgtgttggcccgtgcctgtaatcccagctactcgggaggctgcggcgtgagaattcttgagccccggagacggaggctgctgtgagctgagatcacgctgcagcactcctgcctgggtgacagcgtgagaccctgtcctaaaaacaaaacaaacgagcagcgaaggcatataattctgagggttgctcggcttgttttacagacactgaggagtttggtgtggataatgaggaagggcctgagggttgcaacaggacttaggcgcttaggcttggagaggtagcctcagacgccagttccactgagcaacaggagctaagggctttaagcaggggaaggacatggttagttttgtgtgttaggcactggttacagcgtgacaaatggtttggaagtggggagatgggccagagaaagcagagagagttaagatgtgagatcatgaggctgtagccagtgcagcagctgtggagatggagcgaagcgaacagatcaaagaaatttaggagtgagaactcctagtgatcgtaaatcagtggcccaacccagggaccaagatccttttgactctttttttttttttttttttttgagacggagttttcgttgttgttgcccaggctggagtgcagtggcacgatctcagctcactgcaacctccacttcccaggttcaagcaattctcctgcctcagcctcccaagtagctgggattacaggcgtccaccaccacacccggctaatttttgtatttttggtagagacagggtttcaccatgttggccagattggtctgaaactcttgagctcaggtgatccacccgccccagcctcccagagtgctaggattacaggcgttagccactgcgcccggccccttttgactctttaaataaaccatgtacattatctgactacaggacaggctgagtcctccagtctcccgtgtgtggtcacgggatggggggagatggtggcagataggtgtctggttattcccagaacaatgtttcctgatgtcctttcctcgttggcttttgtacctgaggggataagcagctgttaactagaataggccccaggtggcaggaagaggctcctgggtcaaccaggaacaaaagaagctatttctagtgcagcatgaaattaaaaatcaaaagcatgacccagggttctctgtgcaggttcccctcttccaagacgggtgccaagtgatgagtatcaggtgtctatggtgagatttggggaggatcccagaccttaacagccctttggttgaaacctctcacaatgtggcaggtaagatgtctttattcccattttgtagatgtggcagctgagcctcagaagttacgtgacttgttcaaggtgacccagtttgtggtaggactgggagtgaaggactcttgactaagaatctttccagggagcgtttgccctttctgcactctctgcctgggtgctttcctccaaaatcctggcatgactggctcctttggtcattcagatgtttcatccctggaggctgccccaccctataagtctatcacgttatccttttcttttttttgagatggagtctcactctgttgcccaggctggagtgcagtggtgcgatcttggctcactgcaacctctgtctcctgggttcaaacaattctcctgcctcagtctcctgagtagctgggattacaggcacgtgccaccatgcccggctaatttttgtatttttaggagagacagggtttcaccatgttgatcaggctggtctcaaactcctgaccttgtgatccgtccgcctctgcctctcaaagtgctgggattacaggcgtgagccaccgtgcccggccttgtattttcttcatagcagttattcatatctgaaattgttgcttttatttgtttgctgtttccctctgctagaatgtgagccccatgaaaatgggccatgtctgtcttgttcaccactttacccccaggacctgactggtgcctgccacgtggcagatgctcaataatatttgctaactgatggaaatagtttggggagagagaaagagaaggaaaccaacatttaatgaaagctgaggatgtttcaagtacttctcacaaattacctcatttaatcccttcacagcctttcaaggtagaaatcgtatctccattgggtgaataagaaaccatgctaagtcaggtcaagtctgtggtttgttacttttgaggctatagactcgtctgagatccattagtataaaattttgcatcagctacgtggaggaattcacagaccttctcaggctcacttggggatctcagatcaagacacataggattggggaacttgcccagggtctttttggccccaggcctttgctggatcctcactccctggcaaggatggagtccatgtagtggactgtagggaacctgctgaagattccggagcagagggagatgatttgccctgagcctctggtgtctcagacctgagtttgaatcctgactgtgcagaagtcatctcacctctccgaatcccactttcctcattttattttttttctttctttcttttttttttttttgagatggagtctctctctgtcacccaggctggagtgcagtggcacgatcttggctcactgcaacctctgcctcccgggttcaggcaattctcctgcctcagtctcccgagtagctgggattacaggcacatgccaccatgcccagctaattttttgtatttttagtggagacagggtttcaccttgctgtccaggctggtctcgaactcctgacctcgtgatctgcctgcctcagcctcccaaagtgctgggattacaggtgtgagccaccgcgcctggctttcctcactttcaaagtgaaatctgttttttcctaacaataactaccctttattgatctggtcgctaagtgtcaggtacttggctaatgactttacagtcgttatctcactttcccttacctccctatcacatcagtatctttatagcctccattttacagccggggaaaggaaggcttgaagaggtatcctgacttgccaaagatcacagcagcagtgtcagccatggtgttcccacatatgtaccttgggacatgccatgggctcagacttcccaaagctaactgttgaatcaatttcatcctctgttcttggggtttgtgggaacatttgggtctgaattaggtgaaaaaaggtatgcagggatgtacttcactgtgaatggaggccaatcccttaattttgtgtcttgcctttctccctgcgagggcctctctccaagtctggactgtgggttttttttgtttttgtttttttgagatggagtcttgctttgtagcccaggctagagtgcagtggcgccatcttggctcactgcaagctccgcctcccgtgttcatgccattctcctacctcagcctcccgagtagctgggactacaggcgcctgccaccacgcccgcctaattttttctatttttagtagagatggggtttcaccgtgttagccaggatggtctcgatctcctgaccttgtgatccacccgcctcagcctcccaaagtgctgggattacaggcgggagccaccgcacccagccactggactgtgccttttgattggaacatctctgtcagccccagggtctgcatcacacatggtctgcatctgtgcacatggctactgtctctttttagcagtgatatcaccctgcctcatactgttgtttatgaggccatctccccacctggctgggggccactgctttggccattcagagtggaattcctctgtcttccagcccctagcacaggcctgggccagcattgctgctcaggaaatgcctgtggaatcaaagtgaggactgtcccaggtgttgaggatttactgtatgctaggcctgtccctgacactttatatgtgttatctcatttacacccccacagtcatcctgggagggagaagttactctgcctattttaccgagaagaaacagactaattgaagttgggctttgccttaggccctcttgtggtggttgatggcacgagggccaactctagggtctgtgccctggtcgtgtttgaggtgtgtgggctgaaaaagggaagacacacttcaaggctccagggatcctcagagaccttctactaacaggttcccagtccggctctcatttcatccgtgaggacacagaaggttagaaaggggagataacttacttatagaccctcttctccacttgttatatacttatgtatccacttactttttggcaggatggatctgttttgactcaacattgtaccacccatgtagcccagtgcctaatccaggttgatgcccagtaaatacttttacattttatttattatgaaaccactgagaaaggtataaaaattaacagaacaaatacctgtgtacctaccatccagcttgcaaaataaaacactgctaatataaagacctttttgtttccctccatgactgaccccccaacccaagaagtaaagactctcctgatttggtgtttattattcctatgcaatgtttattgagatataattcatgcaccataaaactccccctttaaagtgtgcaattcagtggttcttggtatatttacaagattgtacaaccattaccactgtctcattccagaatattttcatcaccacagaaagaaacctcatccctattagtagatactccacaattctccttctccccagcccctggcaaccagtaatttactttctttgtctatggatttgccttttctgaatatttcctgtaggtggaatcctacaatctgtggccttttgtaactagcatctttcacttagcataatgtttgcaaggttcatccatgttgtagcatggatcagaactttattccttcatatggctgaatagtctttcattgtacagatatatcacactctgttcctccactcatcagttgataggcatctgggttgtttccactttttgccattaagaataatgctgctatggccaggagtggtggctcatgcctgtaatcccaacactttgcgaggttgaggtgggaggatcacttgagctgaggaattcaaggccagcctgggcaacataaggctctctacaaaaaaatttaaaaattagccgggcgtggtggcatgcgcctgtcatccccactactagggaggctgaagtgggaggatcacttgagcccagtaggtcaaggctgcagggacctatggtcacgccactgcactccagcatgggtgacagagcgagaccctgtctcaaaaataattataataatgctgctatgaacattcatgtacaggtttttgtgtgaatgttttctgttctcgtgggtagatacctaggagtggaattgccgggtaatatggtaagtatatgtttaactttttgaggaactgctgttttccaaagtggcagcaattgtatcagagctccaatttttacatcctcaccaatacagttatccctctgtatctgtggggaattggttccaggacctcccatggataccaacatccaaggatacttaagtcccttatataaaatgatgcagtgtttcatatatgcttaagtcccttatataaaatggtgtagtgtttcatataaactatatgcatcctctcatatgctctttaattttgttttattttattttaaatttaaatttatttttatttattttgagacaaggtctcactctgtcaggctggagagcagtggtgcgatcatagctcactgcagccttgaactcctcggttcaagggatcctcctgtctcagcttcccaagtagctgagactacaagcgagagccaccacactgtcctttccatgtactttaagtcatctcggccgggtgcagtggctcacgcctgtcatcccagaacctcaggagaccaaggctggcagatcacctgaggtcaggagttcgagaccagcctggccaacatggcgaaaacccatctctactaaaaatacaaaaattagctgggcgtggtggcgcacacctgtagtcccagctattcagggaggctgaggcagagaatcgcttgaaccccagaggcagaggttacagtgagctgagatcgcgacactgcactccagcctgggtgacagagcgagactccgtctcaaaaaaagaagtcataaatgctatataaattgttatactgtattgtttagggaataatgacaaggaaaaaagtctgtacatgctcagtacagttgaaacattgttttcaaatattttcaagctgcagttggttgaatacacagatgtggaacccatggatatggaggtcccactgtacttgtctgattgtggccatcctggttggtcattgtggttttgatttgcattttcctaatgacaaataatgcgcatatcttttcatgtgcttattggtagtttgtatatcttctttggagaagggtctatttaaatgttttccttatttgtaagttatttgtccttttattattgggttgtaggaattctttatatattcaggatagtagatccttccttatatgtgatttgccaataatttgtcccattctgtggatggtcttttctgtttttcgatagtatcttttgaagcacatattttaaaattttgacgaagtccaatttatttattttttcctttgcttgtgctttgaatgtcatatctacgaaaccattgcctaattcgaaggtcacaaagatttacacttactttttctaagagttttatagttttggctcttaaatttaagtctttgattcattttgagttaatttttatataggatgtgaggtaggtcttatgcatttttaccctcctattaggtgtatttctaagcaatatatgacactttttcatggtatttgcacttttaagtggtaaattatatgattcttgtgcagcttgcttttctctttcagtgttatatcaggagatttatccatgttttaaggggaaatagttcattcattttcactgctctataggtttcattgcataaaaataccaaagtggcagcaattgtatgagagttttgtttattctcctgtgaatggtcacttgggttctctagtattttattactatatatggtaaaaagactaatagatgcctcctgtgcagtgtgttgaaggtcgtgagcatattcagacttacaaggtaatacaaagtttctttcccaaatggttttgcaaatgtgcactcctgccagcagtgtattagaattgccctcattctgcatcctcaccgagacagaatggtcaaggtttctagcttttgtcagtctagtgatgtgaaacggtgtctcgttgtgattttccagattaatagcaagatttgtttttcagtaagtgtttacatggttggatggatgaatgcatgaaagcagaaggggcccagaataaccctttactctgcctgttgttggaggatggcagggctctgggcctagactatgtggctctctgtagggacaccgtggagctagagaatgttgggggcaggctgacaactctagatgtgggagaggacggttgtcaccttgaaactagtgatgggagcttctctctacccagggagaggctatcgtcctgctcttccatctccttgaattttccaagaagggagggagtggagaaagagtgaagccaaaagagaattcctgggactgggcgcggtggctcacgcctgtaatcccagtactttgggaggccaagacaggaggatcacttgagaccaggagatagagaccagcctgggcaacatagtgagatcccacctctacaaaaaatttttgtaaaattaaaaaacaagggaattgcctaaggatgagaggtcacagtggcctaagtgacccttaggaatgaccctttttctgggactttttcatgatctttatattggtgtgacatgaactttccttgtttaatctactgagtttggagatggtcttaatgataataagaaaatgaatagtaatgattatatgttgaactcttatgtgccaggcacttacgccttttctttttaaaaataggtattatctcattcaattcctatgggacaggtactattagtattcccattttattttatttttaaaatagggatgagtctcactgtgttgtctaggctagtctcaaactcctggcctcaagtgaccctcttgccttggcctcccaaagtactgggattacaggcatgagccaccgcacctggctcattcctgttttatagatgaggaatcagaagatcaaagagacagagcaactctgagggtttgcacataggcagttggactccagaactcttaggcatcatgctgtgtggttaacctggctcagccgaatccactagagcaaagaaaagagaggcttgcccaggcttgggtgagaaacaggagtcagaatattcactgggcctggcctgagggcgcagcagggagcagagcgagaggccgctgggaaagatggttctcaaaagcagaagcctcacgccaggggacatggcccatcagcaagcacatgggtgcctcttctgggcatgctggctgctggggacccagaatgggatctgtctgctcctgggtctcaagaaagacctgtcttgtggggtagacagatgataataagcagacttacccataagtgtaatacactcagaaatggggacatgtgatacagagggtgaagagagaacctttatagaaaggacctagtttagttaatgtagtcaaaggaagcccctttgaggaggtgacatttgagtggaggctcgagaagaaggaagcagccatgccccagtttggggaaagagtaaatggcagat

SEQ ID NO: 514 - DNA, 91496 bp, Homo sapiens
acgagacagaaagtcaacaaggatacccaggaattgaactcagctctgcaccaagcggacctaatagacatctacagaactctccaccccaattccacagaatatacatttttttcagcaccacaccacacctattccaaaattgaccacatacttggaagtaaagctctcctcagcaaatgtaaaagaacagacattataacaaactatctctcagaccacagtgcaatcaaactagaactcaggattaagaatctcactcaaaactgctcaactacatggaaactgaacaacctgctcctgaataactactgggtacatgacgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaattgacaccctaatatcacaatgaaaagaactagaaaagcaagagcaaacacattcaaaagctagcagaaggcaagaaataactaaaatcagagcagaactgaaggaaatagagacacaaaaaacccttcaaaaaattaatgagtccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctacacaaataaactggaaaatctagaagaaatggataaattcctcgacacatacactctcccaagactaaaccaggaagaagttgaatctctgaatagaccaataacaggatctgaaattgaagcaataatcaataggttaccaactaaaaagagtccaggaccagatggattcacagccgaattctaccagaggtacaaggaggaactggtaccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaatgaatccagcagcacatcaaaaagcttattcaccatgttcaccatgatcaagtgggcttcatccctgggatgcaaggctggttcaatatacacaaatcaataaatgtaatccagcatacaaacaaagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattctatatctagaaaaccccattgtctcagcccaaaatctccttaagctgataagcaacttcagcaaagtctcaggatacaaaatcaatgtacaaaaatcacaagcatccttatataccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctgggggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagcttacaccttatacaaaaatcaattcaagatggattaaagacttaaacattagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaagagaaactaccaccagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcgcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaatatcatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgatattggaaatcatcattgtcagtaaactatcacaagaacaaaaaaccaaacactgcatattctcactcataggtgggaattgaacaatgagatcacatggacacaggaaggggaatatcacactctggggactgttgtggggtgggaggaggggggagggatagcatcgggagatatacctaatgctagatgacgagttagtgggtgcagtgcaccagcatggcacatgtatacatatgtaacctgcacaatgtgcacatgtaccctagaacttaaagtataataaaaaaaagtcataatcacaagattattttaatcagagaaaattattaaaattttatttcctaaaataagttgatggccaaaagcttttgaatggctttctaaatgattttctctacttgggaagttaaactgactaatgattgtgtgtctgtttctgatgttcattaatcacaggtaaattagtagacacctcaggttctgtttaattaataaatcatctctgcaattgtgcatcttgaacttcaaaatagcacttgttgaatctggggaagcattcaagattcctctgtaaatgaatcttactttttgtttaatgcttaatttaaaatactttttgatatgtaaaaaacttgtcatgaagatgttaaccaaatttatttgtggaaagctattatgtgaaaataattgattatggacattaaccaattgtatgacatcagctatgacatgtattttgagggccgttgacctcgatttttgttcttgagattttttgtgtgtgtgtgtgtgacgaagttttgctcgtcacccaggctggagtgcaatgatgcgatctcggctcaccgcaacctccacctccagggttcaagcgattctcctgcctcagactcccgggtagctgggattacaggcatgtgccaccacgcccggctaattttttgtatttttagtagagacggggtttctccatgttggtcaggctggtctcaaactcccaacttcaggtgatctgcccgcctcggcctcccaaagtgctgggattacaggcgtgagccaccgcgcccatcctcttcagattttttaatgctggccttgaattggttttcccgttttcttctctctgttttgattcccttcattctttagtgtttggtctctgtggaacaagagttgttcattctgactatcccagaccttgcatcagccctcccatggcttgatgttcctgttgttttcttgagctctcgagtgatccgttcttgagtgagctatgactttgtctctttcgtgcttttccctagtatttgaatccttttaattaaggtgtttattggaaaggatactttaatagtactttttgtttttgtaacgcaagtttattatgctaatgctttcaaaccaatgtgttcaatagagatgaaaaaagaaaactaattcctccataagcatgtttatttttttttcctcacctaagacaaagctaatgctctaaaaggttgtgagtctccttacttatgtctttacccttggacaaggtaaaacaagttataatggagggtgttgtgggtgtgactgatgtttattagtccctagcaaattagtagatgttttgtctcctgatacctctggctttgattcatgtttgctcactacagaggggcctcatggactttcaggatggcactcattcatcggagaaagcattggagattagtacataaatctgttgtatttattttatcatttgtttggtttaaaacatacttttcctgagggataaaacgtcctcccttttttctgtgttctaattggcatcagcttccgtgtatttcaaggcagctgcttagtgaggaagcgcagggggcgctgaagtccaaacacaccctcgcctgctccctgactcctccacaatagaagagagcaatgaccagtagttggaggcactttacttttttataaaataaactaatgtaaacccagctttggacacattgaataatgaccctttttcaggctccaaatgaactgtctgtttaaacagctggatatgtcagggaaaaaaatcaagttttaacttttattagatctctcctgtttagttcacaccaactatatgtgtctgtcatgatgagagtgctttatacagggtgtgagtgagtagttacctttcttcctgctggaacattggagaggaccggggcccagtggctgagagctaaggtcagagttaggcagagctaggtctgaaggccacttcttccacttagccccaagcctcagtttcccctctgtgaaacaaggataataatactatatacgtcacactcacgggactataagaggccacctatggagaataattagctgggtgcttgatgcaaaacaagcatcaaccaacaatagccacaatgatatagttaccatgtttttcagtttgagttcccaggtggataccactgatattagataacactgatattacacaccactggtatctgtagataccactgtggttagctaacagtgaatgtagacacgacagtgcttcatcaggtagacatcagacttggaacatgcctccatctttctccaaccagaacccctgcgagggggaaacagagcaagttaaaatactgcaaagctttgcatttagaaaccggaaaacagatgcacagagcagtctgcctctgtgtaaatgcacattgtaatcagttttctaacgctgcctttacaaggatgagttaagtggttcgttgacatatcattatcacattctgaagataaacagccacaggatctatgaactctcatcaggcagttaattattcttgaatttttctgcactcttgaaacatattctatttatttaaccgtcccctgggagccctggtcgcctttgtccctgccacacggccagtggtgtaaaacctctgcatctgtcagatttctccatgtggagcgtaattgcctgatttccatttgaaagtacagccctgacattaaaatgacatagacccaccaatgataacaatggcttcctgacacctaccagaggagagggggcgagggggcataatgcaggaataaataagtgcatgaatgaacgctcgccttcacggggccaggtctgaatttacagctgcagatgaagtgttccttgggagcaaacaaaaagaaagaatgaaagaataaaagaaaaagaaaccaatagattagcatccgcgtgagtctgttggagccagatggctctctgtggagagcgagctggcctgctttctcccagtaaccctgaccagcagacagcaagcccgctacacggggagagaaatgatctcattcctcagccgggcacgtgagccgccttctttctctcacacacaactcgagctgaaggggagttggaaaagagagaaagggtgaaaaagaaagggcgggggagaacgggtgattgtaaagaacaagcaggtcctcgtagcccagaggaagagtgagactccaggccttggccagccctgagcgtccaagaactgtctccagatgtccacgaaggagaagacagggagacagaggggacacccgacacattgttgtctcctccacacacatccgtgaacttcacctccacgatccaatgttgcctggaaggcttgatgtggagaggctgagaggaggggcgcaggctgctgtagaggccatgggattaagttctgtgccccactggaaaggggcagtgaacaatgttttcaattcttcctaatgacaatgtctgcctgtctctgtgggccacaggcgaatgagtctgtcagtcctcagcctgcaggaccagccatctgctgggatcctggtctgccatgctcctgaacaggtgcctgagatggaggcagctggagtaagggggcagtcaaatgaaactgacaggttgtaggtgtgggagggctcctatccttgaagattctgaggctgagaggggcttggtctggggtcattctgcctgctctgctgagcaaagcattcactgcttgtaaacaagtctgttgtctggagtgacagccacacgtgggggttggtggacatcagacagaccaccagatgctggtgttagagcctagcacttgcagatgtgtgcagaggtgcaggcctccttcaagtgaatctgccctcttagtgagtgttcacacacccagcttggtaccagggctcctgaggcctccaacccagagaagcagactaagagagaatgaaggtgcccgtgcgagtgagtgctgggggctcacagagcacttcatcagcctggctaggttgcttgggcacctgaagcttgtctccagcagtgtttactcaaaagaataaatagtttccagggtgacaccaaatgcggggagatgtagtcattcctttaaagctggaaactattattttactcctaataaatattgagcaaaattctcttcattttcagcccaggatgagagcacctgcttcacaattcctggcagttgtcggtacaaatgaacattaagctggcatattctatcagggccaaggaagcaaagcaagctgccagctgggggctaaaaccacaggctctggcttttcttctttctaaaaatgaaacagaaagccaccaccccaccaactgttttgctctttatctcccaggcaatgctaccacataacagggttcctcgttctgtatgggattctcactcacagcagagctaaggatttcaaaggaaaccgtatcactaaagtaacaagagcgtgagctccaacatcgttccttgcctccacttaagcagggagatcagtcactcaataggagcatttaagaaaattttaaaatgctagcatttaaggagcacttaccaaagtgtcggccctgcctctaagcgttttgtggacatctcaggtaatcttcatgacaaccctatgcagcaggttctctgattacccttattttacaaataggatgccaagtcccagagatgttaagcaactttgccaaagttgcacagctagtcccgggtccataccaccaggctttcccacctcttttgatggtgtaataactgagctttaggctccctattttggctgctcaccagtggtgccatcttgggctactaagtctccctgagttcccatttccttgtctgtcaagtaaggactggaatagtggtcttatagggttgctgtcaggagcagaagtaatgtgtaacatacatgcatgcagggccagtgcccggcacatgtttgaggctccataaatgttagtacagatggtcccctgatggtttgatttaacagtttttcaactctacagtgggtttgttgggaagtaatcctgtcgtgtgtcaaggagcatctgagttaagctagtttgatttacagtttcaactttaccatgggtttatcaggatataaacattttatcaggatataaacctgatgcatttttgtattttcagcttacaatgggtttatctggacagaaccctcatcgtaagtggaggagcatctgtggttattactactgtaagcattgtcattatctttgtgctcttagatttcactgaattctcacacgcacacatgcacacataaaactatgaggtaggtggggcagctgtcactaaccccattttatagctggtgtatcaggtggtaaagcttgggcaagaacccccatctcttgactctgcactttgtctaatctgagcttgctgtttcccgctggactgcaggtcacacctgtccatttctagacaccaaacacagttgctgtctagaaagattgcagcaaggaattcaacccttgtcactttccctttgtctccaggccctgggattggctgaagacagagccaggtcctgcctgtgccctcctgggaattgctgagacagttaatgcctcttgggacaagtaaggtactagcttaaatggatcacaagctcctgtgtgcccttaagattttcgttaatgtctaggtcaaaaaaaatacttattttcttatcatcacgaaatgcagatgcatagccccatctcatgcctcgcttctcctagttgggatagcctctgagaacatttccaacactcttctttgcagaaggtattctgcacctacagctggaagcaggagacgaaccggccaaaggtgtcttggctgtgctctgccttctttccttagctttcctaactctgcctttccggtgattttcatgttttccctttcattttacattcagaaaatctctggggaatgcagcttttgttctgttgcttcacgtaattcccagggcagggaatgaaaattatttgctttcacaacttctggctgagtgcctttcacagcctggctgtgttctggggtgatttataaactgcagagcctgggtctctttcctcctccttttcctcctcctcctcccccccctccccctccccctccgccttcccctcctcctccctttctccttcccaccaccctttaaaacaaggtgagcctccagagtcagggtgtcagccactggggctcttgttcaggcaaaggttcagtggaaccatagtgatgagagcttgaagccattcattcctgttagaagaagacagaaataggcctcaaggccgaacttacgtctctgagaacaaatttgacccaaaatctcaaagtttagggttggctttgaactaagaatataaaagcacattttccaaacttgtcaggattgtgtttcatttctagacttttattctcaaagggatgatgaggaagagacacggcttaagaagttttgagctgagaaatgaaaagaagtcacttttctttgctgccacagaactaagtagggggaaaattaagcccaggggttcatttaacctgttacaacaaaacacagaaaccagacggcaaagtgtcatttgcaaggtgatgtgtctttgtcggagctgaaggctgtcgccggtcggctgtctccatggagtccccatctggccctgcactccccacagggatgatttcatcaggagctgaaagaacacagaggggtgagcaagtgatcgagcctcagactgtctgtctgggccagaccctggggaacacgtgtggacactacgggcctccttttctactcagtgtgatcctggacaggaagaattcttcacagccaaggccaaacagcccggacagaccactgccttgtggctatatgagttctttgaactgccctgtgccatctttttggtcatacccacatctttgcttctgcataactcacacaatagcaccaagtctccttgtcttctggcctgtggctgtctgtgacttctgagcagcagacacggaggctgaaggtcagagccagcattgccactacttgacctgtaaccctggatgagttactgaagctctctgggcctcagttttcctcatatgaaaaatggagaaataacacctgccttccagggttgttatgatcattaaactagatgatttataccaagtgagtcacgcaatgccccatagagcacaaactcaaagatgccaattagtatttctaagcatgggagggagccctgggagaaggccctggagaaaaaccgcctccgggactgtgagccaaggcaagagagagagtgggatcagagaaggaatgggatagaggccgggtggaggacactgaatctatctcctcccgcgttccctgcagtttcatttggaagggcagcgtctgagattttaaagtcatatatcattgccatttccttttttaaaaatataaatcattgtcccagagatattcaagttcagaaaggcgcatgtattaggtctgaggctcacgtacatctagtattatagaaagcgggaaatcaagaggggctcctgtcttcggccttctcttcccaaaataatggatgacttttttttttcactattagaggctgttagcactcagacttcatcctgaacctggattagtgatcggttttgttttaagatcctaagagcacaaacaatgagacagaaacaggctccattcgctaatgcactgctcattgaggaatgtcagtgatgacatacatgtggaaaatttggggctaccagacctctccccagtctcatctcagtctcaggcccagaatgaggtgaaaattggagagagggccctggagcagagaaagggggattcctgggacatgtagggccatgtcactgaggcaacttccagcaatgatttacaggaagcgtttagctcatgcatatattggggccaatctgaaaaggaatcaaggttcatgaaactctcaactgtgacattttatagggtatggcgcaaccagagttagctaagtacagatatcattagctatatgttcatttgattgctattacatattctctctctctgacacacacatacacacacacacacacacgcacacacacacgactgaattatattcagcagtattttatgctctttggaaactgttacttattcagatacaggatgttttgtttttgctttttgctgattctctactaattttattattcccaatactctctttcattttgaattatggagtttattgcagtattgtattttttgagatgtaaaaactattataattagaactaaatttttcaaaaatggaaacatgcaggttaaatgataaaaatagtgtatttgtgaaatttgggttccgttttgttttgtcatcatagcaaatagagaaaaaatgagttgattacagatggaagtgtaatttttttctgttgagaagacctggtcatctgcctccacatccatcaccacccaacagcactacaaagagcagctgaactctcccccaatactcctctgtgccccagtttctccagatgtaaaacaacaccacacaacacatctgtctccccctcaactcaaagaaatgttataagaatctttgagagaaaaaaatatccacaaaagtgttgtgatcccagaacttatttgttttgtatgtttgtaattgtatgaaaagtggaggtcactctagtgaaaatgaaaactgagctggaaagggctggaattgctaaaatgagcagaaatacggtaaaggaaaccattccctgtacccagcagctgtcaggctgtgttcatgatctgctcttgcttcctgagagcaccatgatttctttgtaaccaaaaggaataatctattttctggcctaacctctcataaggtattttggagtaagctcaacactaggaaacaatattttacagatatcttcgtctcctctttattcaacactctaattttttccccttgcaatttctcttctcagaaatgtagcttttcagcgttgattcatctctcctgcctcatagcacatttttctctcttctagcctgaccatttttcatttctctcacttgtatcttaactggatcttccatctcctccacttctactcctatttcctttaaattcattttcttctttcccttttctctccctaaagagtgaacagagaacagacagaaaggacaatcagctaggactgtgctgagaaaatgaactgaaacagcacagtgaaagttggacaagccaaacctgactccatcaatttgggttgatgcctctgacaattcaaacaagacttggtcagcgcagaactgcaaggctgtcttggaattttcacacatatatgtttgacattctactccaattcagttccacaatccagatgctggaagaattttgtttacttgagatggattctcgtccatcatctttcgctcccacaaaaccattgttcacaacccccaaggactgcctatgagtaccatcattttgttacagttaatgctcattgttgtgcacagttgggaaatgtagccttctggttaattacattttccaattaatagaaattacaaggtacatcttccatgtgttgctgacatctagacacctgggatactctaagcaccaaagctaacttgaacaagtttagtctttcttggaaaatttagaggaaacttcaggactcatggaacatcaagggtaccaaagtgtgttgtagatgtgggtagtataagataattgggattttcatttggtacaatgtaaaagtggtttgggggtatgtaatagcacaagtcacatgggaaataagggtaccatgtgaagcacattatatctttttaaaattatcctcctcagtattattaagtgtttaaatgttcaaaggaaagaaattcatgccctgccagattacaaaacagtatatacatgacaattccatttttgtaagaaaaagcatgtctgtatacacatatacacagcctcccatataaaagtcagggaagatatgacccatattttaatagtagtctctctgaatgatgtaattataggtgctttggttttcttcttttggtttatccatacttattaaaaattaaatatttcttctataatacaaataaacaaatagtctttaattggaaaaatcacatagctcagtattaaaatcagcacagaaatctatctcaatgtagatcaagaacagattaaatgaaaagaatggttgcagaagaaatcttcccatttggaaaacacctatcatgtgagattgtcaaacacaaacttggaggctggggagttgggggtggtagtggctgcagcgatagcagcatggaatgtgaggaaatgctgttgccttggggaatagaggtgggatgtggatcatcacctgttatcacaggcaggctctatgaatcatacacgatatgatatggggttacaagaaggattcttacaattgccattaagataatcacttcatagcatttctgcatctgtttctaaccttctaaacagaataagatatggaagaccacatcttggtttcaacactgattctccacgactggggtggagggtttggcctgagcctgaaatcaggcactcagtcttctccagggccctgcaccaccacggcttcaccccattcaccgcttcaccccattcaccgcttcaccccatcctggtccttgacagcacagggcttgtgccaccgtcccacctctctccccaccctggactggcctttgctctgtgtggtctccacttgtgcagagccctgtaccgctcccacttgcttccatctcagttttcccagcgttcaccctcatcctagaggaagagcaggggatgtgtgaacagacaaaagagacacaaattccaaaaatgaaattttaggggaaattctaccagtgagtgtatacttctaccctagcgatacaaagagtgcagtggcatttccaggatgagggaaggggtggctgttctaggatcacactgcctggttgcctctttccatccatgaacaaaagaggccatgccgtgcaggaaataaattcccagcttccagaagtccccacattttccagagaccagagcagatccttgcctattcttgtttctgctgttgcatgcaccttgtctaagaggttttccaaatcccagtgtgtgtttcagcatcacttgtgcacactgtcatgctggagcgccctgcacaaggctgggagcctgacttcccatgtggattcctctgtcccatttgtctgaagctcttcgcacacaacagatcgtatttaaaaaaaaaaaaacaaacctctgcagtacctcttacagttttgtgttaagacccatatatttgttaagcgaatgaatgcccaagtgactcagcagtccgcacacctgacactctgctgttttcaggtgctacatactatctcatctatttctcaaagcaaccctgtgaagaaggcccgccattacccctgccttcaggatgagaaaaatgtcttgaagaggacttgcccgaagtaacacacaggtcgctgactgccaggacctggaattctgatttcagtctattgccctttccatcacgatggtgatccccaagccagttggctcatcagaatcccctataaagttggttaacgaaccagtcacagccctactgcagacttgccaaatccctctcaggtgaggctcagccgtctatactatgaacaggttgttccacagatggtctggctgccctcccacccatgccgcctgtgctgaccagctctgatttgacatctggtcgatgctatcaagggtgtcaacacaaaacttcaaggctagccctgacactgaaaatcctatgttcctccattagtcacctccttgtgtgtgaagagttcatttatacctcccaggatcctccttctgtaggagctaggttaacggctcaacttctagaaaacccaaggttaaaaatagctgtgacactcattagccccaagggggaaaggtcagcaaagtttgacagccacacttaggaaggactgagagaggctgcagaaagggctcggagctgagaacagggacccagccttccttagaagcctggctccaaaccagctgggccccccctaattggccacgtctgggaaaggtgctcgtatagtcacgactctgtaaagcaaggggcaagggccctggtaattaagtgaccacaaacccatccaataattactcatcagggagactgcaaatggtggaaaagttcttcctgtttggaagagtgagtgaaatttggagggaatcagcaacccaacccctccagcagcagaccgctaaagtctaacctcatcaggagagagaccctcaccactcaagttctccagaggaacaattaggagttgcttgagaagtcccccaagctgacttaacctgccatgaacccagcaagcagacgccctctgactgtgatttataaggaaggggtcgcctccagagaggggcctgggctgcttgcctaagtgctgtgtgcaggtcagcctggaaaccattattgtcatcaacaggaggatcagttaggagacaagttgaagcaagttgaaatttgaaaaacacattaacagcggcctgacgagatgccagaagagtctgccagcagggacagctggaaggccaatttctgagtcaatactgaaaggtggttgcttaaatatctgagtcaacacacactgatttctctccggctcaatactcccgtttaattgcactagggagtctctccactgacaaatctaacaccaagatatatagttaagtgaaagaaaagcatgttattgaagtgcaaatgaggtcctccatgcagcctgcaggcctgggtcccgctgagcgctccctactgccctggcagaaggtggttgggccttgcagggactccctgtggccccctttttaaagagggtcgagatacgcgtgagccccaggcctcagctggccagcagagagaagtctaggtgcgctgcagctgcacaggctaccaagactctgagatactttgtcaggatccacggtcctctccggggagagggggccaggagtgcccgtttcccacccaagagggccaagtcagatggaatggtgtgccactgaagagccatcatgtttggcagccaggtgaccacctggtgagattggtggcagagatgatgaacgaagcaagtcttgaacgtccacccagctgcctggagcctgagaagcaggttggtctctgaggagtcctgacaggtcatggctactgatgcagacacttccccatcgcgatgcccacataggggccgggcaggatggcccaggggtagtgacgaggctgggggctcccacagtgaccctctggcagccttcactgacttcagagctaagcatgatataggagacctagctagacctgaaaacccatgagaaccgggacccgaaccacagtgaagaggcagctcccatgagcaggtggcatgagtcctccactgctaaattctatgtctgctgccaactgtcaaagatgaggaagaagcccatgtcagtggtaaacccaaactcaaattactggggcacattgtgaaagggcagtttctggttcagtacgtctcggtgtgggtagctttgggtccagtggcactcctggtgcacaccagtctgtcatgaacccacagtgtgggagtgcttcctcattaatacacctgctaatcacaccgaacaatcagagatctgttcagatggggcccagaggatctgagagacaaatggctgggccattgtcaacccaagcagttcaagtgcagtggccaccacttagggaaactatggaattgtcttggtctgatgctcaaaatgaactcacacggacgtgatctgccctagacaaacaagtctgaaatgaagatcaaatgctatttcttccacttactagttgtgggaccttatataactgttgtgtaaataagataatgtgggtaaaatgcctggcacaaagtagttgccaaaaaaatgccagttcaccgctcgagtttccccccaaaactgaggtggcctcaatttttccttctctagttcagtgttgctttttgtccaggaaagccacagttagaagaggtgctgtgaaatttctatctctcacctctaagcaagacatccagccctgctggtccctgtggcaggacctccccatctcccacgcagcagaagtttgaaaaattaatttactcatcttcctggagcataaagagttttttagaccttcccttctgaactgtttatggaaccgccatttaggaattcaaatggcagagccgttctccctctgaaggtctccgggagccccagcgcctcctcacctaccccttatttcatgctcatgcttttttgcacgttgataagcagtctcaaggccaagactgtcccaggccccgacacacctgtctgatttcatccctatgtctcccttcctcttgcagccctttccaggcacactggtcttcttgtctcctgtgaacttgccaaggctgtttctgccttgggcacagcgctgcctggaagcccctacccaggtagccacatggggtttcttccttcatccaagtctcagctgaaatgctgctccctctcagaagacttcactggccctctactgagttttatttttttcttaacattcatcactaccccaatgatcttatttgtttagttacatgttaattgtctgtttccctctactaaaccacaagctgcccaaaggcaggaatctcatgtgtttagttcagtgagcattgcagatcccaggacagtgactagatgctttgtccattcctgcagcagcaacagttttccaaggaacactatcaaatggacctatgagtgttataattctatcctgtaatacgttggacaactattcagggttttgggcactgccagaaacatgcaactccaggaaggagaggagtggggacgggagggaaatgcctccaggcaatggcaaaaactttgctttgagcttctcatgtcccagaatgcaaatgtccatctgaccccaggatcagagtgagagaagttttgctctgtctcctctcacctgaaatgaacaggaggctgctattcattccctcaacctcaggttctaggatcaagctagagggaagcctttgggcatcagggcagtgccaatgccaagggctcaagcaacactcaactttagagatattgtctaataaagataacgagagctagactttttatatggattattaagctgttctaactcatcacatggatcatttcatttgtcttaagaaattgtctcagtgaccagagatggtttttagaaaatgcatgagatgtgatcccctctatactgtggccgtgccgcttttaactccacacggatcacctagcatgagggttctagaaaaagatgggggagctgctgctacaggggttcatgttgtccacccatccctggttcttcattattcctttgtgactccatactcaaaaaccaagccttgtcagtcctgagaatggctctggctctgagggagctgaatgactgccaaggccgtccagaataagcatgaattaagcaaaccctcctgtccctacgaccctcaggacaaagtggagaagagagtaactgggctactctgcggaagtgtcaatgccctgaggtctctgtaaagcaccagatagtgcaggaagaggaagtctcagctctccttagcaagacaaggcaagctactgagggccacgctgtccagagaaactttgttttgtggatgcacagaaagtaatacgtttttctggtattagagattcttttggaagcgagtatagatggccctgccggaatgagagcccttgggacacctgggataggggtgctcaaaacaacagtttattcaaaatacagcaagcaagtcagtagcgtcctgccccgggacaccaaactccacctgtgctatcccttcccggctctttctcactgcctatgaagtgacctctgaagtgtccgattgtctttatgagcaatgcaaggctggaagtattttagaccaggcctgctgcactcaccgtctgcatctgctgcgtttctgtcggggatcagctgctgactgtcggcatagctcatgacggcagcagttctcctgtcttcatttccctgagcacttgcttctgcaaaaaaccgtgagaggaaggaaaagtgaggacggttgcatgagtgggcttcatggctgccgaagtgggagactttttttggatgcctctgaacatcggctgcccctggcaggtttcccacaggtgcccatcatgtgaaggactggatggaagttccagctgttggatgtcgtggtagggaggctgaaggacatttaacgtgtttcatgtactcattacctagaacgaggaaatgcactgtcttgagaacgaagtggaggagaggaggctcatttgaggaagagctctcctggacactatcctttcttgtttctgtcaccttctgggtctttttgtgctagggtggagtggggcacaagaaagaccctgcagggccctttcttctgcattgctttggtcttagacatagttcttaatgctgactgcacactagaatcactgaagtgccctcgctgctgctcctccctaagtaacccccccaaaaaagtcgtgtgtgtcccatgggagataatctgagggaatagacccatgtgaaaagagtatcagtgaacataacagtgtttccatgcccctcccccatcactgtctttgagaggctctatcttgcctcatggagatgtcagtggtcactgggagaaaacaccctggaccccggaagttaatggggttccttaggaagcagtatctgcatgaggtctcccctgagagttcctggccttcctgctagagcccccatgctgcagatgaaggcaggcagggagagacagactcaccctcccccagagcctggtggctgaggctcacagcaggaaatccaaggctgctggggaaagggagaggggactgggaaatgcacagaagcatgaaaagggttgggatccttccttcctgggaccacatatatgtttgtgcagttttctctacatggaggcacctggccaaggggttcagggtgaggactgacctcagtccacacagaggttgccattttcctctatgataagccatgtctgggggctgtcgaccccatagcccacaaaggggtccttgttcttaatttgcacagagacactgactggggcctcgggggatgggggctgctatcccctgccctcctttcacacctaccctccctcctctttctcaggctccattctgagggctcccagttgaggcacccttcctcactttctactcagggttgcttttccctagctcagaactgaaagtgggtttgattctactgactcagaccttgctccggaatactgtttctctaagaagtgtgggaaccctcagtgaacgagtgggagagagcagtgtggggttacagccaggcacagctgagacccatctgccctgtcctgtgccaaagcctccagccctgccttcccctctccaatgatcacgtgatatgatgccccctccccactttactttgttcatttcttgacaacgaagaagagaaaagggggggatgtttgtttgccttctctctagaaaccctctgtactgtggggctggcatgatggtgggtgggagggagtgggagatagcagtggatgaggtgcccagagcctggaaattctggggctaaaacctctaatgaggactgctcctcgtccttattaccaaagttatttcttgttttttatttagatatttgtatctcagtgtctacaacagtaaaatgtggcctaaaccaactatagctcacagggatactacagtgagctgatattagaatgaaagcattatgacaacaattttaaaaattcttcaaataatccatcttttctttgggatagccccacttttaaaaatagtcatcataatccacatgtcccaaagagacatactgcgtgtaatagctgtgtaaataaggaacctctggactttgagattccccttgtgggcctctggagtggctaaagattagctcctgtcagaaggaattcattcccttcttggaggttcagaaaggcttgcctcctattaccaggtttccccttcaggtcagcacttctgtcttagccaggctgtggctaagggaccctgagtgtgtgggactgatcagccttgcagctgatggagagctcgccattggattccagcttctttttgggggtaccatgagccaaacagtaatccctggtccagcttagtactgggtttttttaccctaaactcccaccctcttgtcattcctggagctgggtgagtcacaaattttgtccctcatcccagttttggaagctagaacaaaatgtgaaaaaggttccagcacgcgagggaagcctgtgctggagcctctgaggctgtggagcagaggaagcactcacaaatcattccccagctaccagagagctgcatgggaaacgcccagagaagaaccttgaagactaatgtatgtagaactcttcagctggatctatcggcccagctcaaagaacgtcataataaccaggatgcaagagaagagtgttcagggcaagatggttgaactgagccctggagcttggtggtgggcaaggatgctttctgtgttgaccctgcaaataataaacatatctgaagtggttagtggaaaaactactcaacactaatgacaaagcttctcttttttgcttacccttgtgatcaactggggttttagatctccccatgatctcatcctctgtggcattcaagttctggatcaaaaagtatgtggtcattctccctttacctttcacttcaatttcacccctctcaatgattttaaacccttgatttttcaaggctctgcacagagaaaaaaagtgcatcagatatcaaagattgtgggtctgtaactcaagagttggctacaatgcaaagggctactcaagaggaaaagtccaggacacaggacacacaacagcaggggagggaagatcccagacatctgcctgctgaagcaggacagaggccgtggggaaagtgaggatgagatattctgaacaggatgccaaaggccaaaagagaacacagggacccatcaaaaccctcccaaccctgccaccaattttcctccctccagctcaaccctcatatgggcatctctcacgtttctacacaccatgctgtcagtgcccatgtggacaccacctttcatgtttctgccacgtaagactcttgggtatcaacactcttctttccatcttccccaagtgcaccatataccccatgcttgctactatgctcatcctaactacccaagctttctccaccacaatttctgtctgccaaggaactgaagaggaggactatagggaagggaccatgaaaagagacagagctatggggtaattacaaaacgtttccctgtttatttatttactagccaccaagtgatgttagagaaaagccaaagaaccactcagaccaatgaggattcaaattcatgaccacctgcctcggcactccatcgagccttcccttgcccttggccaggttggtagagagttcagaccttcaccacagtcctcatgggcctccatttggcatctgctcccctcactcatacgctggtggctgtgcctcctactttatgccctgattcatctacaaaattacattgattacaggtgagagcctgtgacttctcaccccatgaccacaccatcctgtcccccaatctccgaggatgaggtatatttcttgtccagggtctcctcaccctcacccccttcccaccacctctgggccttgctccattggccaccccacgcttatcttcatctcccattccatttgcctttctccttctgcttttcagtgtgcttatgtctcttccatcctaaacagaaacaaacaaaacagcctctcacctgctttaatctcatgcaaactttctcctctttttattcttcagcccaacgtctatcccaccattctactacaaccacttttgagaatgtccccaaaacctctagtgagtatttttcagtccttattactacatttgacatttttgttcaattcttccttcctaaagtcatccacaagagtgcttctcaccctcaactctcctggtcctttctgagtatttcttctcctgtctcttccctgggctcctcttccttctgtgccacttaaatattggttctgcacaggattccattcttttcccactgttctttgcacactgcatccttccctgggttgatctcatcaactctcatgactgttattaccacctatatgttgcttactccaagtctggatcttcaataactcaactccatccattttatggcacctctagctgaatgttccacagttcctttgaacccagcgtgtccaacctaaactcattgtctgcccctatgatctgggatacttctcatttgtcccattgcagatggccaggccaccattcaagccctagtcacccagaatggagacccgggctccccccttcttctcatcccccatttctaactactttagctggttttattttcccccatattcccaccactaatgttctgattcagaccaaactcctaacaggtctcatctgtctcattttctggttctcaaatatgccctttcagggtctctagagtggtcagtgtcaaataggaccctgaccctgtcactgtcttcaacctcacattcgttgggggcttttcctcacctacggcatagggctcttgcccttcagtaaggcatgtgcagctctcactgctcctgcctcatattttccaatacagaaaacctcgggtgtttatagttctctgcacctattctacatgtgagcctctacccactttttactcccaataccccaattttggctaaattttactctggaactccttgctcaagattcagctcaggaatctcctccatgaagcccttttttactgggtcaagcacccttgccctgggctctcatgacacccccggtgactaccttgaggataagagtgcagcagttaaaggggggacactgaactctgactccgtgggctgcatctgggctattctccttcctagcctacctggtcctgaggcaaatgattaacctttttgtgccttttctttcatgtaaataataataataatgtatcttcacagagctgttgcaactgtaaatgaattaacatataaaagaatttagaatagaatgtggcctattttaagtgctcaagaaactataagtattgttttatgcacatatttgtcattgtacttatctcactttaaaaataatcaactacaacttttcttttttcttctgctagaccaaaggtcagcacgctttttatataaataaagaccagatagtaaatattttagactttgtgtatcatatggtctttgttgcagtgattcaactctgcctttgtagcatgacatcagccatagactatatgtaaatgaaagtgcatggctgtgttccaataaaactttatttacaaaaatgagcagcagactagatttggtctgtggggttatactttgctgttccctgaactaaactatatgctccttgacagtaaaaactatgctacagttagaagctcaactaaatttattatctgccacaatatcttctgtaagccattgagacatggaaggaaaaacatgagtttcctgcactaccccaacccatggctgctaggcactctgtaagttctagaaagaggaagggacaaaggaaggcatgaataaatggaaggctacctgtaggctgtgggactgaggtgcactttgttgggaagcccatgactttccatcctagaagctgtgttcacagtgtcaccaaacaagcagtaccgtggcatcttgtctcctacaacatctgctaagactggtccagtatggatccccactctgagctgtacagagacagcatcactgaaaagagaccatctaatactcttgattttatttgtaagttgagatataatttacataaaataaaaaaagatattaaagtgtttggctccatgagttttgacaagtgcttatatccctgtaaccaccacccaaaataaaatgtaaactagttccattaccttgcaaaattatcttgtgccccttctagttaagctctctccccatcttcttcagcagagataactacattctcatttcttctttttttttttttttttttttttgagatggagtttcactcttgttgcccaggctggagtgcagtgtgatctcagctcactgcaacctccgcctcctgggttcaagcgattctcctgcctcagcctccagagtagctgagattacaggtgcccccccgccaccacacccgactaatttttgtatttttattagagacagggtttcaccatgttggccagctggccaagctggtctcgaactccggaactcaggcgatccacctgcctcagcctcccaaagtgctgggataataggcatgagccactgcgcctggccttttttatttcttttaccaaagaatgatttgcctgttccagaacatcacatatgtacaatcttatagtatatactgttttatatctggtttcatttactcaacataatgtttttgagattcatctatattgtcttacatatcagtagttatttttatcactgaatagcattctattgttagaatacaccacattcattatccagtctccttttcatgaacatttagattatttttcagtttgaatctattaaaattaaggctgctataaacattcctgtacagatatttttgtagacatgttttcctttctcttaagtaaatacctagaagtggaatttctgagtcccaaggtagatacagatttaattttattttttaacaaaacaagccaaaaaactacccagcaattctccaaagttgttttactgttttacatttctatcagcgacgtgacactttcagttgttcccattttcaccatcatttggtcttctcgtgggtgtgaaatgatatctcactgtggttttaatttgcgttaaattggtgactaatgatgttaggcacactgtcacacacacattggccattcatatattttcttttgtaaaaaagtctgttcaattttttgcctgttttaaaaattgagctgtttgtcttttattgttaatgtgtatgaattgtacacatatttggatatgtaatatgtatgtattacaaatatttttatcagtctgtgggtttgtgtatttattttctttaataagcagaatgttttaattttgatgaatgtattcatctgcttaggctgccatagcaaaataccacaggctgtgtagcttaaacaatggaaattatttctcacaattctggagcctggaaggccaagatcaagctgtgggcagggttggtttctcctgaggcctctctgcttggcttgtagatgtccacctttttgctgtgtcctcacgtggtccttcctctgtgcacatgcattcttagtgtctctttacgtccaaatttcatatttttataaggacatcaggcacgttggatgagggcttactcttaaggtttcattttactcagtaaagcctctagctccaaagacagtcatgttctgaggtagtgagtactagagtttcaaaataagaattttgggcaagacacaattcagcctgtaacaatgaagtttatcatttttttcccttcatggtcagtgttttttgtgtcctatctaaaaaaaaaaaaatcattgttttccccaaagtcatgatgctattctttatttccatcaagaagctttgtgattctagattttatgtttcgatttgtgatatatatcaaatgattttttttgtatatggggtaaggtagaactgaggtacattttttctttccacatgatattcaatggtaacagaatcattttttaaaaagaggttgccttccccactcaattatttggtgccttggtcaaaaatcaatggactaaacatggagtctatgtctggacactctgtgctgctccagtggtctctttgtctattcttctcccaatctcactctgttttttttttactgttgctttagaataagtcttaaaattagttgtgtacatcctccaattttgttattttctaagagtgttcgggttagtctagattctttacatttccatataaattttaaaatcagcttgtgaatattttctaagaagcttgcagggattttgattggtattctacggaatctatacatcaatttggggaaaatggacagcttaaatatattgagttttccaaagaatacggtatatctctctatttaattaggtcctctttaatttccctaagcaataccttatagttttaagcatagaggtcatatgtatcttttgttagatttactcctagaaatttaattaagtttattttctttttatttcattttcaattttttgtccttaacatataaaaatttaattaattttcctgtatttatgctatgaccttgctaaactcatttattagatcttgtagtttcctgtagtttgtataagagtttctaggtgcaccattatttgttctgtgaataatgataattttatttcttcattcatttccaaacttaatgtcttatatttcttcttcttgccttagttcactgggtagagtttttggtatgctttaactagaagtggttgtctttgtatttattctgcttgggtttgctgagctctggatgtgtgcattgatatccttcatgttgaaaaattctcaactattatctcttcaaatatttcttcttacccattctcactctgttctcattctagcatttcagttacatatatgggagtccatttgatattgtcctacagatatagagtgtcttgttcccctttttaaccctgttttcttctttgcatttcagtttgggtgatttctatttctctgtcttcaaattccctgatttttttctctattgtgtctagtcttcgttgagcccataaaattaattctttatttctgatttctgatatcatagttttctgttagatatagatatagatgtaaatatagacagtatgtacgtatttcccatatcttcacacttgttttgccccttttcttatagaccctttaaaatatttatcacactaattttaaagatccaacatctaggctatttctggacctgcttctattgactattttctctattggctatccactatattactattttcttgttgcttcttgcatctcatatttttcattatctaattgaatgacccatattgtgtgtgaaaatacagtagagactgaagtagataatatttatccaccagaaaatgttacatccctacagaattaggctgctggaatgggcagtaagtaaatctaatccatatttgagttgggtcagggcttttccagaaatattggtagattccatgcaccactggtttcaaatattatgaaggctgaatcagaactttcagtacagcagagcttagaatctgagcaccagcaagactctgaggaccttgaatgctgtacagccaatccacagcttttggagttgtaggagatctcctcctgcattacagcccaacagtgagattttcagaagtctctttgctcttcagtcccaccctggctctctgcaccttgggaaaattttctctgccattcctccttgccctcatacttcaaaaggtcatcgtagtgtacttggtgaagacgaagagtacttcagttggatttctctcagttctcttactctaacattagcctttaatgggccactgctttgcatttgggaaaggccccaaacacctcagggactcgggagttctctcagctctcctctcctgtcctagtttttggctgactaatcccctgcacttggcctatgaggaagagttggtagatgggtacagactctgtggctgggactctttggcattctaacctgttgtttcagccctgtgaccattaaaagtccactaaaatttagacgggattatccctaccctcacctctggtggattacttcttctgctgccctgccaggattgaatgcaattatgggtgtcttctctttgaaaggtttgtcacttcctggaatttagtttattttgattcctttgctttctggtgggggaaaaaaaactgctagcatgggaacaacagtctcttacagctttctacatcctaatcagattgcttgttgtttttacttgctagattttcttctgcttgaaataaaattataatttctctaggaaaacaggattctctgaacccttcaaagcacctagtaatactgtctcatacatggatggatctcagtaaatgtatattaaagctatatgaataaaataatagaatatctcagtgcaaaataattgcacaattctgttaagagagaaagtgtttccagttctctcccctacatccttgaataaacccatatgatatgctgtttctggtggatatttaatgatgctcctaattatgtccatagtcttaccttggaattgctaacatcctttcctatttttttcttggtaaatccaccttgagagtttccaacaattcattgtctaatttcattcttattggtgtagcattattttcatctctggcgctatgcccctttcatacacacatgcacacacacacacacgcacacacacacacacgcacactatgctttccatttttatttttatttttcaccagtgacttacacaagcatcctttaactgaaacatttatctcttatctaaccttcttatatctcttccctcattgcctctcatcctgattttttatttattacattggatttttattccactgatgcacactgtgtttacaatgagtcattatggcagctatcttgttcttgtgactatctaaggccagcttttacttagaagactacagtggatgctgtagccatgatctgcactgtttctcagcttctaactcaccatggtcagagtgagtgcagcagattttcagaatctcctgtaaaaagttataatgtggaaaaatcatattccatcttataattggctttgtttattttgaattgactagtttattttaaatttctgactgatattagcagaggaaggacctagaaatcaaaggcagagagacgccactctcagccatcccaggagcattaggatctgctgagccagcggaggaggacattcatttttcacctccaaaactgttcaacttttagagtgtgaacaaacttccagacttggaagcgtacttttctgtgagaaaggcgagcagatgtctcgctagtggccacttggtggaaggaaagccattctgaatatcttacggcatcacggtgcctggcctgctgactgcaggcagcctcacacctcagcctgagttctgaacctgtcagatggcatgttggagacacaatttcctaagcaggaaaagttggctgctcattaaacctgaaccacttgttgaaatgcttgaacataaaagcaggaattataaatgagctggtgtttaagatggattgagccctgctaggtaaataggaagaactgctcagcactgtcctgaattaccaacaaaggaagcttgcagtcaatcgtaggaaaaccttgagcaccgcagcctcctctgaaatttgagaaaagttgagactataggagccttaggaatatctctattagggacatatgcaagagaagaaaagggctaggatacattacccattttaatgacagcaacttacccagtaatcacctaagcacataagcagaattctacttttgtgtgtgagatgtttggcattaagccaagtactcagttgctctctacctggatgggttctccagtaacaggattcgtcacttcctttgcagaaattctcatccccaaggcaaaattagccactctttgagcatggtttccaataggcactggtacacctcctaccaccatataagcatctcctattgtttctacctgtcagggaaaaaaaaataggtattcagagggattccttcatgcactaaacatgtcactacactttttttcattttccatatatagacaaagggactatactaaagctggtaattgattctttgctaagggtatgaggagcatgagggaggaggtgagaaagaaaaggactcaggaaacaaccatgagagagccaaaaggcctttctgcttttggtggaaacaaatcccagaaaagacgaagctcctggggtagtcatgtgatgctatatatgagataacacattgtttagattcgattttctgctgaatttaggagtaggagaactacactctatgaaaacacctgacatctaggtgcccctcaagggcaccagagtgccatcttagcactgagcattgtaaaaagaatttctaaaaactagaattcctaaaatacttccaattccctttcagcttttattctgaccccacactcatccacaccaaaccccagaccagtgcagacagaggcaaagggagacttagaatcaagcactcgccctgcgtgagcacaccgtgaaacaccccacactgcacagacacttactttatagactgcgtgcacactggttaatctgtcaaacttggagtacatggaattcagcacgttcactatttgtataggttcacaggcagtacagatgttagtaaatgtcactacatcgctgaaaagaatcgtgcagcttttaaattctcctacaacagaaaccaggtatcagtgagaaacaaggagatcgactaataagtccatgaattctggattaagaggccctgtgagaatcaaacctgccctgtgccttgtgggaaaagtagctggatgccattccccattcagcatcacccagcacacgtttactgagtgcccgctgcaagctagtcgtagtaggagaatcatatcacagggggcaagcagaccaggccctcgcccccaaggagcccccagtctaatgaaggagacataaaagtgaacaaatccttccagtaaaatgtgaccagtgctgtgggaggacagaaagggcccctagcaagtgggccaagcagagcctgagctacaggagacctggggacagggctgacagagactggtcactgtgaagtgatgggtccctgtctttgaatggcaggaaacctaccttgtcctgaacacttgctcctaaatcatgcccctgattccaccttggcccccattcatgctaacttccacatagcagccagatgccctgtttaagtcagatctcccattcttcaatctcaaatctttcatgacttccatcacacttagaatgcaacccaaagtcctgaccatggcttacagaggggaccccccacctctgtccctgccacctctctgaccccatgtccctccggctccctccactctggccacactggcctcatggggtttctccagcatgccaagtgcctcctgccttcaggcttctacacttaaaaaaagaggtgtttcctctgcctgacacttttctcaaatatctacagggcctgttactcacatttcaaatgtaaccaactcagtgagaactctcctgaccaccctgtataaaatagcccctagactggctatccttttagcttgattgccttccacccactccatacatttgacattatatgtatatacatatatatatatatatttttttttttttttttttttgagatagagtctcactctgtcacccaggctagagtgcagtggcatgatctcggctcactgcaacctccacctctttggttcaagcatttctcctgcctcagcctcccgagtagctgggactacaggcacacgccgccatgcctggctaattttttgtagttttagtagagacagggtttcaccgtgttgtccaggctggtctcgaactcctgagcagaggcaatctgcccacccagcctcccaaagtgctggtattacaggcgtaagccaccatgcccggcctgatattttgtatggaatggtttatttggttattgtctaccaccccattggaatacaaagctccatgagacgggagactgtcagtttagatctctgccatatcccaagcacctaaagcagggcctggcacatagtaaatgctcaataaatattgagtgagtgaatcaatgactccttgaatgcagccgggtgccttctttgttagttaagcctctgatggtaatttcccctttgtggaactttcccttctccttggcttctggcctatcatcctctcttcatattcctcctacctttctgatctccttgttttatatctttccttggcttctcaaccttcttaagcactagatgttccctaaagagtaatactccactctcttctcacttcctgtcctctaggtgatcttatccaccattcagagtctatgattaaccccgcccacattgcaataactcccagatgtatagctccatgccacaatgttcctatgagctctcactaagattcctaccactgatcatgctgtgtggagtatcccacagacatctccagctcaatggttctaaaatggaccttatcattctcccccaaccctgctcttctttctggccctgtcttaggataaagcatcccatttttccatgcgagaagcctcagacccatgcctgcctccgctgtcttaccttccccatctggtcagtgaggaaatcctgctgattcttcctcaggctgccctaattcaggcctctaccatcaatcagctgcgcccttatggtctttcagcaccccctcatgcattcattacactgcagccaaaatcggatttataaaactcatcctgtcacttccataataagagaagaaacttcaatgaattctcactgcctacaaaagacaatttccttttccctaatagtccaaattcatcactgcatcacctgaaccccaccctacccactcagcgtcaccagaccccacttttccacataccccacgctctgggaacatgccccatggtattcgtttgcacattgccttaactttgactcttactagcccattctccaaaaatgcctttttcctctttgcttgctgaaattcagcctcaaggcccaactcaagtgtcacacacttttgagaggtacctccacaactccaacccacccccctatctcttatctcctgacatctatttattattaatttccctgtccccatgttgccatagcaccttgtgtgatggaaagagtatggattttggagttagatggccttaacgcagttagtttccacctctttcatttatcagctgcgctgaatgtcaatttgctcagcaatatggtatggacaacacctccttcatagaaatgttgagaaaatttaatgaaactgcacatgtaaaatgtctaacatggatcctggcacaataattgctccttaatgcaaattagtttcttttcctttggtcatttccacccccattaatttattctgcatatatctatcaaactcatgaggctgtaaactcctctgtgtccccagatctggaacagcaccctggcacagagtaagttcaccaggcgtgtctggtgaatgaacacaatcccatgacaaacggaaagtgagttcagggtaaacacagcatccctgcctccataaatagtatactgtcccagaatggtcctcagaggaaccctatgatttaactagtgtgcgagtgtattatttctagttaaagttaagaaccctactcattgtcactgagtaatgaggccagtctcaggacatatccttaaattcttagagaatttaatgtgtgtgtagttgacaaccatttttatataattcatgtttcactcctgtattatttttattattattattattaatgtagagagaacaaagctgagaatatgcaggtggagtaattaccccaagatcatgccacttacaagtgacagagccagaattcaaaaccacttctgtctggcttcaaagcctgtggccctgaccactaagacataccacgctctgctcagaggacgctgtggaggagagggtgccttacctgcagccacctttttgccctccctcagctggttggccacgtgtttgggcagcatggcataaagtaaggtctctgttttcttcttttcaatggccaagtgcttggagaggacctgtagctcctccttcttcctttccagctggttggacagctctatctcagccagccgctgctggttcaggaggatgagatccctggtggtgtcgttgggggcgatgtcagaaagatgcatattgagttcttccagctcttgcaggctgcggagcttcggagagcacaggtacaccatgcaccacatggactccatccagatcatctggccttgccatcatggagagaaatgcaacagtagagtatgtcaccagtagggactgagacgagctcgctggacaaccaatcatctcccacactgtgtgcttctagttactgcacagtcacgctctttctcttttacccaaggtctgtgagaccttacttatctcccctctgtccctagcagctgtgtccattgcctacattgaagtggctcccatctatcaatggcctccatgctaccgatgccaacacaagttccttggccttttctttactcagcctttctgctgtttgatgatgttaaccagacccttcttcccgaaatctcacttcctaggacttctctgacactgctttctctctgagatgtcccctaattctttgaatttttacttacattattttaatctcattccttaaatgttagtgttcctgagggttttgtcttggtattctcatttagcatcacacaactgcatcctacaccacgctgactgcatctgaatttccagagaaaccttgcttcctgaactcaatatgtgtatttctttaaaaatagatatgtttgttatgttattgtaaaagcagtacacattcattgcagaaaacaaaaaaagtgaaagaaaatagtaaaaatcacccataatcataccacatggataattactgttaatattttgtagtatatctttgttttacaaaaaaacagggattacatggcatcttcttttcataatctgaatttttcacttaaaatatataacatattctttcatagtattaaatatagatattcatcttaatttttgctggttaccttgctcatactgtcttttattaaataataagctagtattgattatattttatctagcttatcattgtataaacaacattgtgatgaataagcttgaggcagtctttgtgtataatcatggctagttagtttgttaaaaagatatattcttagacacgggttacttagacaaagaatatcctcatttttaaggcttttgatacgtattgccaaaatacactctaggatgattctgacaattaatacctccaggaacagtgtttttttttcttctgttctccctattaggtatctgttcatggatatctgcactgaactcaacttcgatcccctccacaaatcttctctttctattagttctttcattacatatgtagttagtccctgcgatgagctaggcacactgttttaagcattgaggatacagcagtgactcaaactggcaaaaatccctgcctcaaggacattacattatgtctttttttcagttaattgcaccttcatcacccagttacccaatcaaggaagctaataattatcctaacgattctcttccaccccccacatccagtcaccaagtcctgccttaattatcttgtgagtctatcctccaattgccactccagtgccactgccagagtttagcactttagagtttctttcctggactccagaagcagcctctgtctggcctcccaggatccattttctctacactgtgacccatccttcacacacctccagagtgatcattctaaacatcaaatctgatcatggcagacacttcagcatgtttccagctgcatgatagagttcaagtcctcatcttgccagcctcctctcccatcactccactctacacctcactcgggttcccagaacatgtcattctccccttggacatcccccgagttctgcctgtgcttatccctggaataactaaacatccctctaatagaaagatagctcagaatgtgtgccctttcaaggcatatgcaaaaatttgctcaaaaggaatcaaagacctaaatgtaagagctaaaacataaactcttaaaagaaaacatagaagaaaagtttcacaacatcagatttggcaacaatttcttggatatggcaccaaaatcactggcaacaaaaaagaaaatagataaattggatttcatcaaaattaaaatcttttgtgcatgaaaggacacaaccaacagtgaaaaggtaacatacagaatatatttgcagattatatatctgataagaggttaatattcagaatgtacaagaaattcctacaactcaactgcaaaagcaaacaactcaattaaaaatggacagaagacttgaatagacatttttctgaagaataagtagaaatggccattaaccacatgaaaagatgctcaatatcactaatcattagagaaatacaaatcaaaaccacaatgagataccacttcacacccattaagatggctactattttttaaaaagcagataataagtgttcatgaggatggtggagaaattggaacacttgtccattgatgtccatgatgggaatgtaacatagagcagccactatgaaaatcagtatggaagttcctaattttaataaattaaaaatagaattaccatataatccagcaatgccacttctggatatatattccaaataaatgatggcagggactcaaagagatttgtacacccacatttgtagcagtattattcacaatagcaaagtggtggaagaaatccaactgtccattgatgggtgaatggatacagaaaatgttgtatattcatacagtggaatattattcagccttaaaaaggcaggaaattctgacacatgctacaatatggatgaactttaaagacattatgctaatcgaaataggccagtcacaaaaggacaggtactgtattattccacttatatgaggtatctagacttgtcaaattcataggaacagaaggtagaatgctggttactggggaattgaggaaggacaaatgaattattgtttaataggcagagtttcagttttgcacaatataaaaaagttctggaaatggatggtagtgaaggtacaacatacaacgtgtgaatgtgcttaataccaatgaactgtacatttaaaaattattaaaatggtaaattttgttatgtaaattttactacaattaaaaacaaaatgtgggccctactaatagtgagttagatgatcatgttgctacataaaatacagacattaatttaataccaatagcacctcatgcattctgaaaattttggtaacatatcagaattttataattacataatgtatatacttgtataattatgtatgtaactatattacatacatagtttacgtctaagccagagatggttgaggaaataaaatatattctttacagatcaagtcaagtggaaacgtcagaaaaaagaaaacgtgttctcaacgtagcccctaccctactttttaggaaattggaaaactgcctcttccctttcggatcaatctctcaaacaggtggggagcaacaggaaaggagtgagtgattaccttgaagtttgagtgtagtccgactttgccatgctacaggcatcatttctcttcgtgtcttcaggacaaattgactgttgataaatctgcggatgctgaaaatgttgaaggtaacttgaggatgaatgatggagaaatactcatccagttgaatattctgggtttggagtcctggtacgtacttctgaatgttcactctggcttgcttcacctgtagctatccacagaggacagatataagctgaggaatagaaagcaacctcccttcccataaacttccccttggaaataacattctagccatgttctgtggctcactatcgggaaagggggtcagtaatggaatcaacatcatggaagtaataaatttttttgaaacaatcaaatctgtgctaatgtctgaaagagaaaagaataatacgagagtgctcagaggcttatttccgactaaagagaaatgaggttacagctctctgttgggctaatagttcctccttgctctctgagacaactctctctctcactctctctatcatttactaatgaagaaactagcaaattctatagcattggatctatcacccaggcctgggtgaagaaatccatcaagggggtgggggaatacctttcactgctatctccagtgaacacacagaaggaagaagtaaaataggtgtcctttaaatgagttcctaatcaattcagttgacatatattttatccatagaaatggattaacaatcaaacttaaatagttatgctcacaactcttacagagcagtggcttgagttggcatgaccccttccccatgttcaagaggcagaatgtgaagctgggtgggatggagacatacatggtggtcacaaggatgggaagagttcatgggtagaattccaccctattgttgctactgactgtgttctgctgtctctttatgtagtgaattttagtgtcacttccttttccccttttttctaatggtaaactttcccatgcattcactagttcaaacctccctttctaccctatcaagaagatcctgcataatggattctggaggataccacaatatgaaaagcaaatcaatggtcctgccaggataaagcctagtctcccaagccctgggaatttctcagggacttgaaaatctccactgttcatgaaggactgtaaatcatgctcacttccctggcttagccccaattctaagctacagagggaagagtctcttactgattcatcgaatacaatgtggaaaggaaaagcgttgcagaatgtcttctcttcaatccagagtctctcaggataaattggctcaaaggtgttcatgagatgccctggacatagaaaaaggaagtgctgatgagaagcagctcccgcctccacccttgcacagagcagagctcgggatagggatagtatcttaagtgtttcacaagcaaagtgcaatctcacttcttttgcatggactccctcagcatctccagatggccacagcaattcttcttccaaattaaaacaaacagaaaacttgctaccaggttgagaagccctcctgccccctgccaagtttctgcctgccgctgaagagtttctgggccaattgagtatgtctcgccatgaacacagagtcggcattgaaatggtgacagccagacaatgagctagcagagcagagcgtgtgctccgggcccagcatcagggacatttgccatggagctttttagactgacagttttgggtggcacgtgaaaatttaaccaacagtcctatttggcagggggtagagattcgaaatggagcctttttgatatgaaaatctcctagacaaaggatgtcaattgcgtgtttgactcacttgccatggcttgaaggacgcaaaatgcagccctttgagccctgcagaccttctcccagatgcgtgtcacctggcccattgagtcgtgacgcagagcaccctaactcccttctcccaatggatcagagcccttattcagactcaggcgttaggtgctaatcgttagacgggctcagtgcccacaggggtaccttagcaagcctaatgcctgcattttgcaaatgagaagatggagactcttgtccagggtcacacagctccttaggcacagagccagaaacttgctttcttggctcttgatctagtgtcctttgcttgggcgactagggttgttatccacagatctccagtccagaaatgtgtccaaatggagaaggcctgactgcagaagacgagctgtggaaaattcattgttcctgatggcacatcagtgctcatcttccttctctccacccatcacctgttgggagtgattccaattgtgtctccaaaaactttttcttaggacaggggagatgatgtctccatgtcacccggcacaaataatgagaggcaatggaaggacaattagagcctgacattttaaagttaaaaaccatggtcaccaaatccaagctttgcagaaactagtgccaacacaatcacagagggcttggccctgtcagtgtacactggccactactcctgagaatcaagcaatctttctgatctcagagctgagcttgggagaatcactcacttaccttttccaaacatgactatgcttctcacaacatcccagtgggattttttcacaggacaagcagagacattcaaatatttctccttcatcttgaggaaagctgcctggagggcctgcaggtggcagggagacaggtacctggtcacatgactggagaagcacaaaccccatttgctgtgatggggtccacctttaaataaggaactgtatccatggccagaggaacagcatgagggcttacaagatcacttctaccaagactttagcgttcccggtattttttaatcaaattagtcctcatgctgtttctctatcaaagaaagcaataactttttagaaaatctcaagagggaactaggatgatatctggcaagaaaatcatgcacgaacatttcttcctgtggttgaagattctgcagtgaacagactctgagatggactttgaaaatactctaaggaatcagagactaatcctaatctgggtattttcacaagctatgtgcatggagagctgttcagctaacatacatggtaacttaagcaggtaatgatcaccctatcagttgcaactggggtggccaagtacagagtcttgagttgactcaggacctatgactggttccagctgcagaagtgggcactgaagactggaaagatcaatttatttgaggaggattgaaaaaaaaaagccatcaaattcaaatttcaaatccttcatatggttattgttataggtgaaaaattgtccaggctcaggtgcatcccagaatgcttcccagtatatatccacttaaccttaacccagcaattctcaactgggaatgattttatccattacccccactacgcagacacttggcaatgccaggagacatttctttttctttcttttttgtttggccacaaatgaggggatgaggttctactagtaggaaaagaccagggctgctgctaagcacactatgacgtgaaagacaccccatcaacaccaaagaattatctggttcaaaatgtcagcagtgccaaaactgagaaactctgccttaattccactattagaaggtccagttggtctcccatccaagcactaaccaggaccaaccctgcttaacttccgagatcagtcacgttcagggtggtatagccgcagacactcgtaagtgggaggtgaacagtgagaacacatggacacagggagaggagaatcacacgccggggcctgtcagggggcagggggcaaggagagggagagcattaggacaaatacctaatgcatgtggggcttaaaacctagttgataggtacagcaaaccaccatgacacatgcatacctatgtaacacacctacacattcaaaacatgtaacccagaacttaaaggaaaacgtaaaaaacaaaaacaaaaacaaaaaggtccagttgattctgttgtttgcatagatttttccaagactcgtagctctacttaagtgcaactgttctttctaaaggcacagcaaacccagtacctcttggtctctctccatgccctgactgtcttgtaacctttttggctttgtctttctcatcttcctgtgagccttctgtacaatcagaaacacaacatgctccttcttccctgtcctctccacttcttcattcatgtcaagaatgtccatgattacatcaatatcaaagaagtctttggccacagcctcaatgatacctgcagcagaaggacacctattgtcgagggatggccgaaggcaactttatcagcaaaaatcataaaataatcaaatggcaaaacttctgatgaatattctgaagttcaccaagcccaggccctgcttcaaatcagacatcagtgacagccaattaaataaaaatatgcagagactgaagttatacatgtttggataccaaatatatccatgccactttaatttctagtttggcatctattcatttgtttgttatttcaggtaggcatttaactcattaaacaaacaaataaacctagagataatgtaagcaaaattcagttgtaaaagcattaaggatcaagttcaaaaaagtgttcccctgggaatctatcccagggttatatacaaaatatagggaaagagccaggcacggtggctcatgcctgtaatcccagcactttgggaggctgaggcaggcagatcacaaggtcaggagatcgagacgatcctggctaacacagtgaaaccctgtctctactaaaaatacaaaaaattagtaaggtgtggtggtgggcacctgtagtcccagctacttgggaggctgaggcaggagaatggcatgaacccgggaggcagagcttgcagtgagccaagatcgcgccactgtactgcagcctgggcaatagagcgagactccatctcaaaaaaaaaaaagaaaaaaatatataaatggaaagcatgtatgaagatgttcatgatagcactgtttacaaaagcaaacgattagtatcaatggaaaatttaataataggggattagttaagataattacaatatggaatatcattcggccacttaatatgtggttttaaagattatgtggaaacatgctttttctacaatgctaaatgcaaataaaaagctgatacaaaataatatacgcagaattatcacaactatgtaaaagcctgtatgatttaaaatgttgaaagaaaagtacaaattactcatttttgtggaattttggaaacttattttaaaagctcaaggacattgggagcagtggtcaagatgatatgaagtcacacattctaagagttttaacttcttacccgtagccagttattagccatcctggagaatctatggggaaaccttcctcacttcagaagccccatagctctgcggccagctaagccatttccatacctggtacaatgtggcacagaccacttctatccgagtagtaatggagaaacattttcccatctgctcctctctccacacgaaacgatggtgcattcatctcctaattaaaagacacacatttttcccagtggacacaaattgtgtaaattatgcttttgacgctttgtgaaacaatagtatttacccattacatcatacagagctatatgccaaccctctctccaatcacatagaaactcccactgtttctgctcctgtatgtcaggaattttatactatacctactgtactttaaacaactctatatggcaagtactagttccatttgaagaggaagaaactgaggctcagggaaggcaaacctaggttaatggtagaacaacatttgattcccaaatgagcctttgcaccgtgccatgctgtttctacccatattccaaaagcagctgtctgctggtaacaggaagccttagtgagtttccgccgcgcttggcctgtgaccaagtgaccatgggcatcttcactttccaacacatcagggaatcagagaatttgcaagtagaattaatcaatgtcttgttctgaaaggataatgtcttctgtgatatcaatttgaacatttagaaagtagaaccttccaccgggcgtggtggctcgtgcctgtaatcccagcactctgggaggcgaggcgggcggatcacgaggtcagaagatagagaccatcctggctaacacggtgaaaccccgtctctactaaaaatacgaaaaaattagccgggcatagtggcacatgcctgtagtcccagctacttgggaggctgaggcaggagaatcgcttgaacccaggaggccgatgttgccataagccgagatggcgccactgcactccagactgggcgacagagcgatctcaaaaaaaaaaaaaaaagtagaaccttcaaggatacatcagaagagatcctcccctttctccagaaatgttgacattcaagtacctatcatttcacagtaaatgagatgtatactaggaaagaaggatagagattttgcctaggggagtctctagctagttagagggcaactcagcaccctggacacacagcttttggtccaagtgagggaataggtaaaggagatgggttccttccaagatctttgtcgtcttccatggtgaaatgttgttagttaaaatgggtttcttttttttccccaaatacttttttatttttattttttttaattttttatttatttttatttttttgagatagagtcatgctctgttgcccaggctggaatgcagtggcacggtaacggctcactgcagcctctgcctcctaggctcaaatgatcttcccacctcaggcttctgagtagctgggattacagtcacgccacctccatgcccagctacttttttttttttgtattgtttgtggaaatgtggctttgctgtgttgcccaggctggtctcaaactcccgggcataaatgatcttgtccacctcggcttccaaaagtgctaagattacaggcatgagccaccacgcccagccctcaaatactatttttttctaattccaaaagtatgtacctagagaaagtacatatatttatctgtatgtatgtgtgtttacatcttgacaaaatgtaaagagtagttgaggcagcacatataaaaagcataaataaaataggaaattaacagttaatttaaaaattatatccaaatcctacatagtgaaaataaagtaacagaatacagaggcctgaaagaaagtccacgtgatcctgcttcatgcccctcactccttaccccctgcccagagacacttccaaaagttcatgcttttagttcttctggtcaatgtcactaagtctctaaataatataattacacttttatttcttgcttcaaatagggctttttaaaagtggagaattagggcaaagaataacagaataaaaaaaatgcttttgcctaaagagacaatctataatactttgcccagaataaagcactatatagctgttaggtatcattacagaacagaatagaaagcccagaaataaggctgtacacctaaagccacgtgatctttgacaaagttcttattattccaaagaataatgagaacagcacagggcaggatctttggagacaggtgtgggtttgggtccagctcagccaccatgcctgggtgatttggggacagttacttgaactttctggacctcagttttctcatccgtataacaggaaaaataagactgcctactcttatggcatcaagaaggtaagtcaatgttgacacattacttagcccaacacctgcctcataattagcactcaatgaagtttggccaaagcataacaagattaaaggctcagttataaccagaaatgtataccttaaaggcactgccaaattactagatagacacaaaaaaagtgaacattatcttactttgttatttttgcctaaagagacaatctataatactttgcccagaataaagcactatatagctgttaggtatcattgcatgtattttcttccaacttgtatattataatatttaaatattttatttacctcattatgtgcaaaatgtcctcaaataccaccagataagttctattctattgcttctctagcatcacttataagtgagagctaaatattgaatacacatagacataaagatggcaacaacagacaccgggaactactagaggagggaggaagggatagggtcgagggttgaaaaactattgggtactatgctcactacctgggtgttagcgtcaatcataccccaaacctcagcatcatgcaatagacccatgtaaaaaacctgcatatgtaccctctgaatcttttttaaaaaattgaaattataaaaaagcaaaggaaaaagatcataggataaaaaatatatgtgttataaaaaaatattaaaagggcctaactctatttctttatatcctaattgttgtgctttagctaagaaattgaaaggaagttgtcatgcaaattatcgttaattcttaaactggccatattgaacagagagaaaagaaaggggaaggaatagagttattatttatttatggaaagctgatttttctgggctgattgcaatgctagacttttccatcttatctcttgtaatccacatattgctatgaggtaagttatcttttccctatttattcctttttgtctctgtttgtgtccaataccttaaaaagtacttgatacatagtatcactcaataaatattagttacccaataaatattattaaataaaataaattgagattcagagacggcaactaacttgtccaggatcgcacagctgttaagtggtagagccagtgggacagtctcatgggcccatctgaccccataagcagggctgtttccactccctctacccttgagtagttcacatgataacaataggacaggcccagctattcatgcccaactattcatgattcataattgaagtcagttaaggcttccaagcctctgattccttatatgaaaaatggagaaaataatacttttcccatttatcgtctatgggggggtgtaagggttgctgaggctttttaacatccacaatcccattttgtccccatgacaaccctgaaagggtggatatgaacaccaatatagaaatggtgaaggaagatctcggtgaaatatataaggccttaaaattaaactatgttctctaaagcaataaactattattatgatatgtataaatgctctttcaccttttcttgtctaaaaaataaaagagaatctaggcatttgaatttccagtgatctctacaaacaagaaacccaaggaaagaactccagaaggatatatcccagtagggaaattagtttcctaacacctcagtcagtcacccatgggttaatcagagttggatggtttccgattctggctcttagccctgtcaagtcttcccttctgatacatgaataacatgaatctggctgcatatgcaatttatcagctccatcctggccaggaaaccttaggagagcttttgcaaatgcactgaaacctgactgttttccagcctttgttccaattgtaatgagtctccaggatttaattccaaatcaacaccacaccctatctgaaaaggccatcccttcggtttttgtgagccagtttataaaagtggccagcaggtgtttctttttcattctcttccaaaaagaactcctgagcccaccaacaccaggtaccaaggattctgcagatgggagggttctcctgcaaccgtgcctctgttgggggaggcggggagctggcccaggactgccacagcatttgcttcctcttgggcagccaagaccagactcaagtggccttacctgataagagagtgccaggtaactgtggagggcatccaggttttcaataaactccatgagatttcctcccagtgtccgtagcatcctgtcatagccagacatcttcagaattgaaagtattctccaaagagtttcaggatggcttccatggagacacctgtagaaaccaaagcataccccctaaataaaatctcctggaggtgtgtgttgtcctttgtgtggtcttcatttatttccaaagggttcacatcctggctgtgtgacactatcgagctactctctaagccgtcacttgcctcctcggtaaaatgccaataaccacattgatgtcatgggcccttgggaggagccccgtgcagcctggcactgagtaggtgcttgtgaaacataagtctccttgacaaatacttcctcaaagtcgagaaggggatgcagagatgctgtacccgcttagctgctgaagccagtgcccagaacaagcttcactctgggtggggagggcgcgaccctccacgaacactgccaacacctcccacatctttaaatgtaacagtcagtctctaacaagaatacaaggatgcctctgagaaataactaatacacaatgaaaaaactatgccttcaaggctacaggatcctgatttaccaaaaagatgataccaaatacttgcagtgtctttccctttctctcctgacctccctgtgaggcccagtgttcctgttccattctccataaagatttctctgaattctctcttcctaagtgttgcatttttttttcttcctaattcatggtaattctggagagaagcaacccgatcctacacgttttctgtgctaaacacagcataggtgcctgatgaacacctggaggtagatttgcggcattagttggagctgctgcccacctccccgctccccagtctacactgttggaatagacagtaagcaagtgtccactttatgggaaagacagcaaacattttaaaagaatgttttatagttctgacaacacacattaattactgttctgttactcaatgtttgcccagctcttataaggtagctaaccttattatcatgtcctttttacagctgagcctgttggggctgagtcatctttgtgaattgactgcagtcacatagagttgcagaggccagatttgttgaagaggctccaactctaagtttagcactttttataccacatcccccagcctctgaagcagcaatgagagaagcaaggagtctccccaagggaagcgctgcttatgcgttggcatcattgacacaggagacagggcatccatccatgctgctggtctggagatcctgtgagaaacaccctcttatttacaatggggctgtgacacatgtaagtcctgggggctggggcaaatgtctgtaatgcccaggtttatggaaggcctgaagagctcaccatcaccagtatctgtggttgcatccttgaaaaactctgtgatgctctggctggatttggaattcacagcaagggacattccaggtctcatgagctatccagggctaaatcctacagaggacagacgaaggaggtctgggcactctccagcccctgcttgcttcctaggatggtctgaagagcagtttccctacagctcatagtccacagccagaccatggggcagataattgttctgtaatctgagcaggatagagtccccactgaattggtctagttttgtcagagatgagttgtacatattttccaagatgagttatacatattttccaaaaattgattagtcggatctcaatctagacgaagcttgggatggtagagaagccagtggtaatggcctgtgttaattgcctccgttggcttctttgcttgtgggtgcatcctggccggcctcaggcaggcttgtctatacactggtataaattcaaggaccacctgctaacccctaggggatctgagacaaattctaccaagttcctttccagtgcttgagtctctgggagggggactgctaaaaggtaaacagacagatgggaaattgtccttctgctctcctgcttccatccctctgttacctctgatctagcttattcagactaagaaaaaacagctgtgctgtgcatcctggaggctggagctctgagcaggtgcatcctgttacctgccaggaaaagcaggggtcccagcggccccccttctcccaagaacctctgccaggaggactgggctgcgtgtaagccaagcaaagttatattcaagtaagagtggcagctttgggtaaaagactgcctgtttgactttcaaatctttaaacttaaaaaatccatgaagctgtttgttccaggctctggttattttgtttgtggatgcccagctctgttaaaaggaaaggacatctggctgagagatgaactgtttcccaaacaaggatcttgggtttgagtgtggtgttttccacctgtaatgggtttggagcttcttctagaattcttagttgagaatgcttgtccagcagggaataaaggccgcttttttaaaaaaatcagcacctgttttagtcttttatacagtttcacatcagtgtatttaagattccaagaacccgctaagtcataggggatccaagatatacaggaaatggttagaaactgcaagaaagaactaaactaacttaggtgccttaaaatgtttttctgatagtgcaggggagactttatactatgcttagtattctttaatgtaagaaagaagggaaaacaaggaaataatcatctatctgcctacttgtgcaaaattaaacaccagaaggataaacctggatctattgagattggttacctacaggacattggtagggaatggggtggaaagattagaaaaattgtggagttggggaaaatgacatttttctgagcataactttttgaacagttctggtttggggagtcatgttaatgtttcatatgcttaaaataaataaaatataagatcaacaaggatagagaaaacccctaagatggagtacaaacagaaacaaattcacagaacagcatttcaacagaacagttttgaataacataatcacccaggaaaaaaattaacccagtaatatttgaacatagtatttacactactgtgtcttcaggccaaaaacaaaaagaactttaaacaaatattttactgtagttagtaggcttccttttcacagcagtgtgggttagcaattctgaaactatgttctgaacaagtaaatatattgtggatagtgggagccaggtttttccctatctgagaatgaagttacaattatggaaaggggaggaatagaatgaaccctgtgcctctggattagaaaatctaacataataagacaatgaaatctatcatggttttagatatatctatattttatatatctatatctatatctatattttatatatctatatctatatctatattttatatatctatatctatattttatatatctatatctatatatagatagatatatagatagatatagattatatctatatatattatattatatctatatattatatatagatatatattatatatatagatatatatatagagagagaaagatggatgtatgtgtgtgtatgtgtgtgtgtgtgtgtgtgtgtgtgtgtgtgtatatgacatgtattttccagcactgtccactaagagggcctaaaagcagtgatatcccagtagcagtggggttgcctaatgtctagatcttagtttttaaatgctcttctcctgtaaaaggaatcagggccttggagaaatggcagattccagggctggggcagggaaaggatgagatcagcctataacatcttgttatgcaagaaggtaaagaagtgatcaaagaatgatggggacatgtcaaaaggacacaggggccagtttagggtggctctcactggctaactcttgcacaatttgagcatcaaaataaataataaaaggaaaggattacagcctgtttttaaaaaataagaatcacaaatctacattgatataagtaaataaatacatgggggagagggggaaattcttccttacagaaactcaatgaataaatacaaaaggaataatattcttagaaaatcaccatttgacttccatcataagtatcaattcagacaagaatcacaaataaatactaaaactatgaaagagggagtttgagaaatgacaagatatttgcataatctgaaagtatctcctcacaaggtactaattacaaagggaaaatgtaactttacagtggagaaagctggcaaattctacgtaaatcaagtgatcaaagttagcctcactaataataggacagatcaatgaatggaatatgcctcctgatatgataaactgggaaggaaaaagatcacgtctgtgatcttcctgccaggaaagcataacctgaattatatcatgaggaatatcagataatcctcaattgagggacattttgcaaaatgtctgaccagaactttccaaaaataccaattttataaaacataaagagactcagaaactgttccaagccaaagaatactgaagagacacgataagtgacatgattcaggattttcttttgttctaaaggacatcactgggtcaactggaaaactctcaataaggtctatagattagataatagcactatatctatgttcatttcctgagtttgattgttgtactgtagttatttaagagaatttttaaggacaagaaggcatcacatttgcaatatactaacaatttcaagaaaaaaagtataaatctagatataaagagaaggatagacactatatggtaaaatgtcaacatttggggaatatggataaatactacatgggaattctttgtactattcttgtaagccttttgcaagtttgaaattatgtcaaagtaaaaaagattctgttgattgctctgaaaagaccatagggaatcttacataataagaccgtaaagaccatgtttatccatggccagctgaaatacagctgcagcccaggcctctgtaatgttatgaattttgttagttataatcagggcattatcagtacatttttaatgtctttatcttgttagagactaatactgaaatatttatggatgaaattgtgagaaacctggtaattgctttaaaacactccagaaaaaataaaactagaaaaagagtggaggaatcagatagatgaaataagactggcaaaatattgttaattagtgaagctgggtggagggtatgtgggcttctgtacacaattctctctacttttgcgtatgtattaaaacattttttttaaataaataaaggagttgagttttttttggttggttgtttttttttttgtttggttgggtttttttcgtttgtttttttgtttgtttgttcggttttttgagacagggtctcactctgttgcccaggctggagtgcagtggtgctatcacggctcacgcagcttcaacctccccaggctcaggtgatcctcctgcctcagcctcctaagtagctgggactacaggtgtgtgccatcacgcctggttaatttttgtattttttgtagagatgggggttttgccatgttgtccaggctggtcttaaactcctgggctcaagtgatccacccaccttgacctcccaaagtgctgggattacaacacccacccaagactttttttccaggaggaaaatgatggtcacaaagcttctatgcttgattccccaggtgtggagacctctaacaagcttttacattggagtgttgcatgaactcaaactttctgacttaacaagcatgggtcttctttgtcactgggaaacatttgcttcttgctgggtttcagctcaaggtactggaaagagtagagttgggctgtccagggctgggggacagagagcgcctgttgaagccccagtgaggctggcagggacaccatagccaccaaagcagagcctcctggacaaacagcccactcagggccagacttgcaagacccctgcccacctcccgtcacccaagtcacaggcaacaagagctattcctcatggcactcttcctgagtcacccagcaaaacatgtgctcttcaacaggaaagagaagtacatgctctacatttgacaaagttttccgttgaaaatgggtaatttttcccccaaagcgttggtatccaaaggattactcttcagatacctgaaaagagccagaatctcacatactctttttctccaatgatatcactaatgtcaggcatgagttagtttatggggaaatattttggagtaggagaaagagtagtctaagaaaaggaaagaaacatctgcccatgtccatgctgtagtttgcaaggaggaagaagactctaaattaggagggttgggtttcagaagtagtcgtaagtttatacaggcacagagaaaaaataaactggaagtcgattaaggcagctcaggaaggtggtgctctgcagggatgaagcaattccgctgaagcctggtagagaagaagcctcctggttcccgtcaaaccttggaacagagtagtcagccctaccagggccacagcagggggccaggggtctatctggtggcaagcaggggtgagggacagggcgaggtaccttgttgtgtacccactcggtgtcaggcattttgctcaccttatttgatttcttctgtaggacagatgaaaccccctgggttgttgtcctacagaagaaatcaaataaggtgagcaaaacgtcacaggtatcattgctgcattaccaggggaacatttaccccaggttacattatcaggagccggtgtagccagggggctcacccaggtccgtctgattccaaagcccttgctctagacattgtcgacttcccctccagtctgtgggattaagcatcagccttggaatcagcagacctgaattcaagtctccattcgtggctggttgcacagcctgggttacttgtcccatcctcagaggagaatagtgaagagcaaacgttataatgcctgatttcaagacgttgtcaattttgtgttgttcttatttttaaagatgtgagtgcagagaggcttgctggcatttgctgatagctaactgttgaaacacattttactgtgggtgtcttcgcaagcaaagtctagacggacacagctgtgccaaatggctgttgtgtgttgttttgaattttgtcgcttcagatcactaataacccacttacacactaagtaggcacttattcatatacagaacaattccttatgcaatgctcaacctgccatctggtcccctcctgaattatgctaattggaaagcacagagctatgcagtggcagagcggtctggaaaagtcccagcaattgcttcaaggtagggaaattgcattctgaagcccacatggaaagcaaagccctcactagtggtgactaagcacactttttcccttgtcaaagggaggattttcaactgaccagtatattttgttagacagtaaaatgtccttcctgtagcctttcctttggatgggtcttgctctctcagactcatgggagttggagacatacagaatcacgacgggcttcctggggctgtcctgattccacatctcatacatgtgttcactcgattttgcatcccaacttcttgtttgaaaaatgcattcaccatactcatttactctttcagatagatataggccaatagatgttatggaaataaactacaagaagaaaagattcctgacattcaaagctaggcagagagaaaccacagtgatgtacgttggctttcggtggaaaggtgatgtgggccagcccacacattggtctgtagactggctgctgcctctacacatgttggttgggttgggaatgtgacggcagtggggcaggtatgtgatggcatctcactgctggaggtactgccacaccgtttgatgtacatgagcacagacagccacaaaaatggactggggtgatatgatatatacagagtatttctttctggagatatacaagctgattcaagttcttatattagtccactagggccaccacgacaaaatgccatagatggggtggcttaaacaacagatatttattttctcagagttctggaggtcggaagtctgagatcaaggtgataacatgattacttgacttatagagggtcaccctctcaccatgttcccatgtgacagggagtgagagagccagtgctctggtatctctcctataagagctccaatcctatcaagagggccccaccctcatgagttcatctcaacctaattatttcccaaaggccccatttccaaatatgaatttggggcatgggggcacaattcagtccagagcagttcttaggttaaaagatatttttagaatcttgaaaaagatctgcatccacccttgagagcatgaaatgaccaacttttcctgtgaagggcagatagtaaataataaatgttttcggctttgtaggtcatatggtctctgcgcagctactcagccctgccactgtaacacaaaagcagccatggacgatgtataaacaaaggggcacggctgtgttccaataaaacgtgacttacacaaacaggcaagggcccagatctggcccataagctgtatgtagtttgctgaccactaatcagagagctcagaacataatttttttttttttgagacagagccttgctctgttgcccaggctggagtgcagtggcacgatcttggctcactgcagcctccgcctcccaggttcaagtgattctcctgcctaagcctcctaaatagctgggattacaggggcaggccaccacgcctggctaatttttttttttttttttttttttttttttttgcatttttagtagagatggggttttaccatgttgcccaggctggttttgaactcctgacctcaagtgatccacccacctcagtctcccaaagtgctgggattacaggcgtgagccaccgcacctggcccataatttattttattttattttattatttttaagttccaaggtacatgtgcaggatgtgcaggtttgttacatacataaatgtgtgtcatggtgctttgctgcacagatcaacccatcacctaggtattaagcccagcacgcgtgagctaattttcctaatgctctccttccccccgacccccacaacaggccccagtgtgtgttgttcccctccctgtgtacatgtggaacataattttttaccacagccatttgaagtgaacagcaaagcctgtcttcttataagggacagtatctagaggtacaaaacatagaaatacccccatccttccttcagattcaacatttggctgacatttaccaaacacccagtatgtgccatgcatgttgctaagtgccttacatttgttatttgatttaattcattccttcccacaaccctgtaaggtattattccttttgcaggagatcaactctcagtgaaattctagcccaaggtcacacagctggtgtgacggaaaagaatccaccctccattctcattctggaataacaacgagatgttctttcgcagagggctcagaccaaatcaagactacacgatacagccactacgtccttctgctgctgggatcccttggaataaaatcaagaaaagactaaaggtgggcttaatttcactacccattgtaagcttttttgccgttttatttcctaagctctgtcaaaactccagattttcagctcaaaagtagtcatctctcattacagaatttccacctaatgatttgtattcttcctgtggaaggaaggttactagatgctcctcttacttagctagaagaaaggaggtaattgcaaaccactggacttgctcgtggacctcctgccctcactaggatcacagatgtgcagaattgtcagccacaagggcagcacctaggctttgcctatgtggggtggacatattaggatcaagaggggatctgtctgtctggtttgcaaaagcatatttaacatcgtaatcgcatacttttaaaaaaaattaaagtgatgcttaagaaaacaaaacaggtaatctctttggcaggtgtgtcaagcataaaggctgacaggtgaccctctggggtggctgtgctgctgccacctgttgaacaaaaaggccatagctggggagcagagctgagtcgagaacccaggtctccaggcctgcagcccctgggagcagcacagtgctgtaaagaggacacatcccgctctcagactcgagcgcagaaagctcgatgctgtgtgctttttgataacccagccccacagaaacctcccctggtgttagctgctggagagacaaaagggcctgggagtccccccaagacaggctggacaggataggggtgaggtttgcaggtatcactgacacttcccagttcctgggccagctttggcctagaatctctctctgtaagcttctttggagagcggagctggttggtggattcggggagaggcccagccgtgattcttgggaagccacgtgagccctgtctgccagctgcctgtgtcctccctctaagtgctgccgtggtggcaggctgggaactggctttaggaagcatccgggaggtgttgctgctcttggcgcctgagttccaggagctgaaggagcaaatgactgtttcactccttgtgccttatttccagcctcagacacaaccttggttctatcaaaagatgcaggtgggaagtgaccaggggctaacatacatctggttggaagttgttttaacaaccagttgggacaccagattcctcctagctatgatcaccatcacctgccaggcctcgttggcaactctggcccctgcttgtctctgtggctccaagagagcaacatgatgagatgagacagcaggtggcccagagtggacaggggaagcaggtggcccagagtgggcaggggaagcaggtgaccacctgttaccagagaggactctgagcaccacacacatccagcttcctcagcctcaatgacttccccctcccagcttggcagagactttgggcctctcctggatatggatccctggaaggtcttctgcatccaggagatgaccaggaacatgagaagagatgtagatatcagtcacagcgccatgtgaaagccatgggaaaagccctctcatctgtcagatccagttgcctgcaagtaaagctggcactatctttttaatcatcagataatttttctgaaatccaaagggaagggaaataagctcaatacctcacacgacacgggcactttacacatcactgctgcgctctggagaagctgcctgtccctgcgggcttagcattagctagctgccctggtgtgttctcaggcacgcctgctgggctgatgactgtgatacctgctactggcttaaacctatatcatttcacaaattgttcctgagaatggcaagccaatttgctaggccctcagaggcaccatgaaaccaactcaaaaccatggcccctgctgccagaccctctgcaggctgcataagagccagcttgcacactcccagggactgggcctagcctgacacttccaacagggctatacccggtgccaggtgacaagcatgaggcctgatgcagcgtctgagtgagatcatccttaaatgccatctcacactctcacagtgacccaaggcagcaccgcctatgaggaatgggtgaaggaagttcaacgggaagggaaagaggaacctcatcaaagatcctgggtacagaggggggcttcggcttcctgcatagatccctggagcctgggacggtggaggctgcctgcccctccctcccctcaggcctgccctggctcattgtgtactcagtgctggtgagaaggaaggataaagaaagcgagggtgtattgggttgaatagtgtgcccccaaattcatgtccacccagaacctcagactgtgaccttatttgaaaagagagcagatgtagctagttaaaataaggtgaggacataagggattagggtgggccctaaatccaaaggctgctgtcaatatgagaaggccacgtgaacacacagggaagaaggcctgtggagatggggacagagattggggagatgtgtctacaggctaagcggtgccagcaactgccagaagttgggagagaagcaagagacaagttatccctagagcttccaggggaatgaacccagccaacaccttggctttagacttctggcctccagaactgggagagaattgatgtttgttgtttgaagccacctggttgttggtactttgttacagcagcccaggaaacacaaaggggagggaaggaagaaagaagaaaggaagggaaggagggagggagggagtgagggaaaggagggaatgagggaagaagggagggagggaatgttttttgaaagcctattatatgccagataccacatatgatattttcacatatattttctcatttaatcctccaaataactctgaagattagatcttgttcaaccaatgagaaaactgtgactatttaggtcatttgtcctcggtcattaaactagaaagaggcagagctaatttcttttttttttttcttgtttttttttttttttttttgtcctgtaccttgtcccctctgggcctggggagtgagcagattaacaagataaaaaaaatccagtgctaatacatccacaggaaaaaccatcctgggaggacacgtacattgtcagtgggaccatccacacatggtccccctcctatgaccctgtcaatggcattttcatgtccaggcagatgggaaaatatgcgatggagagcagatcggggaagggccctcagcacactgcagagcaccccacgtccatttccaggtaagcacgagtgtaggtggcataggcggattctcaatgttgttcctcctgacacccagagataatcatagcagaccattctaaaggtattgcaacacctgtaaagccaacatcgaagccaaacatgatggcagtggtgcagacggtgctgctcatcatttttgtctgtaagaagcctaaggccactcaaatggaaagggtcatacctgagccctgtactgggttagagtgccccttaaaattcatgtctaccaggaacttgtgaatgtgacattgtttggaaattgggtaatcaagttaaaatgatgtcatttaggatggaccctaaatccaatatgcttgatgtcctaatgagaagatggaaatttagacacagagacacaaatacagggagaagacagccacgtgaagacagaagcagaggctggagttatgccgccactagccaaggaaagcctggggccacccgaagttggaagagggaaagaatttttcctgagagccttcagagagagcacggccctgccagcaacctgattttggacttctggtcccctgaaccacagagaacgaatttctgtagttttaagccacccaggttgtgatacagtcggtcctcattatttgaggatttcatattcacaaatttggctacttatttatctgtaggcccgaaatcaatactcacagagctatcaaggtcattcacagacacagaatttccaccggccaacatgaatgcttctagccaaggtagaacaaggctgtgctctatgttcttattttagtttgaactataaccaagtgtccttcttgcagtctatttagtgtcatctttttcacatttttctgcttttctgttggtgattttgctgtttagaatgacccccaaatgtaggctgaagtgccatctagtgtccctaagcacaagaagactgtcacatccttccagagaacaggcagtgttagattagcctccttcaggcatgagttacagtacagttggccagcagttcaatgtgaatgaatcaactatgtatattaaatacgtatttttttcacagaagcacacatgaaacaaagttatgcattgattggttggcaaaaatcttgtgaccagagactttcaggaaactaaccctgtatttcccctaggaacaatggtgcagtattcactaattcaggattgcagcagctttatagactataaccaatgcaaataatgagaatcaactgggttttgttacagcagctctaagaaagcaaaacaagttctttcatacttacccagaatgttgcaggcctcttggatgagcttaatggtgatgacgtcatcatacattgtgtaggtcatgaaggcatcttgtacttctgcagaagttctggaggataaatcgaggtgcagtgaatgctcatcagctggagctttgccccaggaatatatccactgacccagcaagatataatgtaacaataatcttcttgatcataaggaatgtgagacactggagtgtttgggtgtcaactcctccaagaagccttccctggacctcagtttgagcccggagaccccttctcaagtacccaggataggctatgcatttcctcaacttatataaagattgttggtcttacccactagctggtctccttgaggatgagcattgtgacctgtttttatctttgaacccccagcaagtggcactgtactgagcacatgttcagaacttaatatatggtagtaaactggaactcaatggtcatagagtcttgttctctgaatggtagagcagctgcttgagtttctcactgttttgcagtgtagttggctatgttgcaggagttatggatggactttagtcttcaacagatagccaagcctgctgaaaagaggcttagcctgggagtctgagacttgcacccttggcttggcccttatgtgagtcatcaaactgtagttggcaactgagttaacaaatgggggaaggaggttggtcagggaatgcttctctaagaaagggagattttgctgagactgaaggatggaaaggcaaagaagagccttctggacagagagaacaggcttctaggcagcagagaacatgtttgaagaacagagaggggtcagagcattcaagcttatccagagcacaccatagaatcttgacactgcgagaagtatggaattttctacatatccaattttctaaatgtccaatttcttactgcacgctatttctgactgctggttttccagtttcttcttgaatgcttccagtgacaacaagctcattcctttgcaaggcagcacattccacttaccaactgctctctttgatggaaacgtctttcttatgttcaaatgaaacccccttctgggccctcataatacctcctatttattaagcatgtgcttttggcccaagagatgaccaatttattacttatcattcctcgtactgttgagaaggctgatgctcagagggattaaatgtcttgctatggtcaccggttgacaagagaaggatctgggctctgaacttcaaagcccacaccactcctgtactgtgctgctgggaatttactcactggccttagttctaccctttaggaaaatgcagactgggctggtccctcctctggatacctaaccttctaatgtttgaggatccttattcatcactaaatttaactatctctttatcatctttctggacttcatcttcctctctgtaaaatgtggcaattattattacctgcccttcctatctgccaggagtgttggtaaggataaaacaggataacaaatctgaaagagcttggggaaaatgagaaccaccatgcagatcctaggagagctgtgatgacaatgagaacaaaggggctgcgtagtgagtaggaggtgaccagggctggggtttaggagactttggttccaagcttataccttacacaaataagctctgagggaaaaccactttccccctctgggccttgatttctttatccgtaaaatagaggaggtactgggcaagatttgtgtttctccatcttttttaacctctctgctacacacacatccactggggattctcagacagccccagaaacgcttgtgcacgcagttgaggatctaggactctagcttctaggactagaagctgcttgaattctccttcacctgtaagagttcctgttttggcccatgcctatacagtgctttctaagcatcttcggaggcagctgttcagagaaaccggctgtaggcctgctcgggcgaggagtgctgtacaccaccactgctgcctaagtggggcactctccaccatgttggagttgcctcttactcgcccccaggggcccacaagtctctgtgaaaacatgtgccctccttctgcacctataagcaaaacagaaacacgtggacgtgaccccagtttaaacttgacacattgtcataatgtgttctgaagaccttagaaagggttaagtgacctccaggaccgtcagaaatgtaacaaactctgtggcgctccctggccctctgatgggaccacccattcaccaatctctggatctggcagcctgttctttcctgtaggctgaactgatcatattttagtgtcaaatatttatttgggtttgtatatatgttgcacgttgctgggatgccagacgtgcccagactgttatgattatacagggattttcagccttgtttattgatctccacgatcctgcatataacatttcccacagagccagtgcacacttgcatatgtagtcattcaagctgctttagtaaaacagtatgttcaccaagaattttttttaaataaataaaccaattgatatcttccaatgagatgacagagcctctcatatgcagaggagaaagagagaaaaatgactattggaaagcattttgaagagatcgagttggagatgcaagaaatgtgggaaatgaagtaagagttagatgtttccagctcacacaaagaggagtacctgtcatggaacatgaaaagtgtcagccacataggtgcttgtatgcatccatgtgcaggagactgaggaatcagtgtttaattggcaccagcaggcattcaatatatgttcctctttagttagttccaactagcgatacccaaaatatctgagcagaaaatcagggccaggctgcctatagcagagcaactcacagggcaaaataaatacacagattcctgagccccaggaggtagtgtctgaaaatccatatatttttaaccactcgcctcagacgactgtccaggtttgaaaaccactgcacagaaacactttttaggattcagtctggcaaggcaacaggttacaaatgatacattttacgtggttcaaccttactaaactgatgtaatggttattcagagtccagggtgagccataaagcccataggaaaaatgaacagcactttgtagcaagattcaggccaagagaatgggatcaatttaagccataggaactcattttttcaacagctctcttaatggtaggtggggaattcatataacaaacttgcctgtcactgtgtgactcaaggtgtacttggggaaagagaggcccagagaggcaaaagatttgtcctggtgtcacaaccatctggaatttagaaaaagcaccagactgtctttctagcctgtcctccagctagcctgtctggctccccacagctttcctaataaaatctagacttcttaggtggacatacccagcctccacgacccagcctctgcacccactcctcacctccagccatttatcccatacatccattcctccagctactcaaactcctctcttccctgccttcccacaggctctgctccactagaaaagctctcactttccctgatctggctaacttgattcttccttcccaactcagtgtcagaatcccgattctggacattctcagccacttgcagatccgggcgtccctgctctgagccccccgtgctctctgtatcacctgtcttcgtgctaactgcgagtggaattgatttgcccatctgcatgcttcctagactaccaagttgaaggatcatgacaatgtcatttgatttaatatcttcaatacctagccctgtacctggcacacaacaagtactcaataaataattgtaagataatttcggtgagagacctaacttgacagaggctcacagactctgtgtgtcaggaggagacctaggagttaaccctggctctaccaccatctagctggatgacttggagcaaatctcactgtgcctccatttcttcatttttacaaagatagtattcaactaggtcattgtcatgaagactgtcatgtctggtcctccccttctctccctcagccaccaatgatgtctccttccttgacctctgattcacttagaaggatgcttaaggcatttaagccagcagttctcaaagtatgacccatggaacccctgcgaatacctaaggtgtttttaggaatccatgaggccaaactattttcaaaaccaaattaagacattatttgccttttgtactgattcatatttgcactaatggcacataagcattggtgagtaaaatttggtgccttatagcatgaatcaagacagtggcacaaaactattatattctttttttaaatcttcagtatattatttatagtcatcatatccctcattgtcacatatgtgcagtaaaaaaaaatgccagttttactttaggttgttcattttgaggtagtaaaaattactaatgttatgaaatcttgaccctgagtatacatcttttgaatattttgtgtaacagaatgggaagtacgcactcaaataaagtacttctcctatatgcaggagtgtgaatggtcacttccaggaaaagtacttacacgattgagttatgagatgaattagccactttttttaatggaacatcatttccacttaaaaaaccactgacagacgaactatggttactcagacttggatatttggcacacattctcttaagaaaataacaaagttagcctgtcacttcaaggaaaataactggcagaatgtgttgccaatgacaaaactcaagtttggggaaaaaagttgcatcttatactgtaagcttattagcatcccaatccttagaggctaaggtgatgatgatattgacaaatgcaattttgatattgtatagtgaaacatgtcaacatttgtaagattagcacaagtcagtgagctaatagtttccaaataactcatgcaagctagtacaaaatgatgcgaaaaaatttctatccaagtgtaacacagatcaagagattttaatataacagagtacgaagaaggtcatcagtacagttacagattcaacattataactgacctttgagaaaatacgatttgtcaagcttttgtgaggtttaaaagaatagccacaattatctgagaagagtattaaattcttcttccttccatattttcttcacaagtttcaaccaaaatcatatcacagaatacatacattgcggaagatggaatcccacttccattacttccattaagtcagatattaaaagagatttccagaactgtaaagtaatgccatcttgtcattaatttatttgaataatatagttatcataaaaatgttacactaacatgtactattatgtattacagcataattatataacatataattattttagataaatttaaaaatgtttttttaatttgttttaatttctaataccataaatacccatagattaaacaaaagctctgtggggtcttcaataatttatgagagtataaaggcttctgaataccaaagtgtttaagaacttctgatttaaatcaagagtgcttcaggtttgctttggaagctaatgaagctgaggtttccaggacagggaggaagcagcctcacctggccccctctagcttgaagccatccccagcctgaggggtcaccttatatgccctggtagtggtcctggatgcctgtgggtggggctgcagaccacccagtcctcaggaccacttgcttctggtagactcaacacacatccagactctactctaacccccaaaaaggcatctgaaagagaggctgcgcattcccagtggggaccgcctggtccaagaggacttgcgtaaaagtaggggagatgggtggaacaggtcgagggagatcaaacgctggagttttcccaggacttgccaacatgaaagaagcacacttcagcaagaaactgctgagaaagttatggatgtgcataaagaaatttgtctaagctaacaatgaaaacaaaatacaataaatacaattttcagccagccatgctagaatattcattctatcctctttatagaaaatgacattataaaatcattgtccaatgaacagaaaaagcaaaatacagccaaagatgcaggaaagtattataaaagagggttagttaatttatgatactaacaataaaaacatgtttccagcttttgatgtttatgttatctgtcagctttaaagttttcttccttaattctaagaagagtacttatttttgtagctaaatttttattggtaattatattctttttaaaggaggcttcccaaattatataagcttcaggcctcgtgatatctgtttctactcctactaagtttatcttccaggccctgcgcagtggctcatgccagtaatcccagcactttgggaggccaaggtgggcagatcacttgaggtcaggggttcgagaccagcctggccaacatggtgaaaacttgtctccactaaaagtaagaaaattagccaggtgtggtggagtatgcctgtaatcccagctactcaggaggctgaggcaagagaatagcttgaaccctgggaggcagaggttgcagtgagccaagatcgcgtcacttcatttcagcctgggcaacagagcgagactccatctcaaaaaaaaaaaaaaggaagaagaaaatttatcttccatatagtcatactaaacaaaagtatttctcaagctttacctttgacagcttttgttagaaaaaaatacttctgctttgtatatttaatattataatattcactatatttttagaatttcccacagatattctcatatgatcttttggaggctgagtcctccaggtgaaatgctctgaccagattgatttctaagggcccttctggctctgaggggctgtggtttcaggcagctagatgaaccagcaaaaatgtttgtggccaggaaagggacagaagtggggagacaagcaacatttttggatcaaagttaaaaataaaaactctctgctttcagctacttttaaactagactttatttatgggaaaagtagataacatggagggccaggggttttcagtcttgaagagagggtgagaaatttggtgagtcaattggatggacgagggatagcagaaaagggaatgaatgaattctgactttttctggctcaattagctttgcgatatactgggctcgaaggaatgcttctcaggatgtcacaatgttaacagccttttttttttttttttttttgagatggagtctcacactgtcacccaggctggagtgcaatggagcgatctcggctcactgcaacctccgcctcccaggttcaagcgattctctggcctcagccacccaagtagctggtgttacaggtgctggaccacacctggctaatttttttatatttttagtagagacgggggtttcactatgttggcccggccagtctcgaactcctgtcctcatgatctgcccgcctcggcctcccaaagtgctgggattacaggcgcgagccactgtgcccggccagcatttcctatttagcaagaacaaaaatcccaaggattcataatcagggttccttgattttttttagattgtagagttcttagagattctgatgaaaactatgaaccctctccccagaaaatacatatagtcacatgtacacgacattttaatagatgacttcggagggttctcagaccttctcaagcctatccatgaacctttggttaagaacccatgacatagagagaagccatgtaatcccacccacctctctcctaaatgggttggttgggcttggtagtcatccatccacctctcattcatttattcatcttccattcatacacacatgaatcatccaatcattcattccgttttcatgtatttatttatacaatggagaatatacgtcagtcctgatggctctacccattacctcttcttagagaccccaccctccaaagtccatctgaatgggatacatatggactccagaccaaagaccatcaaaccctctttctcaggcatctgcaattgaggcactgagaaactgagccagtctgatgatggtgatctcttgaatccaaagggcatatagaaaagcttggaagaaacagaaattaagtccaatcatggtggcatatacctgtaatcccagcactttgagaggctgaggcaagaggatcacttaaagtcaggagtttgagaccagcctgggcaacaaagcaaaagcctgtctcaccaaaaaataaaataagataaccaggcacagtgccatgtgcctcttatcctagctactcaggaggctgaggcaggaggatcacttgagcccaggatttgaggctgcactgacctatgaacatgccactgcactccagcctgggtgacagaaaaaaaaaaaaggaacagaaatcaaaagactttcagagagaagagataaccaggaaaatagagtaaacgtgaagggagatgcagagttggaaacagacctgctgactttctgtttcctctgagatttatctgtacttcctgcaattgagttctgttagagtcttctgaatctttatagtaactcctttaaacattagcttacatagtggattgctgatccttggaagtaaaatcctggactaagttctgcaaacaaagtgccaaggggatgttagccacctcacctatgctcacaagtggatgaggtgagcaccatgattatctccattcacaagtgaccacaccaaagctcagaaacttcagtaacccattgtcattagaagaaaagttcagctccttctcatcttctacacatttatatgtcctgatccctaaaaccctctccaccttcatctcctatcagactcctcacatatgatattccaagcatgttagatttttttcttcactgagttcagtctgacctcaggacctttgcacttgccattttctctggaacacatataacttctctgtcttgaggctgactccttccttcctttcagttcaaacattacctttgccaagaggttttctctaaccagctcagggcaactggcatcttctctgcccagtcaccactaaatactctaaatttagctctttgcacaacctgagatttatttgtttatttgcctgtttactgtcctccccattggaatacattcccagggaacacagcacttgcctattccttttgcctctattcccagtgcctgaaactttgttcagcacattctagaagctaaatacttgttgaataaatacatttgcccaagtcaaacagcaagtaagtgatccaggcaaaatgtaaaggtttatctgattccaaaggccttactcttcctaatccattagttccttctcattgttaaatttcaataaaggttttaaccaaaagattataaacaagcaatttaggccaggcacggtggttcacacctgtaatcccagcactttgggaggctgaggcaggaggatctcttgaggccaggagttcacaaacagactgggcaacatagagagattttgtctctaaaaaaaaaaattttttttttaaattagctggacatggtggtgcattcctgtagtcccagctactctggtggctgaggtggaaggatcacttaagctcaagggtttgagactgcagtgagctatgatcgtaccactgtactccagcctgagtgacagagtgagaccctgtctcttaaaaaaaaaaaaaaaaagagtgatttataattagaaatctacaaatctagactataagagaggaaaatactgcaagcaaaggaggagaaacatctgtttcctatttcatgttaagataaaatttatgtcataaggtctggaaacatgcttcattttacctaatcatttcttcttaaaatttctgtaggaattgatgggttttttctttctcagctgaaattctactctaaaagcattagggaatttgttatttaaatgtggcctaagcaaatccttttgcacagccaataatctcaccttaatttctcctttaaaagctgagttttctgcactagtttttttttcttttttctttttagtaaattctaatatgatgcaattttcatagctggtggacttcttagattggctttatttttggcttaaagatgcatttccaatgcaatcgtatagatgtctagtgctctgtatacaaacatcctgagacccagttaagcagataattgaaacttcaagatgaaagagataaaacctaatgacacaagcgcaggatgtaccctgctgggttctctattcccagacatatttctctggttcccttgcattcttgtaccctcattcaaatgtcctttatccccctggaggtcatgtggattcctgtttgtttgggaatgctatgagaactgctcttctaaaggaagaaagagatgacattccagcctttcagagaggtcgcaccaaggatccaaaaaggaaaaagtctcttccatccacttacacatggaaagctggagattttttcccccttgatttggaaagatatgctgaatatctcaaccaatgaaggttccagcagctggccatgctatctgtgttcagtcatacccggagggtgagagtccctccttaaacaacacatctcagctgcctgtcgtaggcagagctgaacatgtcattttacctctgctcatgtctaagtgctctggctatttctggctattttcaatgatttccagagccctggcctttctcctaggcaggacaggttcttctaagcagcagctgagctgaggctaaatgtcctaaccaggaaatcacatggtagaaaattcgtaagtcaaaaatcaatcaacaaaaatccatctctccccttcacggcctggtccctagcatttatgagggttcctcaaggcagggctagacagtggcccacactaggcgtcagggagatcagactgaaatgaggagtggagataaagccattcagcaaatcacactaactttaggaggcaaggtctcctctgggcaaagagaaagcctttgaggaatatctgcttcttcaagatggaaagcatcattatctgaccagcagcaaagtggttctaataatgtcaagtataatgtaatcttaatgtagcacctatatctcagagaggaggaaggatgcttactgagtttctactaggcacttctgtgtagattgcaccactcaattctctccttaaccctagaagataggtacattattccccctttatcaatgaggaaacagagcttcagagaggtgaagcaacccgctcaagatcacacagctctgagcagcagagcccagatgcaaatccagtccagtgggacgcacgccactgccccccacctctcccccaacccacgtgaggacgagcatcttgaaaataagccaataccaagcactgaagcagccattatgcaacagcagcttgcatttgttgagtgctcatcctgggccactcattttttctaagtgcctggtttgtatcatcaatctcagttaacacttgcaataaccccatgaggttagctgcttttattatttttcttttcagatgaaatacctgagtcgcagagtggttaagtgccatgccagggtcatacagactgtaggccttgcttctgggctttgagttcagcattgtagccccagagcccccgctgaatccaacgactgcttcctaaggacttgcaacaatgccgtgtttctgagaatatgagtatcctatttcccaagttggttccccaccccaccatgcagtgtccacccaacagcttggctgagcctgccatctctccttcctcctcctaagacgccttgccctctgcataggagcagctgatcctctggaaggcccaggtgtgcatggctggagctgacctgcccctgtcaagtttgtagcagaggaaacgatcccagtttcccatctgacatggcccttcagcaccctagttcctgtgttccaggcatacctgtaatgtttccacagattctaaagccatccaggccaaaaggcttatttgcttcttcaatcctccagtgtttttcatagtaccaggcctactatgggagctcagtaaacacatgtttaaagacacacctctcttatttcacccagagcccctgaaaatgaattcccacgtggtggcgggtgcctatagtcccagctgctggggaggctgaggcagaacaatcatttgaacctgggaggcggaggttgcagtgagccgagatcacgctactgcactccagcctgggtgacagagtgagactccgtctcaccaaaaaagaaaaaaaaaaaagaaaatgaattcccgttgccagttgctcttcctttccccaggtagaatggcctaatagaaaggagtctttgcagttaccgacctggatttgtgtccccaccccagcccccttatgcactgtgcagtcttcagcatcatcctctccgggactgtttcctctttggtgaagcagggcaataccttgccttgcagtgttcttgttgggctttcaaaagaccattatataagaggcatggccgaaagtaagtgcttaaaataagaagactgctctttcctgtcctctattcttactgagtttagcctttacaacgcaatggctgttacaaaaaataaaaaaatgaaaaagtcttcagatgcttctcttcccacggccgcatagggggctgaaaaggagcactttaaggttctgacagcgcatcctggccctgttgctcccttgctgtgcagtcttggccaagtcacttaacctttctaggcctcagtttcctcacctgtcaactgtgaagatctgggctaaataatctctcaagggtccacgagtccaaggtttccctgatcatagttactcagtgctcctacttaaaatatttggaaatgaatattcttcgcctctatgaggccagagctcctttttcccatctaaacttgtggagctgtaagcaatttaccccagagatgctgatttacccctgggctgccttcccgagaataagatggttgatggtgtcctgtgtgtgagcagtgggctgcagtgaccaggcctgtgcagggccatgggtctgggcaggacctacctgtggcaagtcactgtgctctcagctcgatttattttatttttaaaatgggggtaggaggaagaggagggaaagtttgcattaagcattttaagttgtttttacattacaaaagcaataaaaacatagcaaatttgggaaatagatgttaggaaaaaaaatcatccagcattttatctaattcagtcactattagttattattttggtctttctcttaaccctttttcatttgtgtaatttacctagtagatatgtaacttgtgtcttttttggtttttttcttattttttttaacagtattgtcataaaaatttgcaagttgcttcatgatctttgcaatcactatatcatgatgcatatttcttttgtcattctatgtgtttgttggtttgtttttaactactaaagacaatttttattttattatttatcaatataaagctacattatatctttttgcatatatatgcatatatgtgtgcacaaaggtgtgcatttctaagagaatagattctcgggaatggacttactgcttcaaaggatttgatcatttgcacagcttttggtacatgttgtcagattgctttccaaaggggctgcactgatttactatgccatcagcgattacccattttgctgcatcttaaccagaactggttattatcatttaaattttttggagatttaataggcaaagcagtgcctaattgttttaatttgcatggcattgatgaactgaggaagccaatcatttttccatatttttgttttcctctcccttcctaggatcaagtgatttctgaggcactttcatccccagcttctaacactttaggtctgggagcctctagggaagcagacagatagcacaagattgcaagagtcagacaggagactatatggagatataaatgatgacattaaggggttactggacagaggcagaggagaaaaactaagaattaaccaaagaacacctaagaagtgattctggtcaaacttaaaaggtatctcccctcttctgtttggcagctcccttgatgtgcaatggaaataatgcagttgctctctcttctgtgattagaaagagaaaatgagaattcattcatgagataaaagttaaaataatgttggtattatttacagtgagatcccatttaaggctgattttggtaatcaagactgataccttcatcgaagacagataaggtgtaccaggtgtttcctgtatctaattcatatgtttacggtacgggaattggtctccctagtaaatgaatctctttgagaaccagctgtatcttttatgatgggttcattcaactaactggcttaatcaaaaggtcagtaaaaagctgtaacctttaaaacactggaggcttaccagttgctccagagatacttcatcttccctttcacatacttacttcaatttttcccatgtttcttcaccaaatttctctatcacaagagattgcagacaggtgttgataaatccatactagaatacaaaaccagaagaaaaatatatattatgaggcatgaaatccccagtcatacacatcttcatgtcttttaggaaatgtgcaatggcatcctcttggagaaactaattataccttttccttgtttctcgtgatttaatttaatagctctgctcattcccaacttaggaaaaacctggcaccccaccgcttgggttatttctatatagaaaacatatgaactacatttgaaatcaaattgtaattagagaaagttaaagaaagtatttactgtcaattataatcctctccgaaataaggaactggtttgttagaacaaagaattcaaaaacacaccagtggcatggaggtgtttagacctggcagaaaggaagggcacacacttcatgtcgattccaaaaaggcagtgacaggatgattttttttttctttataaaaatgaatctatacctgggtgtgtgtgtggagaatataacgagtgcaggaaaacagaggaggaaactccaataagaaagacagcaccaggttaacagaaagaactgtcttctgggtttgctcattaatctgtgctctttcttcttcctccatcagagaaaaaaaaaaggaggacccatgaacacttctgcttagtgagggatagtgtgccccaggcaggccacctgccttccgcaactcggggctcctaacacaagcagggtgattgagttatgtttgaaagcactgtgtgagctcagctttcaaaatatttcttcctgaagggaagaattcttttgtcacacaaatatcaggctccagatttattttataagtttggattttcatatatataggaatttcttaaagtgaaagagcccagtgccaacaggaaggcgagtgtctaaactctggtagttattttccagaaatggaaatatttgtcctactgggctatatttccagttccccaccaccaatgtcatccttactccttactccatcttgtcccgcctctacgctccccaatatgtgcccgcaccctagcctggcattcagagcactctctagaactgtcttaatttgtttcattttatcacctactcctgctgccttaggctcatccaaaatgcctaccacccttccccaaacagagatgtcatttcttcaatggatagagtttcctcctttctcacccagtcagcccagggcaaggccaggctctgaggctactgggatactgcctggtctgcagaaccatttcctctccctctgccagacccagccatcattccctgtcaggctcactgctggatgcctctgtgtcctcaacaccacagagatggtgtgttaactatcacatgcacacgctcgggttttgtatctgtcaacacacacatatatatatacacacaggcatgtatgtatgggtgtgcatgtatttgtatatacttatatatattatgtatgtttatatgtggccatgtacacatataaatgcatatgtgtgtatgtatatatatatttttttcctgtcctttgttaaattgcaagctcctcagggtcaggaagtaagtgtcatttatctatattttgactaaagtgccaagacactgtctgctacacaggaggtatttaacaaacacttatcgagcaaggaagtactgaaatgaagcctcaagtctcatgaaaatctttaaataacccgttattcaacatcaatccaatgtaaacaaagatagcaattgttcaacttagcaatctttgcaaaagtatgcccaatcaaataaaacatcatgcccactgcccgagcactagagacaaacttctagtgtgtaacaagggaaactgaggcagtggggaatttgaagtctgctgctagttgataaccacatcacctacttctaggtcatgaccaccccgatagtgtgcctctgtttgatgaatttagggccattgagtcatgtggtccagcatttgtctttggtgttcagcagttccccaagctggtaccagagttaatcatttagagaccttgagcttatagatcagagagtggccccctcaccctctactgattataaacatgtccctttcctgtccactgaaatcaggtgactttctctgcccctggagagagcaaaagaggcaatgtatcccacacgatgtgtcgagcatatgcggggaccttggtgtttgctgcccacacccaggtggagggggatacttggtaggacacactccctacacatttgagggcctcactgaaataagtaagaatggcaagccagcaccaaagttctctaaccatctggaactagtgctgctcaaccagtgagatcagcaagcaggcagggactctcatttgctggtgacacccaaatctttcagaggctacttgggccatggctgcagcacccccaaaaacatctgcgttccaaagaagcaattaaaatgtctgaaaatgttaaggtttagccaaatctttctcctgtaaagatgttttcacattccatatccagtcctactcaccgtgcctgccaggcattggctggggaatgtggcttcaaaataaaatgcagtctcagtaagcccagagagggagtacagcttaggagaaagggtttgggctctggagccagaagggtttctgtttctgtgacttgtagctgtgcagctttgggtaaattgcctaacctctctgagcccagtctgctcatgagctaaagtggacataataccgtttgctgtgttggaggatggttgttggggttatagagtaacggttctgaagttagaccatgagggctcattgctgaccccaagtcttatttgctgtttgactcaagccagatcttactcaccctcagttgtctcatttggaaaatgggggtgagaatggtcccttcctcatagggttttagtaagcattaaatgaggtaatacgtgtgaggtacttggcacatagtaagcgctcaggaaactgtagcctcttagataacaggcattttgaacaataggtgctcaacaaacagaagcggaaggaaagtcagggccaagggtgctgagagctgctcaccatgttcctgccgcagctgctcctggggccacagggattgagatgcagcaccaagcgcccgcccttcctgccagcccctagtcactcaggagagaatccacagcgtctccagaagcctgtcttgtagaaatctgggcagtccacagtgaaattaggagctcatcactagcctccaagcaaggagcacactgttgggtcctcagtcacctgcggggtaaagcataaggccgccccctctggtgagcaagtgggacctgctgcctggcaccccaagtcgtgcacaccccagatgctaagctctcaggagttcagcctgaaacctgaagcttctccccgaggtgccaacggcacagaacgcctttctgcaagcacagaaaagcatacacccctaagctcctgtaggaagactgccttgtagatgaggctgtctattgagtgatctttttagtgtatctttaattaaaccacgttggatgccatccaagaacggcctgccttgaccaacacttggccctacagtgtcataatgggaagtcccctggtgccttgagccttatcctccatccccatcactgttccgtttcaggctctggtgggctgtttgccagaggtctatttcctgagtattacttgtggtcagaggtgagaaatccagccactaaccaggtccaacaaatgtcgcctgtagctgttccaacacacatgctagctttggtgtaaaaacagagaacaaataaatacatttagtaaaatcaaaggctggggtaagccctccaggcagtgtggaggtgtggggcactagagggatgtgactcatggttaagacagtctgtcgaggaccacaacgccacagactggggccgtccactgaaacgaacgtccaggcatcgcacgccctcctggaagacttcagcatctttcccttggcatccgaagtttgctgaaagattcttcccttctcagtaggcactccttcactctccgctgttggcctccctctcctatcctgcctgcccttctttctgtcactctccttagaaagacttcctggtcctccttccactcagcctttctggctcctttgcttttactctccctgcttaactcacgccagctcctccatagaaggacttgacacctggagagactggtttcagccccctcttctttctgaaatggggactttacttattctcaaaagctggactctatgtgctgctcctctgtggaaggaacatgtggtcaggaggagaaaaaaaaaaggctcaggaatagatgatttccataattacgcttcgcaaacccttgcctccattcagctgacactctttctttctgccctgccaagcgggcttgctctggcgctctctcacaaaccccctccccacccccaacccgctttttcaaacacatacaccagcaccctcacatttcacaataagtaaatggtttaaaaaaaaaaaatctccattttctttttcatgcggcagatggcagttctcaggaacttggtggaaattaggctttctgattttctgataaatttcaacatctcacacaaaaagcacaagctcattttgattctgatgttaagtaccatatggcatatcacccgtggaacgtggcagcttcataaccagggtaacaaggaagggagggtctttcctgtaacaacgaggctgagtgggaatgaaccaattggattcctgggtgaataccatttgataataatattgtatatgacagtggagtaattatccctcttttatggtatgtgttaattttcactgccagtttccctaattacaactgccacccaacggactactttttgtaaatactctgtaaacatttgaaaagacatagacagtgcttgtaccaaaaaaaaaaaaaaaaagtccctagattttgaaactgtctggaaaattggctgacgttttatatgtttttcaattgcatagacagccagggaggaaatttcactatatggaaattccccttctctcctccatgacataatggacctccctgccgatactgtgactgttgttttgagggatatttttcgctgttacctttttctatattaagtgcgcagtttcatgatctttgacaaatgtacactattgtgtagctcacaccctaataaagatatggaacatctctgtggtcatggaaatttccccggtaccccttctcaatcagtcctaccaccctcagctgcccctattccgattactatcatattatcgccacagactagttttgcttgctcttgaacttcacgtgaatacagtctgttctctgttgtgcctggcttaacttgttaactcacttttggtgcattgaagagttcaaacaccattccccaaattagtaacatgtatgtaaacacagtctcgcttgatgcgtgtcctgtgataagtgatgagatccaataagccacatctcatctcccgtgatctatgtatgatgtgcgatgagaaacacaaatcttttatttttcatggacttgcagggagggcgggataccattgggaggtcgctggagtaaacctctatcatttaaggaaagaaactagagggagaatgcaaggtaagagtgtctgagaggaagataggaccctgatctggtttttggtggtttgtttgtgcatttctgggaacgcagctgcctcattcctggtaggaagcctttcctgtggttgatttgttgcccccagtctacctcagactgcctggcttctgagccgctgctggctttctttccaaggcctacatcagcagaggaaggtgtccccggacacaagacagggtgtggctgaagctgggctcccagaggcccgtctgttaaaaaatacgcccccaccccccaccccccaggcctgccaggtctctgaaattctcattccttttagctacaacttgggaaacttctgacagaataaaaatatattcctttggctgaacagattagctagtattcacctaagaaggaaaaggacatagaacagttcaactttgatgtgtgtgcttcagagggactgagaggatcaatttccacatcagtccaaggcatagagtgctctctgagaggcaggctctgcagagggaggtctccatcacctagggaccgcagaggcacagaatgaaagagttcagctttactcgtgtggcaggtggtactgggatggccttgagttttctcccttggtaggattaatatctcattgaaagatgtcttgaggctgggataacctggctaaaggtggagctatgataaacagccagatctcttttggcatatttgcgtattagaaactttagtatgcagcaacaactgagtcagctatcagtaagaatcttcaggaaaaaaataaccagaagacagggcggtttgttttcctaaatgttcatagtaagtgcttgtactcttttcatgccagctgtaataataatcactcactttcaccaagcctcacaatatgcctggcacaaagcactttccatgttttagaatgagccacatgaaattgccattttttacaggtcaaagactttagaattgaacgaactgaaccacttgcatttcgttctacttaatattaattcagccttaccacaatcctatagtgtaggtcctattatcataaacacccttgactgatgggagcattgaggtgaagagacatgaagtagcttccttgaggctccaaaactagttagtgtcagagctggtattcacaaccaggcctatgtcctatatcaccttcaagagaagaataaaactagctgctgttaacccctctcttttttctggaagaggtttaggcctgtcttggagtcagacaatatcttcagaaaaaaaatctctttttccaggaatgtcaaaactctggcttatgtgagcccattttatttcatcagccacactggaaagtgaggtttgattcacacatgtggttgagtacaatgttgtgaaaaacacctgaaaatgggctctgaatgtggaattctgaatcctttgatttcagacaagaggtcctttgatttccccttaggatggatgaaaccagcaagaactgaggcatttcctacagggtggtaaccagctagtgaacccagctcacctcctcaattgctaacggccccatactcgttgacaatgatatctgtgtattctaagaactagagggcagggctctttccttttcagtttgattttcaaatcttcagcgatgcattaagaggaccagcgggattgctgagcgtaaagcgccaccgtgtggccaaagccccacatgccaacaggacgctgtgtaagtcattcccgcaggaagggaggcaggaggtgtgtggctctgaagactcacaaatcctgaccaggtgcaggatcatggctcagaggactgggctcaagtctgagtcttcaccctgcaactggtacttgaggtctggagtaatcatgaaaaagtcctctgtctttcccaagtgatagtgcccctcagtgtaaaatgaggctacaaccttctccaggtgcagtggtcccagaactgcaaagagaatatacatctgactttgtacattatgtacagaacccaggcaagaatggaggtgaggtctcgcaacactggcactcgaggtaagggctcctcaagaccaaagtcaacaatcttcaaatctaacctaatctatacttccatttgataaaggaaaagttgcaaataaaccaggtgatctggggactatatataaggaggcatgacaaaaaaggattgttacattgtaaccaactgaatgtaacttgcagatttatgtattttgagagccctaataataataataatatgaactgaatatttattgtgcttactctgccagacaccaggccaagggctttatgtgcattatgctatcaggtgctcatgagggtcccatgagcccaatcttaaccacaagtcggtgcagtgctgtcttcttcaaaacagctttctcaggagactgtacttcctccaattgaaacattttgagaatttctcttttacagctactttcagagtgtgtggcacaatttttgaatatcctaagtgatagcaaatcaacattctttcattatgacaatagttaacagttactatctaccaggcactttaacaggtgtaaattcatttaaccttcaccatgacactatatgttaggaaatgttattatcgtgcccaattcccatttgagaaaaataaggcgtagagggcctaaatcatctgcccacttttacacagccagggcctcaggcctgcagcttggatgagaccgtgtgagacagggtgaggctgggtagttttttctttgcatgagggggtactcgggatccagagtccatccgcactcccacccagtgcaggccagagaccactcagtgaaaggagcacctaagtcatgaatgacacttcagctgcccgtgggcttctgctacaggcaactgtctctcagcagggcttgagttttagaaacagtcagaaggagtgcagagctgggtctcatgagacaggttagtgagctttcagctgtggacagtccgattttgaataaaaattgagactgtttttctcacctggctgtgaagcctgctccaccaaccctgccggtctcccatgccgcttcccctctcgccctctgggctcagtccgcacccttggagcacttcctgctcattggcccactctttctcgaaccttgcttgctcctcctctgcttagcttctgcatgctggggtactccaggcctcaggtgtcagcttcctccctcttacatctccactcagcacctaggtgacctcacctccctgtggcttcaaattccacctctgcgaggatggccccgggattacaccctagaccaagccattcccctgagctctacacaaagatacctaatttcccatttgacatctctacttggaggtctacggaaagctctaagtaaacatacctaaaatagatctcttgatttccctcgccaccaaatacccctgcccatcagcccatccctcattcaactcaataaagggaacctctatcacgatcccatgtctccatatcgaattcacagcaaacctaaatactggaaggttctccttcagagttgatcctaaatccaatcatctttggttacttccctatccccaccctgatcaagctactccctcaggaccctacagagctgctcaacagctgtccccaccccacccccatccccagtcaaaacctcacccaacagccagaatcatcttttaaaaacgtgatcagattgtgttattcccttgctcagaaccctcgagcactcctgggcaccttccttccttctcctcaagatcccttgatgccgtttcacatggagccttcctttgcctgggcagttctcctcctggtctcctcctggtcctttgcctgggcagttctccttctggtctccattaatcccccatttcattccattaaagtgtcaccacctctgagaggcctccactgactgaactccccaccttccgcctctctacactctgtgcctttctccaccagacttcacagcatttcacccccggccctttattctacgtaaatatatatgcatgtcatagatgactacttattgcctatacacctctgcccccaaatttaaaatctctgaaggaagggatctggtcctattctgccttcagggcctagaagagtgcttggcaaatacgggtgctcagtaatgcactacagatcagtcagggccatcttggagctgcctcgcatgagccataatccctctagcacagatgccttgcatggtattccctcggcctgagtctctctccatggcccatggctcttgacttttttttttttttttgtactttaagttctagggtacatgtgcacaatgtgtaggtttgttacataggtatacatgtgtcatggtggtttgccgcacccatcagctcatcatttacgttaggaatttctcataacgctatccctccccaagcttcccaccccgcaatgggccctggtgtgtgatgttcccctccctgtgtccatgtgttctcattgttcaactcccacttatgagtgagaacatgcagtgtttggttttctgtccttgtgatattttgctaagaatgatggtttccagcttcatctttgtccctgcaaaggacatgaactcatcattttttatgactgcatggtattccatggtgtatatgtgccatattttctttatccagtctattattgatggacatttgggttggttacaagtctttgctgttgtgaatagtgccacaacaaacatatgtgtgcatgtgtctctatagtagcatgatttaaaatcctttgggtatatacccagtaatgggattgctggatctaatggtatttctagttctagatccttcaggaatcgccacactgtcttccacaatgggtgaactaatttacactcccaccaacagtgtaagagcattcctatttctccacatcctctccagcatctgttgtttgtgactttttagtgataaccattctaactggcgtgagatggtatctcattatggttttgatttgcatttctctaatgaccagtgatgatgagcattttttcatatgtctgttggctccataaatgtcttcttttgagaagcatctgttaatatcctttgcccgctttttaatggggttgttttttcttgtaaatttaagttctttgtagattctggatattagccagttgtcagatggatagattgcaaaaattttctcccaatctgtaggttgcctgttcactctgatgatagtttcttttgctgtgcagaagctctttagtttaattagatcccatttgtcaattttggctttcattgccattgcttttggtgttttagtcatgaagtccttgcccatgcctatgtcctgaatggtattgcctaagttttcttctagggtttttatggttttaggtcttacatttaagtctttaatccatcttgagttaattttgtattatgtgtaaggaagggatccagtttcagctttctacatatggctagccagttttcccagcaccatttattaaatagggaatcctttccccatcgcttgtttttgtcaggcttgtcaaagatcaggtggctgtagatgtgtggtgttatctctgaggcccctgttctattccatttgtctatatctctgttttgtaccagtaccatgctgttttggttactgtagacttgtagtatagtttgaagtcaggtagcgtgatgcctccagctttgttctttttgcttaggattgtcttggctatgcgggctcttttttggttccatatgaaatttaatgtagtttcttccaattatgtgaagaaagtcagtggtagcttgacggggatagcattgaatctataaattaccttgggcagtatggccattttcacgatattgattcttcccatccatgagtatagaattttcttccatttgtttgtgtcctcttttattttggtgagcagtggtttgtagttctccttgaagaggtccttcacatcccttgtaagttggattcctaggtattttattctctttatagtaactgtgaatgggagttcactcatgatttggctctctgtctgttgttgtataggaatgcttgtgatttttgcacactgattttgtatccggagactttgctgaagttgcttatccacttaaggagactttgggctgagacaatggggttttctaaatatacagtaatgtcatctgcaaacagagacaatttgactgaatgtagacagtcagagacaatttaactgaataccctttatttctttctcttgcctgattgccctggccagaacttccaatactatgttgaataggagtggtgagagagggcatccttgtttgtgccagttttcaaagggaatgcttccagtttttgcccattcagtatactattggctatgggtttgccataaatagctcttattattttgaaatacgttccatcaatacctagttcattgagagtttttagcatgaaaggctgttgacttttgttcaaggccttttctgcatctattgagataattatgtggtttttgtcgttggttctgtttatatgctggattacgtttattgatttgcgtatgttgaaccagccttgcgtcccagggatgaagccaacttgatcgtggtggataagctttttgatgtgctgctggattcagtttgccagtattttattgaggattttcacatcgatgttcatcagggttattgacctaaaattctcttttttgttgttgtgtctctgccaggctttggtatcaggatgatgctggcctcataaaatgagttagggaggatttcctctttttctattggttggaatagtttcagagggaatgacaccagctcctctttgtacctctggtagaattcggctgtgaatccgtctggtcctggactttttttggttggtaggctattaattattgtctcaatttcagaacctgttattggtctactcagagatttaacttcttcctggtttattcttgggagggtgttgtgtgtccaggaatttatccatttcttctaaattttctagtttatttgcgtagaggtgtttatagtattctctgacagtagtttgtatttctgtgggatctgtggtgatatcccctttatcattttttatgccacttatttgattcttctctcttttcttctttattagtcttgctagcagtctatctattttgttgatcatttcaaaaaaccagctcctggattcattgattttttgaagggctttttgtgtctctatctccttcagttctgctctgatcttagttatttcttttctgtgctagcttttgaatttgtttgctcttgcttctctagttcttttaattgtgatgttagggtgtcaattttagatctttcctgctttctcttgtgggcatctagtgctataaattcctctctacaaactgctttaaatgtgt

SEQ ID NO: 515 - DNA, 48696 bp, Homo sapiens
ctaaatgctggtaccctgcagggatggtcatggaggtagatgagttctttgtgattttttgatttgtgcagaaaggaaaaactcccttcagaatgccattaggaattcaggtccatccctttgctctgagctgaatttgatggtgatcacaactcaatgtatttggaatttctcttagcctggctcaaaagtcacaaagtcaaatgccttctgatgccaggcaggtaaagtgagtgagtctcatgggctgggataagacaacagggcatggtggagaccagcaaactggaacgctcagtctacctcaaggtggggcggtaactagcccattccagtttactgctgctgtggggaaatgtagccagatggcttgaattttcaaggaacgctgaaatctggcttttggggttttgttgttgttgtttgttttttttgtttgagatggagtctcactctgtcgcccaggctggagtacaatggtgtgatctcggctcactgcaacctccgccttctgggttcaagcgattctcctgcctcagccttccaagtagctgagattacaggcacacaccaccacacccggctaaattttttgtatttttagtagagagacagggtttcaccatgttggtcaggctagtctcgaattcttgacctcaaatgatccgcctgcctcagcctgccaaaatgctgggattacaggcatgagccaccatgcccagccttgaaatctggcttttatgccctgcttcctaactttttaaaattggcagctaattaaagctcctcaaaacaaaacaaaaggccgtgtgggtgaaatcgaacatatatgtggggcagatttggcctctggcctatgtggtcatctccacagcctctaccactttggccgcctctgaatcaaagaagggggaagagaatgtaaatctcggtgaagaaatggtccagaaaagtaagaaaacattttcctttttaggttcattaaaggattcatcagtcgcaacaaacccctctgtcctgacaacgaggaatttatcgtgtttgtgcggaagaattacatcttgaatctccggtatcaccttccaaagactgtcctggacaagagctggctgaggcctcctggcatcttggaaaatgtaaggactaatctgggatttccagtgttgtaagtagcacgggcactgacgaagcttaactcttgcatgtctttgtgctgcctccctttggcttgaaagggctgccctggcaaagcccttcttcccaaggatgctgcacaagaaattgaactcctcagaatttgcgatgtccttagtagcattataaagccactggagtgtccttagtagcattataaagccactggaggttgtttaaacagagcactttttttttttttttgagatggagtcttgctctgtcacccaggctagagtgcagtggcgcgatcttggctcactgcaacctccgcctcctaggctcaagtgattctggtgtgtcagcccccctgaataactgagattacaggcgcccgccaccatgcctggctaatttttgtatttttagtagagacggagttttgccatgttggccaggttagtctcgaactcctgacctcaaatgatctgtccgcctcagcctcccaaagtgctgggattacaggtgcgagtcaccgtgcccagccgacagagtactttcgaatcatttctattcctgacgtagccttcctagaatagcatccctcaagagatgatctgaggaccctctgtgtctggaacttagaggcggggctgttgtaagagtcccgggctccactttggacccactgagtcagaatctccaggaatctcattatagccagttctgcaggtgagtcataaacatattcaagtttgagaatcattcgttaagcaacagcaaaaagttgggagaggatcaggttagctgctgtgactataaaatataaaatattaacactgtgcttgaaatcaaactgaattcagcagtgtttttttaaagcttcattttgatcgccacagccccagacagggagtgagtgaggcaagtggaaagaagtgtgttctccacacaggcatcagatctgctcaggaaaatgtgcgtgaggaacctggtgcagaagtactgccgcgggatcacagctgagcggaaagcaatggtagggacatgatgtctgcggtggccggtggtgggggtgggtgtaagagtgggtcctgagtgtcagtcctcctcatccaccatttcacctataagcgggggtcatgctagtcccatgctttgaaatgttcaagataattgcaggtagacctgcagagagccctggatgaatgccagctgttactgtaatcagcatggctccgtttgttaccatgggaacacaatcacaacggctcctgccatccatccaccggagcagagaatgtagacccctttctgctggaaatctgtttttcaccgtgctaacctgcgggtcttttgtgtaaagggctagaagagtaactatttcagggtttgtggcctttctctgttggaattactcaactctgctgctacagtgagaaagcagccatggacaatgtgtgcatgaatggcatggctctgtcccaatagaatgttacttacaaaaagggacagcaggctgagtttggcctgcaggctgtggtttcccaatccctgatctacaagaaactgctcttggaactctggaaaatccactttcaggaaggtagtaagggaacgagcagaaacgtcaacccagtctctaccaatatgactttcagggcattttggccaaagccaggaaggtgttctgacttgtatgctccagggtaacaaggctcccacagtttatccagcaaaggatgtgacctcaatgggtctagagctcttctatcccaaagaagcctgtggctaccatttttatactttcaattgtgtattaccagatgcagcaaaaggtagttacaagtgaaatcttcaggggaaggaaagacggctacacagaaagtttaaatcaaccctttgtcaacagtcggataggtaagtacattttccagcctatgtacttggctttccaattctaaaaggagttaaagggtggggtgcggtggctcatgcccataatctcagcactttgggaggccgaggtgggcggattgcctgagctcaggagttcgagaccagcctggccaacatggcgaaaccccatctcaactaaaatacaaaatattagcagggcgtggtggtgtccacctgtagtcccaactactcgggaggcagaggcaggagaatggcttgaacccaggaggcggaggacgcagtgagccgagatcatgccactgcactccagcctgggagacagagcgagactctgtctccaaaaaaataagtcaaaggcagatgctcaactctgcagcatttcctgatggctatttccccacctgagatcttagcacagagatgcataacaaaactagcagataccaatgacttttccacaggattggtactttagtgatgattcatggccttctggttccctctctagatgaaggagacattaatccgaaagtgcttcagctaattagccatgagaaaatccaggtaaggcgatgtgtgtcctcagtctcaaacaggattccctcatcgagtctaagagcagggtcccctttctccataaagggcgcactatttaaatgcaggggtgcagctgggcagctggggctctcaactgtgatgctttgggtattaactaagatgatggggaacaaatgatgattagataatggctgctgttctcatgacacctccgtcaccctagaaactgtcttggtttgctttcctacaaaattgaatgaagtgtagccatgaacttaatcacgaaacacccccttattggtgagaggcagtgtggcatagtgcctgggcactgacacttgctttgaacgtagcagccgtgagatcctgggcaggtcacttaagctcttggtgcctctgatcttctgtgaatgaggatgatgggtttactgagaggatgaatgagtcggtgggcgagaggtgctcaggctgctgcctggcacgcagcagcaggtgaagccctggtgatcgtgtgtgccagtgtctgctctttttttttttttttttttttttgttccctggggaatagaagccactgtgactggattggattacactgtggctgtgagagttttcatctctgaccatcagagcagacctgcaaggcaggcagccatagccttgacttcctcagagggcaacgcaggtaggcagagctagggatccaaatccccatcatgcagagagccaggaaaaaaaaaaaaatatatatatatatatatatgtgtgtgtgtgtgtgtgtatatatgtgtacgtatgtgtgtatatatgtgtacgtatgtgtgtatatatgtgtacgtatatgtgtgtatatgtgtacgtatatatgtgtgtatatgtgtacgtatgtgtgtgtatatgtgtacgtatgtgtgtatatgtgtacgtatatgtgtgtatatgtgtacgtatatgtgtgtgtatatgtgtacgtatatgtgtgtgtatatgtgtacgtatatgtgtgtgtatatgtgtacgtatatatgtgtgtatatatgtgtacgtatatatgtgtgtatgtatgtgtacgtatatatgtgtgtatatacacacacacacacacacacacacacacacacacacacatacacgcaaaatctgtttgagcttttctaaatgcttgacatcactttaccggtgtctgagtagcaagaaactcggtactctgccccaccttccctggtgaagtcaccttccccttgcagtatggtgtcccggtcattaaatatgacagaaaaggcttcaaagcacggcagcggcaactcattcttactcagaaagcagcttacgtggtggaacttgccaaaatcaagcagaaaatagagtactcagctctcaaaggtaagaagtgggcaatctttaaaacaatgcactgagttgactcaactactggaaagcccagtaatgaagctcccaaatgggaaacacaagtgtagggtgcccataaaccccggggtagtgatgcacacctgtagtctcagctactcggaaggctgaggcaggaggatcacttgagcctgggaattcgaagctgcagtgagctatgattgtgccacacactccagcctgggtggcaaagtgagactctggctcaaaaaaaaaaacaaaaaacaaaaccatctgccctcctcccctagcgttgcccagcctggactgcacccttattctggcataaatattaatagcaccactttactcaagtacccaggttgggcaatagtctgcttccacggtgatcagagcccactagcaggctaagatttctaaagtatgcccttcatccttctgggcccagctaggagaatgaagtgtggtgttgggcagcccctgggcgtatctcttcttcctctgtactaatgtcaagctctctagttcttggctcctaactctggatctgtcttaaggtgtctccactagcaatctgagtgatggaatcttagtcattcatgtttcaccagaggacagcaagcaaaaggtaattgacagccaccagtctctactaaaagacagaaacaatacactgccaaaatgttaagttgaccaccgtgaaacttctctattggagtgtctgtttctttaagctgtgaatactgaaattatgccttgtctcctccccaccccagggggatgccgttttgcagtgtggacacgtgtttgaagcagttactaaactcgtcatgctggttaagaaggagaacattgtcaatgttgttcaaggaaggtaggtggcttcatcttcagctcaggaagtaattcaatgttaaaatgtttattaaggccgagcgtggtggctcatgcctataatcccagcactttgggaggctgaggtgagcagataacttgaggctaggagttcaagaccagcctggccaaaatggtgaaaccccgtttctactaagaatacaaagattagccgggtttggtggtgcacacttgtaatcccagatacttgggaggcctgaggcacgagaatcccttgaacccaggaagcggaggttgcaatgagccaagatcacaccactgcactccagcctgggcaacagagatagacaatgtctcaaaaaaaaaaaaaaattacagatcggggaagatgcaaatattgttttcactcctgcttgcctcctgcttccaacgtaatcaagcaccatctctaccagtaaggggtgagaagcctctagtgttacatcctcgccccttcccataagtaacttttttccgtcttcatccctgggatcttggccttcagagaaatgaagtcagtgaaggcaggatatcctggagagctgtttcttttccctcatcctgtgctgttccaagttttaacaaccagagcacatttgtaggtggaataaggagagagagttgagtgctttgaaatgtgttgtctttgtgttgctgtacctgagggaatactcagcccctcagagtttcagtgtgatatggaagtagttccatagacatcaactgaccctttgaagaactgaatgtgctcatttgatctcatggtaactacagaaacatgtaagttgcccagctgtggcaacagcattcttcctttcctcaaatatgcaataaaacactgtaataaaacaggaatttgatcttgaaactagtagaatttaataagtgaatttcttctgtagaccaaaggttgagagaagaaaatacagtatgtcagtaatgtgtcactttgtgtattttaagtttacagttttttattagtccgggaaaagaaggcacaatagttttcgacactggactggaagaacaagtctataaaaataaaaatggacaattaacagtggtgagtggccgtctctgggagggaagtaagccgttttagatgagaatataagttaaagttctaccaatttcagtcctgtagattgactggaatcataagctattaatagttcatttctgccctctattcctaattctacatctgtaagacaggaagaaactgatatagagatacacacatctaaacactgaatgagaaaagaaaaaaagcttaaccatccttgtcagtgaaccagaagctgacatgagacacttcccaaatagcagagtctaacttttcactggataaaggcttcacgcttattacagttatccataactatccataacttccccccacgtggaaatcaatgcgcttgtgtcccacccagatactgagacttaattggttggaggtgcggcttaggcttcaggatgcaagaaaatataaacgtaagaaaaatatgtaagaaagaaatgtgtaaaaaatatgtaagaaaatataaagttgctttttggaatacatgtgtcaaaggctgcccatgttaatacctttggtataaaatggatctaacaagcacagaggtttgggaaccatggctacgttagggagaagtctagcctgagcacacaagtacgctgccttccctgactgtgcccatgctgggctgagggtcccagtggtcctcgctggctgctagtacacggagcttgttttgatccagttttgctgaaaacgacatgttaaaagcagagggagctgaatctttaaaatgtatcttgtattataggaagaattttgatacaaattaattaaaaaatggtctgtgaacatggagtgtctcatacacatttaaatttaagtggatttacctataaagtcattttgcaggcccggcgcggtggctcacgcctataatcccagcactttgggaggccgagatgggcagatcacctgaggtcaggagttcgagaccagtctggccaacatggtgaactccgtctctactaaaaatacaaaaattagttgagcatggtggcacatgcctatagttccagatactcagggaggctgaggcaggagaattgcttgaacacaggaggcggaggttgcagtgagctgagatcgcaccactacactccagcctgggcgatagagtgagactccatctcaaaaaaataaaatcattttgtagatataaaataattgcccctagacacaatgaactcctttggggacaagttaaaataaggatcattttggatgtagactataaggtgtctttttagtttacacactgtcttaaaagtgacaccccagagactgtgtctctctcctctggagtcacacggagtccatcttcctccctgactggttctggctgaagaggctgacaggcctcgatgagccagtttctaagtctggcttgtctcatgggaggtggcactggcttctcacaggccctccacacccaccttgctaatggtgacagttgaggtgataactgtttccttttgcgcaaagggagcggggaagggctgtaaaccgaagtgtgactctctcccaggtgtcagtccggaggaagtcctgatagaggatgacgtctgacctctaccatcgccatttttgctccaactgaggaaactacaggggaagtggggattggatccagttagctacctcttcaaggtaccaggcccgcagcactaacagatcacatctgaagaaactgaggggcgttaggccaaagcctaatcccagctcctcagctgccccatggcaccttatttaaaatgtcaccttctggaagcagaccccaggtcacccgaaggcgcaattctaaacaccctcgacaggatctatgttcagtgcgcagtccaacgtgtcattagagggtgggcaagattctctacctctgtcaagctgccctgagacatgatgaaatactgtgtacagcaagttctcaaataacatttcgttatatgttgataagacatctgattcctgggcagggccactgtctgggtggagtctgtatgttctccccatgtctctgggtttcttctgggtgctctggtttcctcccacgtccccaaggtgtgtgtgtcaggtgcactggcgtgtctatgcggtcccagtctgagtgagtgtgggtgcgtgagccccgtgagaggaggacatcctgtccagggtgggtcccgccttctgccctgagctgctgggattgggctctggccatctgcaaccctgaacgtgcaggttggagaacgaatgaatacaaattttattgtaaaataaaaatgtatataaagcatatgagcacacaaatggacaataaatgccacagcgcaaaagcgtgtagcgagcctgccacgcttgtgactggggaggggctccgtataatctcacctttgcaagcgtttatttactgatgtatgcggccaccactgtgaccaccatcacttaccgattcaccaaaacttaggtaatatggtcttatttttgatttaattaaatatacgtgtagctcatgtatttcacagtttaatatgagaagtgctttggtctttatttagaaattgggtgatgtttttgtgcccagcaacatgctgtaggaatttaactcttgtttacatccattagcctcatggttttgcttcaagtctcagcttccaagaacctatcgatgacttactgtgcatggtctgagactaagtaaaggaaatttcctaaagctgtgaaatttgaattttgctttaaataaatggaactcacatgtgtcaagggattgggtttggtgaactgaagccctctgccccataatagcaaatcagtggtaacaccagctgattcactttttcatgagccaggcagcctttgaccccaagacttccttttggtgtttgaattcaaacaaacactacagaaacatgactgtcttttcccttccacctggagcgactttaaggggctgaggcagaacgtgggggccctgcctttgttgtaaaccgattttaggggcctggttatgccgggcatgcctgaaaagagccagaaaacagaagcattttatgacttttattttacatgtcgccaacgtttgtacaacatacagtggctacatctaaaactttgagcatttttttatggcgcaaagagacagaaaggttaatgacacacttaactgttacagtgactttgggtagggccctaaagacagcacacgctccagagggcgggctgagtgttgttcacacttgggtcctgaatcgctgttgtaaggtacagagacacactttaactggggaatggggtccccacacagtgatcgccccacgggagggtgacagaatatgccaggaattgtcttggacatgggccccagtcaccacaatcagatggcttatttgaaacaaacaaacaaaaaaaacccttgattacgacacaccaaagctgttccaatttgtaaaaaactgtagttattacattgcaatgaaatctctttaccaaatcttgggccagtgttttacctggatagtgcttacattataaatattggtttttgcccttagtgctaacataagaaaaatcagttccttgtatactcaataacagagcttggaccagccaatgctgtctattcactcatggctataatgcagccgacagaattgttcaccatggaatgttttataaacctgttcatattccagagagacaaagactcaaaactacaagtgcaaagttgggtagagagagctgccagaaacactagctcattaggcatagaggccacagcaaatcaaattgttccacaaactcattcttcacacaaacatttaaaacactatgcagccaggtgtggtgactcacacctgtaatcccagcactttgggaggccaaggtggtcggatcacagggtcaggagttcaagaccagcctggccaacatggtgaaaccccatctctactaaaaatacaaaattagctgggcatgggctgatgggtacctgcaatcccagctactcgggaggctgaggcagcagaatcgcttgaacccaggaggcacaagttgtggtaagtggagatggtgccactacactccagcctggccaatagagcaagactccgcctcaaaaaaaaatttatacaatggcttttccattttcctggccaacattcacttcgactttctaaaaaagctcaacccaaaagaaagacagggttggtgtttaacacttaaacagtataaaatatttacgaaacattttgtaagccctctttccttagcacttaataaaatccaaatggcctaatataaaagtttctcacacgacagtttaaaaagcatctgcccaatacacgattttgacattcagtcatgattgttttaaagttttattgtagactttgctgttggatacaaaatgaaggcatacaactgtcacaggcagggcagtaagtacaaagtctaagctgtaaaaaccgtttgaaaatataaactcgtttttggaatacatgtgtcaaaggctgcccatgttaatacctttggtataaaacggtaacgattcccttgacaaacccatccatcacctgacgcacattcacatctcctggtaactactctacctagtctagtctcaaccacccctgtcagtcacgactcactcctgttcctttgcaggtgcagaggagcctgggaggtaggtcactgagaacacccgtcctacataggcgctgcgcccagccgggctccagcaggggccgccacctgtgccccacaagcacacgtccccacccacagtcacacatatcccttaaacaaacatgaacacagacacaaaccagacccaaagttatctatctacccgcacatcctcaacctgttcactgctggccactctacactgtgtaaaaatcagaggcaaagacaagggggtctgtgtttatagcagggaagctccctggggctggtggtgtgagggtgtccctgcctggatgccaggctgggaggacaaagggtatgggccacactgaatttctaagcaaaatgacttagaaagttagcccagcttcatggggaaggaggctgaagaggagcgggatcccagggaggggtagtttatgagctatgcctgtcacagggtcagatggccttcctggagtggagtcgggtcaatcaggagaacaactggacggggctggagttggggaaagaaccagaaacagagctggacacttactgccatggaaagttctgctcctacgcagacatatggggtcccagtgagcaccaggccaaagaccagcccaaggtggcaaaaggcttgatccctaaacaaagccttgcacccaaagttgcactggtctcaacgatttagacgctcattcagccatatttccactgccacaagctgcaattatcaacaagctctaggcccaaagccacatggcagaaagcacgtctagcaaagcagtggggattgtgcccgggccaaacacacaggaaccaggagtggacctgctggggctggaggattatgaaataggaagcagggagctcagatacctctggtggcctccaactgcaggacaactctcagaattgtcaaactgaacccttaagggagtgtcacccaaaaagcccacataggaagtcgacacccacaaaaataaatattgcaaacaaaagttctcacatacacttcacactcattcatacttttcctctgagaaccgagaaagcctggctccaaagagtctcagattctcatgaaaagtagagatcttagacacagcttgttcaacgacaggggtcatacgcctgggtcaagacaatcaatttgccttgtcaagcaataccaaaataatcatctggcttgttacaaaagtatctccaggctccaagggaagcagaaggggcccggcagcctgcacaggatctgggtgtagcacggcagggagtgggggcggtgagaggagggcggctcggtctcttgcctgctcactggtggaggtgggcccggtcatcagggcgcttgatgtggatcctccgcacgcgctcgatccgctcccgctcctcgtcctcgtccaggtggtgggagcgccccgccgccccgcctgtggcctccaggagcgcattgtcaggtccccggccatcctgggcctcatacagcaaaatgttcagggtctcctcataaatccgggcttcgggaaactccacctgtgttcccacagtatacagggcaggtaagttatggcccaccccctctgccaacacctggactttaagcagggccgccaggctaaatcaggcccctgggattctgctgaaggccaccagtattatttttaaataaactgatattttcaatggcaacacttacatgtggtgctaaatgcacagaaaatcaaggggatgcagagaaacaggtctccctgcccctagtttcccttcttaaaggtacagtttctcatcattttaccctctcaaagattctgtgcatgtaaatatgtgtaatacacatatttattcacacacttcaaaaaacacacaaggtggcccaccacacagagttgtacatgtcttcctcttgtgcctaacttaacctagagatcattctgtatcaaggaattataaatacgacaatgcaattaaccatacttggatggccatttaggtcagtgctaatatgcttctcctaacagagctgcaaccttgcacagaagtccttccacaccttaaagcagtctctaaagcagttttttgtacagggtccagctggggactcccacgaaatgggcatgagcccttctgctgtttggcaaatcattgtgtttgctcattgcccttcagggttaaggtgtgatgaacaggaagagggccacataagcaggtcccacacatttgatcagactagactccactttcagggtggaattcggaggttctgggaaaaatggagcaggcacactctaccccgtcttcctcactgacactacaaagccagaatgggatgcacacagcagctaactgtggactcagaagtaaatcatggcaggcagatgggggaaacaacagaatttggagtaatgcccaacagtgagtttactgtttgctgctgccagcactgatgcagcctgaaaccctgaaatggcaccaggacagaagacctccagaaggtctctagtggccagggaggccaacagagtctaacaggcagagaggctgggaggaaatcctggttttctttcctttttttttaaaagatatgggatctggctaattaagctttaaaattttaagacttctcatttttagagcttaataaggagcaaggggatttagagaccacatggtctgatcccaactgtttcttgattcacagaccaggttcaggagtggcgtgttcttgtgtttgtgaagctggttaggggcagagccaggacgggagtccaagggcctctttcttttctcttttttgttttgagagggagtgttgctctgtcacccaggctggagtgcagtggcacaatcatagctcactgcagccttgaacgcctaggctcaaatgattctcccacctcagcctccccaagtagttgagactataggcatgcatcaccatgcccaactaactttttgtagagatgagtgtgttgctatgttgcccaggctggtcttgaactactgggcttaaatgattctcccacctcagcctcccaagtagtttagactacaggcacacaccaccatgcccagctattttttaaaaaatttttggtagagacaggggtgttgctatgttgcccaggctggtcttaaactcctggactcaagcaatccttctgctttggcctcccaaagtgcgggattacaggtgtgagccaccatgctcagtccttttctttattttcttgcacccagacctgagcattcctgtggcagcaaccagagactgcaggagtcaaaactctgagggaaggaaccttcttttctgatgagaagagctgtggtctcagcaggattgggagaatctggttgctttttctatcttcatgctcctgggcccaaaatacaggcatggttacagaaagtgggtggcaaagggggaataaccaaacccccagctttctggctggccgatcagagaaggggactccagggaagcttagagaactgcggagaagaggagcttgagaaagcagcctgtgaagttgtatatgaactcctagacccacacccagctgcaagatctacccctaaactgcatacgcagactgaaagaactgaatgctgcaagagatactgcccaggacagacgggccacagcatggcacacagctaggacagatttgaaggctttgaaaatcaaactgtcaccgcaactacaaactacagaaggctggttagagcttgcagcctgagcccaactgggtcaattgcctgctaaaacaaaaacatcaatgttctccctaggatttaaacaaggcctggagtcctttaacaatattcaaaatgtttaggatacaatcaaaatttctcaatacacaagaaccaagaaattctcaactcctgtgggaaataactcacagatgctagcgccaaggtgacacaaggttttggaattacctgacaaagacctggcagcagctattattaacctgttccagtaagtaagggccaatgctcttagagcaaatggaaacatagggagtctcagcaaggagacagaaaaaccaaatgagcacttgagaactgacaaatacaataaccaacaacctcaaacaaaaacacaacttaccagcagggctcaataacagagtggagatgagacaggagaggagagtgatatgggctgggtgcagtggctcatgcctgtaatcccaacactttgggaggccaaggtagaaggaccacttgaggccaggaggtcgagaccagcctgggcaacatagtgaaagccagtccctacaaaaataaataaaatgagccaggtgtagtagcatgcacctgtggacccagctactcaggaggctgaggcaggaggatcacttgagcccaggagttcaaggctgcattgagctatgattgtgtcactgtactcaagcctgggtgacagagcaacactctctctcaaaacaaagagaaaagaaagaggcccttggcttcccatcctggctctgccactaactagctttacaaacacaagaacatgccactcctgaacctgtctgctaatctagaaacagttgggatcagaccatgtggtctctaaatccccttgttccttattaagctctaaaaatgagaagtcttaatcttttaaagcttaatcaatatggtgactctcctcttactacccaagggcagaggcagcccaggtatatttttaaaaaatcaaaccatgacagaatgggggtctaattacaggaagaattcacagccctgaaaaaaaaaaaacagttcacaggagaaaaggggcatgatgtcttgccaatgtggagagagaggcagatgattctggttcaccccctgcccccgggatctttgaaagcaaaaagaacctcagtgtttagcacttcttggctaccttaagaacaatatctattcttttaggatagattttgaatgcttaggaataaaatatgttgtcaaattcatcctgtgagtgctggggaggaggagtagatacagactgagtgagagtgcccaagctgatggcccttgacgtggcgtgatggcacaggggaaatcaccacactataattctgtgtatggcttcaattttcaataataagttaaaaaaaaaaaagactctggtttctactttgtgatgtgatgatttcttctcatttgctttttgttcgaggtcagctacagaatcatgcagaactgtggccccaaaagctgcagggacaatagtaacctgggtaagtgacctacaggctcaggctcttaagactcctgtgcaagggtgacaagaggcatgaccgtcggcccacagcagacctgctgcatgtcactggatagccagaattcccttagacacgttaaagaaatgacagagtgtataatgtgaattaaaagtttaaaaagacagaaaacccaattgcagagccccaaaagggcaggcaaattcaattaagggggggccagatctctagcagcactatgcagagcaatccagctttgtggaacggcatggtgggagaagtcaaaggataggtcaagcctactggtttggagaggatgatataaaaacacatccccagagtccagcccagtcagggagtcaagcatgcttggaaggaagccagcaaggtagggagctaaaggaatgccagatgaaccctacatttggctccttgcagggcctaaaagataaatattttaaggatgagcaatcacaaggcaagcaaagcattttaaaagcatttccctctgtattgggctcaagtgaaaggaagttctataggtgtgtgtttcagaacagccactccaaactgtcctctcgaggctcttaccttggtctgtttcttctcagtggcatagacgatggaggtacaacagacttcagcaatcttccggccctgaccataaaaggaccagcagcagatttcatccccaataacatcctttatgaacaggacccttccgttaaagcgcagagacagcttatcaaacagttcaatgtttttcaacatattgtcgtcagaattgctgcaaaagagcatttgatacggtgaccacaagctggtaaaaactgccatcatttgctgggcccttctacacgcagggccctactgagcccactttctccactacctcatttcaacctcacaataatcccatgacaaaggcactccaatctccatcactcaagaaggaaagtgaggatcagagaaattaggtaattgctcaaggctgaacctaataaatggcagacacgccccccaaaagacagccctggcccctaagcctgagtgctcctaaccattgtgcttgagtgacagcctctgggcacaggcaccaggtggaggagagcacctcaccgagccccaagaggagcagaatggcactgcccaagggagactctatatcctaggtctttttaaagatcttgagtaacctgattaaatcctccctgcatccctcaagttcctgagttagagccacatgttttcaagggccaaatggcattctagaaacctgcatatattgctggtgggaatgtaaaatggtgcagccactttagaaaacagtttggcaggtcctcgaatgattaaacatagaattaccacatgacccagcaattctgttcccagagaaatgaaaacgtaagtccacatagagactttgcatgaatgttcataacagcattacacacaatagccaaaaagtgcaaacaacccaaatgtccatcaactgatgaatgggtaaagaaaatgtggtctacactgtggaatattattctgccataaaaaggaatgaagtattgattcatgctacaacatggataaaccttgaaaacctcttaggtaatctcattatgctgaatgaaggaatctggtcacaaaaggccatatattatgcaattccattcacataaaaatgtccagaacaggcaaattcatcaagacagaaaacagattagtggttacctagggctgtggggttggggaagcaatggttgagggaaaatggggagtgactgctaacgaatagagggtttcttttcaggcagtgaaaaagttctaaaattagatagtcgttatggcctcacaacttgtgaatatataaaaaccacatattgtgaatataataataactgtacactctagaaagatgacttttatgatatgtgtgaattatagctcagagttatacccctgtatccatctgtctacttatctatccaggcagagaggtacagaggggtcatcctcatctgaaggtacgaagaagagctgggcctggctggtgtgagtggaggttttcctagtaaatggagctgtctttcccggctgacgccttacctggtatatgagtatttgttgttacttctgttgtagagcaacttcacggctggctgtgggttgttttaaaagaagaagaagagagttacttggcaggcagatgcaatgaactactagcttcccatagggctggggccctgccctgcatcagaagaggcagacaagcatagcttgctggctggagagggggaccacatgacccaatagcaggggcacaaaagatgacctgtagcttcccactgtgaacccattatcaggcctcactcaggcaattatacatgtttttatttcaaaagttattcagaagaacctccatcatttctggtagcaaaagaaattccacaagggtgcctccaacataccttatttgaagtcgctataagtttttgttcttccttggatgaggtgatcacagggaccttgcagaaaggctcataagtatctttgttctgctggaacaaaacatgctttcagcctaggaggcctgcctagcactgcatttttaaagttgaccggctggacaggctctggcgaggggagatggggcagtcatggctgggaagagagaaggattctcaccaccagtgaactagatgggggaagacagggagttgaatttcccagtaagtctgctctttggctatgaccatgataggccaggatgctgagtaagtactaacaatgatgacacattttccacagcccaggaagccactcaaaaataaacccttgacgtggcagcagaaacgtgttttaatcaaaagctcctaaaaccccactaccatgactgcagaggaattaaaaaaaaaagcataaacccataaggggaaaaagaatgggagaagtgaggtcagcagaccagtaaaaaaagtcaaaaatttgagggtagaaaggtcacaggtgagcgttaaccaaggagagggggaaagctgaaaccagtgggcggaagcactggaaagatccccaaatccatctccgtccccatgcaggcagaagaaagggccatcttcctgcagtggtttgcacggtagaggacagggctgagctgcgattctgaaaacggggggacaagtgaacatcacactaagtgatgagcaaccccagctccttccccttccagatccccaaaggcagccggccaggcctagacccgtcaggcaggaggagagtagaggattcctcttcaggaacaccacctgcttcccccaaaatggcttacagattctgacagttgggggtcccgctgaaaaagtctgccttatcacccacaatgcagcccagtggacaacaaggaccttccatgcacaaacagctttcagagtctctcattccttcaacagacagccaagcatcatcagattacatgtgaaaagcctctttaacatgagaacaaaaccaaaacaaagacaggaaaagaggaggagtcagataatgaagggagaagaaagaaaacaaacagaatcatcagacagttgagagcagatacggcctcctaggaaacaagatgagcacgctgtggaaagcagggcattcggacagcaagaaaaggctcctgaagttagaaagacgaagcagaaatgaaaattttgatagaagggttgaaaaggtgaaaaataaaacttctgagaaagtagaacaaaaggataaagccagagacactaagaggaaagaattaggaggtcagtcctggaggtctaaccttagactaacagaaacgagacccaggggcatgtctccaagacaaagatgaaacagaacctctgatgtgtctgaacacaccactatgagaccgctgagaacgtggggctgaagtaggaacatatatttagaaaaccaagtgaacaaaacaatgaggcaatccctaactctggcaaacttaaagttatagaagaaagaaaataatcactgtacactctgtggcttaactgtcagccgtatttacacgtcatgacgtaaactctgaatttaaccaaaactgtgatgaactgtactgggagaatgggagaaggaaaagtatgcctaagcttggtgggggtagaggtaggggcagtgcgtgagctaaattctagtttctatagtcatgccagtagataatgtcaaaaactgggaattcaataaagagcagcacaggcgaattatgtggaaacataaatgtgaacagaaaaaactgctgaaagaattcacagaggttactgcaagggtgaaggagagtaggaggggtatggtggtgttttgatgttaaccttgcagcactatttgacttcttgaaggatgcatgtgcatcactttcaacagtgtagtaataataaaaaagtaaatgctgcaacattcagttaggtctgcagtgagttcagactctcagagtagaggtggtgtgcagcattatgggtactggtccggtgcggggccagacacagacatgtggtgtgggggaggcccaaacaagggcctcatgcacacagaccagattcctacgaaaacccaaagggatgcttctgatgctctgccacgttgcaactttgtttgaaataaaggggtgttggccatgtctagaagcattttgtttttgtgggattttactgtcaccagacctgactccagtggtcctgctctgtctagctaaggagtgaggggtgtctgtctgtagagattatgctgagctcccaacaatgacttgtgggactagagtaagccctaagattggtcccgaacaccgaccaagtttcacaccgcggggttctctgctgaagggttgagatgtacacatgagaagatccaacagcatggggctgcaaggagtgacacagtagttaggtggcctgctgttccagggaggcctctcaggggtcactccaaccgaaggaatcgggctccagggcaaactcattaactctcacaacatctcagtcagacagaaactgcccccattttgcagagagggaaaatgaggaaggcaggtaggcttggtgcctctccacccatatgggaagaaagggtgatgcctacttgtagggccgcctggcactcttccaccaggccttggactaggtagtacttggcttctgctagcagctcctcgatctcccggcggctctcgggtaaaggcaccgccccgtctcgaaggtagttgagtatcgtaccaaagtgcttcccacagcggtcaatgaggatccagcctgcagagggaggaggcaggggctggttacatgggccctcctcttgtgggaggccctgagcagagctggggtgtctctcggctccctctacctcccagcggagagcgggactgcctggagaatggcagcctcacctgcctacctgcccactaagggctgaggaagcccccacagcctccaggccctactggctggacacaaccataaccccaggtgaccctggtctgaggctctgttagacatcccgactcttgaggcccaaaagtacacttctgaagtaccctcaaatatcccttacacaaggacatccaacaggggcctcgtgtaccacacctgggtaaaacaggcccaaatggccacataccaaggatagaagaaagccttctgggtaaaaaatatctacttcctctttccacaaagcttccttcaaactgtcacattaacagagccatttctaagaacgcacaagtctcaccctcgcagactgtgacctctgactcccaaggctgagccctagacactgaccagcaccaacacaggaagtcctatcccacaacttcctgcaacaagcacttagtggctagtgaatgaccaagacagaccccaccctcaggcagctcggtaaacatggggagacagaatcagcttttattggatatggaaaaaggtcccaaagctgaccaaatccaggcactgtgaaacattcttgggggtgggggccaggaagactccctactctgctgctcaatgtcctttctaatcttgtcactgagctgacattcctccaccagagatcctgagggttttcagaactcctctactgaaatgcagtgtctctgggagtggtatttgtagaagacaggactggagcctaggaggaggaggtaccaaaaaggaaggcaggaatggagcaaagtccaagtatctcccaacagcaaatgtgaagctctaaaaagaagccagacagatgagagggtgaagtcgaggccttctgacaagcagggtgacctcaggcaaggggcgtccccacggctcctgccacgcattacaggtggaaaatgccagtgcgcagggccgtgagaaggcttcagtaggaatcggtcactttatgctaccaccttcctccccactttgggagaagggccaacatttccactcctaacaacgctgtgccctgttccactcctaacaatgctgtgccctgttccacgtcctcctcagactgggccctactgatcctgggccttggatcagtggcagaggccagcaaaagttgagagcagcaaacgcatctttttcacaatccagagtcttaagtctgcccgctttcccctaccccttacctggcaggtccagtccctgccaagtgccctctcatggttttagggcatagtttggtattctttgcatgaattgccaggaaagtttgataacagggccgtttccaggttcccctgatgaaacagctcagcctaaagttcctgggccttttgttaaaagaacggtctccaccctccagcggcttccacttcctacttccgcactgttccaatttcctgagtaggtgggaagaataccccaagtggggggaaatgcaatacaaatgtatagccctgagtcaactcctggtttcagggaagaaagaggccttcccaggcatggtaaatcacatcaccctgacagtgacctgcaaatgtgatcccaccccacttctttctacatctgagaaaacaaaatatggaattaatatcttatgcaacccagatgcctccagggccagtaagcacaataaatgagtgcagctgggcggggctgaggctggggctgacaggacagcatctgccctgcccccaagagaggcaggctcttcccactccagccaagagtggccaggcaggaatgtgggcccaagagctgtgagctctgatgttccatgcaatgccagaaacccagatttttctgtgaattccctgatttttaaaggacggtaaactaattaaaacaaaacaaaactgtcatcaacccaccacaaggcaaacaaaacacatctgcagttgaactgggcctgcaggctaccagcttgaggcctctgtgctaccctacaccaagtaattttttctcagaaggctgacaaggcagggaaagaccgtattatctttctaccagttcttttttgaggggagctcattcccttgcattttccacaaataaaacagaggctcagagaggtgcagtgccattcccaagcagaggcagcaggactagaccacaaagaaaaagtaaggcactcataggaaaactcctttcaccagaattgaaaagataaatagaattcaactcagctgcgcagggaaggaaccttccacgttctgcctttgatgtctgcagaactcagctgcttgggaagacccagggccctgaaatcaattatccaaatgacagcccagagttcccataaatgaacaggcagaccgtgacactgggctccggctcaagaatgccgtcaggaaatgcttgtggcgaaagaatcatactttggacaaataagggcaagggagccaggcacactctccaggaggtttcaatcagcgttttgactttaagatactgtggttgctttcaaagcaggaagtgatccctttgaaagtcagctcaaatgcctagcacgtagaaagacaaatggaagtcaagcagctcctcgcatgtggggggtctctctcctgctgccacggggcacgagagctatttaggaaggctgtccaaagtcagggcagcctgggatcccagacccattaggcaaggctggagagcagaactgaccgggaccacactgggcagcactggacttgggctccaggacgtcctcagcacagcacagcagttaagtgttggaaacccagctctgataccttcttgctggatgacattggtgcttcaattaacctctgtctagcagttttctcttctacaaacgatctcacagggttgacataaaaatatgatgaaagaacgtacagaaggcacacagcacaatgctgggtctaccaacagcactcaaaagcagctatgggtctttaacaatctcatctttcatcattattgctggaagcagagcagcagcgtccagaggcagcaagttccagcccccaggatggagttggtgttgctttcagggacccaagggaggagaaggctgctctgggggtcaggaggattgggccactaggctcccctcctccccgccccgtgagcataccatgtgcttcctctctccctggatgtctgacctctcctttcccctctcccaccacctccagggaaccttcactgacctctctttgccatcctaaggtatttatactctatatttttgtggttcccaaacacccctgatcataaatgccacccaaggtacttgtgaaaaattcagattctagcaacctgcctcattcctgatcagaatccctagggcagggtctccaacctgagcactttgacattttggaccagataattcttagttgtaagaggctgccccgcacattgtagggtatttagttgcatccctggcctctactcacttgacgccaggagcaccatcatccccaagaaacaacaaaaatgtctctggacattgctaaatatcccaaaaaatcacccattggtttgggcatcactgaggtagatcaaggatgtaagtgtaaaaaagcgatttaaactctgaggtttccaaaagccccattaaaaaagctcagacaagtcagactgggagaagatatttgcagcactggaccccaaagaaacaggatccagtatatgaacttttgcaaagtaataagaaaaaggcaaatgtgtaagtaagatgcaatcaagcagttaaaagattaaactcaaaagagcaatacacataaaaacatgctcaacgtaccagacattaggaaatactgaataaaacaaggtaccatatcatactcaccagatttgcaataattaaaaggttggacagtgccaagggttggcaaaaatccagacttctgcagggagtagaagttgccataaccactccagaagggactcctgcaatatctaaggaagtagaagatgctgtcccaattcccctcctgggaataaactctagggctgagctcccaacagtgggtaagatcttaaagccatagcccttgagatggctgggtgggatctagggagtccagagccccctcatttgccaaagtgaaaatatgattgtctacgtgccccatgatgtggcaaaggctgggcagcatcgcacagagaaactcccacgcacggggaaagcgttcaaggatgttcacattcgtcacagtgaacaccgcaaaccctctacatgatcatcaacagaatatggctccggcagcggctgtatgcttctagaatggacactctaccaccggaaaatgtctgaacgagagctatttagttgtggattgatctcacaagcataatgctacgtaagcaaaagcaaaacatacaaactgtacagcaccatttacatcacgtttaaaaacacaccaacagcgccttgtttagggacatgcacagctatagtaagagtaatacctggaaagatggacacttgtggttctcaatgctggttgcacactagaatcacccagagagctcttcaaagtcctactgcctgggccacaccctggctgggacccaggcaccagtactgacctcctcaggtgactccctctgtagccaagcttgagatccacctggtgaccccaaatgcttacctttggaagggagagggacaaacagagaaggcacaaaggggccccacaggtacaggtcatactttatgcctgggctgagcctggtggcacaggtgagtttgttgtattattcacaatttaaaagctctcaggtacttcagaattttaccaaagagcattgtcatggaaggcagaagggctggagatctcagggaaacccccaggaactgcagttttcccatggatcagactggacttcccagttttctaggggaatgtgcgatcacaaaatgaatgactcttcaatctagtgtacgcactaattccaaaatacattagcaagacatcagaaaacctacaatagggggaagtattgtacgaagcaacagggatgaaacagaccactacaggcaaatgctgaacagaatgcattgtgaaaggtgctacctacatccgtggaccaatggcaatgctgacaaggagtcaggtgaaaattctagcattgtgggaactgaacctttccgggaagagtctggaaagggcatgctcactgccacagtgtccttgtcttctcagaaaagccatcccttgggggtagtgtggaactgcagcacactcatccctgaaggccaaggcaggcagcctctcccgacatgctgctaagacctgcttctctgtagcccctcagcaacactcatccccccaacatttacactcagaacaaaagccataattgacagttcccatttactgagttctcccaacatctcaggccctgtggcaagcgctttctcatgtcctcactcaatccccaactctgcaaaacattatcattcataactggggaaggaggaaagaggttcagagaaaaagccacttgtccaatgtcacatgaccagtaaatggcaaataggccaaaattagcacaacatgtagacagagctccacaaatgtcggctgtgactgtgacatgcagcagagccaggtgttgaacccaggcctggctaacatcaacatccaagttcttcttggtttaggagttacttgcacacagtacaaaactcaatcaggtagaagggcccagagcaaaaaggagactattccccccatgctggatgccaggtcccctctcctgaagcaatcactttcttgggcaacatgacacatcccctgttcaggaccttcaaagcccctgtcctttaaccagcaagctgtactgctggattcactgcctggctgagctgcacttggcatttctgcctatttgtagcaaacttcattgcagctgacaggcttccagcctgtaggccagggtagagctgcaggatgcagggagtctatcccagtttgtagacccaagggtgcatttgaggcaacatgcaggccatgggtcaggctatgcagtgctctctccaaggaccgacaggatcgctctgccagacacagacaacagctggaaggccagatacccagcctaccagcccaggccttcacgagggcccccaccagagggctttagcacaaagacagcagttaaaccataaggatgccacactcaaatgatctggccttggaccaggcccacaactagccatggacagcagacagtaagaggcagcaagtcctgggttcagcagcttcaccttttctagtcccatcagcttttgaaaaagcatttcacctctgaaatggggactcctcacttggaatggcaacaacagtatccacccctcgaagggttatggtgaggattaaatgaaacaatacccatcggctgtgcgtggtggctcacgcctgtaatcccagcattttgggaggctgaggtgagaggatggcttgagcccaggagttcgaggccagcctgggcaacatagtgaggccccatctccagaaaaaaattctaaaaattagctgtgtttggtggtgcatgcctgtattcccagctacacagaaggctgaggcgggaggattgcttgaacccaggagatggaggctgccgtgagctatgatggccctagtgcacttcagcctgggtgacagagaaagaccctgtctcaaaaaaagagaaaagaatgccccataaaatgccataccattagcttttcataatgatatgaagcaggggctgagctccggtgacatgaaacaagtcacagtttgcagtgtcaaaatgacactgtgtcccccgagaacctgtgttttccaggcagcaccaggagaaaaacatctcatagcagggatttagaaggtgagcagtcctgccagtaccactcgtatgctctgtccagtcggggacagggggacagaggagtccgtttcttttttgatatggcatcaggccaccaaggcgaggcctttcgaggagaagagcctcagctttcgaggcaactcagcagcctttcctgagcccctccagagagtgggtagggtatgagaaaaaccacaacaatcctggttctcagataatgcctgcttcctccagcagcgggggtgctattgtcttgatttccacagatactctcgggccatgtggggtgtggcacagcaaagaggatcctcccactcataaaaagctaagtgtgagatggcagctttggggctccaacctcagttcgctgctgcctgaacagaaaccggagttcacaggaagcagaacctccagccccacaccctggccttccccaggacacagagaggaatgtcctcaccagtgggtagcccaagcctcagccctcttaggatcagagaattaactgtgggacaccaggcttaggtcccccaatcccacccgcttatgtgaaaactcacccaccctcccaagtcaatgtccctggaaaggtagggcagcagcacagaagaccagtctcagaaacaggaaggcggggtcaaggtcaagccaggctgtgccctggcctggtcttaagcaatctcaggccaaggaatgaaggatggtactatttttaaacctcatgtgacctgcacgcaaacccagccaggtaaggatggagccctgttgtcaggggctctttgatcattccaggtgagtaggaagtagttatgacaatgcccctctcaacaattctttgcctttttttttttttttttgagacggagtctcgctctgtcgcccaggctggagtgcagtggcgcgatctcagctcactgcaagctccgcctcccgagttcacgtcattctcctgcctcagcctcccgagtagctgggactacaggcacccaccaccacgcccggctaattttttgtatttttagtagagatggggtttcaccttgttagccaggatggtctcgatctcctgacctcgtgatccgcccgcctcagcttcccaaagtgctgggattacatgcatgagccactgtgcccagccgattctttgccttttaataacatgactttccacaagaaaaagaaaaacgtgtgtgtgtgtgtgtatatctatctatctatctacacacacacatatacacacatgcactgaatactgactatgtgccgatggccccacgggggagggtattgtcatgcccatttcaccagaggaagaaaatgagaccaaaagcttcggccacttggttaggatcaccagatactaatggggagctgagactgaaacccaggttggcaagtctttgtcaagaccccatcttgggaggacaagggtccagggaagatacctctctctcccccaggcttgagtttcactctgaagtcacagaagcatggcagagataagcaagctaagccctgggtgaggaagtgactttctcaaagtaacatagcaaatcaacgaccaagtcaagatggtgggagtccccaacaagctgcctcctacacatcttcaggtctcgacttaaatgtcacttcttcagggaagccctccttgaccacataacgcatggccagaggcaggcacatggtgggtgagcttaccttcactgtcggtgagcacttccatgcgcccgctgaacatggccttcagcatggtgtcctgcttggtcagcgtctgcatggtggtatagtagagggctccacccacattcagcttcacgtatttggagctggggctcgtgcccttgaaggaagtggtgcgggtagcagccgctggcaccgctgagctcaccacactttctcctgacatctcttcctgccagtggagaggatacagggtcatgacatcaggcctggttgactgctttcagcctgtggattcaatctggcctccagatgtgttttgcttgggccacgcatacacagcatttaaaagtttgcttccaatgtggacaactaaggagagctcacagaaaaatctggacttctggcttctcctaaaatcagaggccaactgggctagcaggggaacaactggtcagagctggggtattggatgacccctagagagggccatgcatcccctagtttgtcccaaaacccacccaaaaagcctcatacactgaccctgcctgtcgaccctgcaggcacaagggtgcccctaactcttgtgttataagcacttcctttctgcctagcacctgtatacatgaacaccctggctgcaccctaaaacagcctaaagcactgcccaggtctctttacatttccttattgccatgtaccactcaatagctagctaagtgtcatttttcagctgcatcacagatgaaataagctttatgaagttgaatgggattccagctggcactcctatcacttcctgtagggagaaggtgtttctgaggactaaacaacagacatggaaacttttggaaccaagttattgcaaaattagacctcctagactagtgctgcccaaaagagcaagatcccactaccatctccctgatagcatggctgactctctgtacatctcaaagaaatggatacagtggctgatttacgcaggcctggaaagtgagattggtatccggcacatgtgtactcagagcaaacatgtctgaaatgaacaggtaaaactgtagaggtggagatgtgcaagggtgggcagaatctttgctgaatctggggtagcccccacggctggccctaccattcccattgaacatcaacagtttttcacagcacatcaccctcagacaaggccactctgtgcccttgcgacaagacaaaaacaggaccattcagtcatcatgtccggacacagacaaaaacataaacattatccaaaatacaaaaatgaccaaagatcccctatcctggctaataggagttatagctgctgctttaccaatgagaggtttagcctccttccattcttcctgctttcaagtcaggaatcactgagacccaatcacagaattagccctgcttcccagcagcatccaacacagagcaaagccccacttctctgaactgtctctcaaatcacccaacacaagcccacagcccttctctgagatgtcccacagttcttccccaccccaatgcaacaaggaaataaacccaactttgcttgactacaggtatgctcctcgtgctttttggctgcagggcactgacagcacataacttgtttgaactattccctgaaactgaaaaagaattgtctagcttttccagattttctataatgaatgggtactacaactataactggtaaaacacaaacgttatttttgtaaatgggactgggagtaaagggaggcagcttgcaacagcagaagcaacgcgacagtcatggacaatattcaattcaaggttatccaactcttctggccaactctccccaactccatggcacccaacagtggcctggatatcacctgccatgtcagggccctgcagagtgaaacagagaaagaacggcctcctggaaagaaatgttttctcaagaaacagttcctttttcatcaagaaaagtcacaagaaaatatgttttcaaaagctcaggcttagctcacctggggtctttgctgcccgatgccaaacacaaaagaggtccagaagaagcagttacccctcctttctagctgtcctctgaaatcagtccccagagacctcacactaacagttatgaccagccacctccctcagaaaaatcctttgtccatgggatgacaggagtagcttatggaaataaaagtttccaaaaactgtgaagacctcgaagggggggagaaaaggcttacggtcatgggtgagggtgtgtgttgaggaaatttgccccaaaatgcaaatactttttaagcacccctttcagatctaattttatataataaatgcttgttatgggaaacgatctagcattttggaaggtgcctatcatgaaacagacaaaaaagtacataaagtatacttcatgtaaagtcaaagcacagtaaatatgtgatatgaaggatttttttctaatggcatacttgtataggacacttaccatgaatggagtgtgtaggcctggaaattgctctgggtgagcgagtggtgagtaaatgtgaaggtctaggacattactgtacactactgtagctttatcaacactgcacagggaggccacactacatttatttaaaatattttttctttccataataaattaacctttgcttactgtaactttttactttaaaaactttttaatttttttttaacttttggacccttttgtaataacatagcttaaaacacatattgcacagctgtacaaaaatattttctttctttatatccttattctataagcttttttctctttttttactttttaaacttttttatccaaaactacaaaatacacacacattagcctagcctacacagggtcaggattatcagtatcactgtcctccacatcctgtcccactagaaggtcttcagggacagtaacacgcatggaactgtcatctcccgtaagaatcccttcttctgggatacctccagaagcacctgcctgaggctgttttacagttttcacttaaaaaaaaaaaggcaggtaggagtatattctaaaataaccattaatagtaaatacattaaccagtgatatatctatcaagttcattactattatcgactattatgtactgtacataattgtgtgtgctagacttatacaactggcagcaaagtagttctgtttacaccagcatcaccacgaacacgtaatatgttgtgctaccactgaaatgacagctacactatcactgggctacaggaatttttcagttccattataatcttaagggactgttatatacgcagtctgtcactaaccaaactgtcattatgtgcgcatgactgtaccttttttggctttccaatacctttttaaagataatttgcacataatgaagtatactttaagtgtacagtttgatgtgttttggtcaatacttgcacctgtgtagcccccactccaatcaagctgtcttggaacatttccatgcctccagaaagcccctcggtgtcccttgaccactgcatttctaccacatgccttttacaaattcaaacaatgctggaagacagctatagttatttccattttgtggatttggatgccacagccccatcagggtcagtcactctcaagctggagttgagtcagtgacggggccagtgaaggacatgggcaagtggtggctggcccagagaccatcacacctagtagattgagagctatgatacataagctgagaaaggccagcctcacctcccttctttaaaaagtacaaaaagccctgaaaatagtcgcgaggtaaagtgtggctaagggtttggagttagacctgtgcataaggccccagccctaccacttagtagctgtgtccagggccaaaagcctcacctccctcacagggctccctagctctgagtaaacactccaaacactcaaattatgatgatttgagaatgctcccgaagtctcaaactatcttctctttggaaactgtttccagctctaatggcagacggcatgactaagagataaaggcaggagccatcctgatctagaatgagactacagattaggcaacaaaagctctaaaccttttcagagctcaccctctccaaaggtcagtcaacctaatagtaggcaaggcccttgggggaaaagttttggcagcattcgtgtccttgagcccaagttacagtgaacttaggacacgaggcagtggaccagagacccccaccatagcaaacctctctagggaggactctccccactgttgctactggaatcctgcttttttttttttttttgagactgagttttgctcttattgcccaggctacagtacaacggcacgatctcagctcaccgcaacgtctgcctcccaggttcaagcaattctcctgcctcaccctcccgagtagctgggattacaggcatgcaccaccacacctggctaattttatattgttagtagagatggggtttcaccatgttggtcaggctggtctcaaactcctgacctcaggtgatccttctgcctcggcatcccaaagtgctcggattacaggtgtgagccaccgcgactggctaattttgtatttttagtacagacgggatttctccacattggtcaggctggtctcgaactcccgacctcaagtgatccatctgcctcggcctcccaaagtgctgagattacaggcatgaaccaccgtgcctggccaggatcctgctttttgacttgtttcaaaggtttgatttcattaccaatgaagctggggaggtgaagcaggagacagcaaaattggttacatgaaacagagaggcaatgaatacttgagatactggctacggatctgattcaatcagaagtttattccagttaaatggtcagtctctcttctctccatctcccctgaatataatgttgctgattctaaacagtggctctccagttggtgacaatcgaaatcagctgggagctcaaaactcctgacacctaggtcctaccatgaaaattctgatgtaattggtccgggatgtggactaggcaacagaatttttaaaactccctcaggagattttaaagcccaccaagattagagcccactattctaaaaagcactgtaccccttatttaagctaccattaactccacggtcttggcccagtgaattcctgacctgacacattaaaaacaaaccaaaacaccataaaccaaagccagcccccacttcacagcttcagagccacagggaggaagcaactgtatgcatgcatgaaaatacaaaaatcagctgaagggggaaaatcatcgactgaaaaggaggctcaggcaagtacagtaggaaaaaacgcaccaaatccctgaccccacgttttctatatgcttctctgtagaagtcttgtgtgcctgtgtgtgtgttaaggaaaacgggatagtctcggcaaacctggattgcaatccagttccaccatttccttcgtgaaattcaagcaatttaacccaagtctcagttttctaacttgtaaaatggagtgttaaagccataatcttcaaaaccctcagagaatgaatgttaaagcatttggcacctagtcctttgtgtagtttcctttgggcgtctcaaacattgggatcagtggttcccaaccctggctactagaatcacctgcgtgtgcttaaaaaacatgatgccaggccaggcacagtggctcacacccattatcccagcactttgggaggctgaggcgggaggattgcttgagcccaggaattcgagaccagcctgagcaacataagacctaatctccacaaaaaaattaaaaaaaaaaattaaccggtcatggtggcacacacctgtagtcccagctactcgggagactgcggtgggaggactgcttgaggcagggaaggtgaggctttagtgagccaagataataccagtgcactctccagcctgggcgacagagcaagaccctgtctccaaaaaacaaaaacaaactcacacacacctgtgcttgcctgggctacaccccagatcaattaatcagtatctcagagatgcggaggggtggctgatcagtcactagtgtttaaaaagctctttgggggattcggatgtgggaccagggcttactgccacctagctaaggtatttaaccagctttatctaagagttgccagggatgtgaggcaaagcatcacctcaggggattcctacagcaaagaagtttaagaaacactgtattgaggcttgtataaaaccttcccaaactgagggcatttctacaactcagaaaagtctgctgttacatttcaactaaactaagtcacataattgcagcattttacatccaaaatttgcttataagacagctaccgccaattgcaacttccatcaaatgacattctctccctgtgtttaatacacaaactcttggtctatttctctcaatgttctagtgagaaagatgtttatcatcaaccccacttttttggggagaaaactaggaatcacacctataagagccctctgactcccaactcctttgcccctttcattacacagtccaaatcaagaaatcattagtctaatcccttgcagggcttgttaaaaccgatagatgggctccaccccaagaatgtctgattcagtagtctctgacagggcttgaaatttcagccattttgaataagttaccaggtgttgctgctggtgggaccagagtttgagaaccactggtttatgctgccttcttcccatccgctggtccttattttgcacaaaatggagcggactagtcaacgtcagctacaggataactgacttttcttcagcagcgtcactgggactgattttcccttaagactgcactttccagggacgtgacaaacaagcaagcaagtagaaagaagatctgggccaatctttggtcatctctacccagggacaatgagctactcagggaacagacccttgaggatcccaagcagacaaaccccacagctgagagacagatcttgaaacatcctccgctccttaggcgtggtcacctctggcctcaatggaagttacagataggtacccaggcgccagctgaggcactgaactccgtggcgcaggtatcctaacctcaggcccctggcatctctccccaggattccaagcactgaacgcacatcagcctgctgggctctctcgatttctttccctcactgggccgtgtgttcagacgcacctgggagccccttccccacttcctggaaactcagcgactccagccacaacctccaaaacgccaaacgctccgccccaaggaatcctacctcaccttctcataacctgcccattcattctccttcataatcctccaaatcctcattttccacccccaaatgtccgttttcaattgatatctctttgttctcctcgcaatcaccaactcccatctccaaccagcactcaggactcacttggagacaccccttcctcacgcacacacgtatctactccgcaagcccaaatgtgcttcccggattcctaaccgccagggagcctccctaccaccacccccgcccctaattctccacccaaagcccttcccccaccccgggcctttcccctaaccaatcccccaaatgcctctccactatcgtgactgcccctcatcacaccccctcctctcggtcccttcttatactctgctgctgcccagctccctcggccgccctcaacccctagtccatgggcaccgccctccctaccatgaaaagtcggaggacgcaggagtctccaaacccggactgagagaggcaggaaacacccagctcacgccagccgggggcggaggcggggccggagcgataacttccgctgtccgcaccccacttccgccccgcagagggcaacgtcttaagccgtccgttgtgcgcctaggggccagttttctttccagcctccccggccggagtgggttccagcttttctcggctggggagggcatttatcccacctccgctatttcagctgccagaggggaggcaaggtgtggggaagttttccttcccgggcgaagaagctctgcggaactgtcattttccggaactggatgcttgcttcctggcggggttctgaaagcgaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttgggtgagttccctcacctctctgagcctcagtttccttctgtgtaaatggagtaattagcaggtttcacagagggtgtgaatacgttttagtaccgtgcctgacacctagttctgaataaagaaaaacttgatcgtaatttaactccagcttagcccccacaggcaatcttgcactctcaacttctctttgcttggccattctgtgaacgggggagccctggatcttgtttgttttacttagtgataaataactgttttggatatacatggattcagattcaaaagcatccaccttagataggctgtagctttcaataaatagtagctgttaatatgaatagtctctttaagtcgtgtttcctattctttaaataaaaattagattattgaggctggccacggtggctcacgcctgtaatcctagcactttgggaggccgaggcgggcggatcacctgaggtcagaagttcaagaccagcgtggccaacatggtgaaaccgcatctctactaaaaatacaaaaattagccgggcgtggtggcgggcgcctttaatcccagcgacttgggaggctgaagcaggagaatcacttgaacctgggaggcggaggttgcagtgagcagagttcgcgccgctgcactccagcctgggcaacaaagtgagactccgtctcaaaaaaacaaagattatcgagaactgatagagctgttgaaaagacaagttggttaaataatctgtgcagtgtctgatacaccgtctgcccagaacaagtggtggtggtcattaaacctggtggcccagcttttcctactgcacagggacaatcctcttggcttagtcagcagttggtatttatgatgcttcagctttggaaatatagaggtaagacaagagtctgaatcctgcctcttagttattacagccttgactctgccacatactaatggtctagactggagtagatgagatcatgaatgatcttctcataggactcctctccttattagatgagatcacttataaaggacttgacacataatgggcactcatttacttttttaaatgatcttggttatcaccaacctcttattttctaatctttctacctatatgattcttgtttccctaactagattgcaagcttcttaaggacaatacaataaagctcacttacatgctacatgcttttagatatcctatattaatattttcccatttaatcctaatcacaatgttgtgatgactaaattgaggtacaagaaggataaatgttgcatttaatcctttcagcaaccctaggacatagacactattattaccctcgatttacacataaggaaactgaggcctagagaggataagtaacttggccaaatgtcggatagaaggagtactaaaaagaaccaaggcccgctttctctgatgcaagactttttctgctgcgcacagccttttctttggttctccatggcatttagcaaaataagtacttaataaacacttgattgtgtgttttattaattgacgaactatagtatacactgtgcaggtggagaaggtatataggaaaggatgagaaaaactgtaaagtgtaggctattatatgatatgaacagaaatcaaccaataacattgctgaagggataataatctcaaggaaggggataagagtaatttcttattctgggagggcccctgggagaagtgaaagttttaagatcgtcttacagtgcttaggtacagtttgcatgcaactttgtttttcttttgggaagaggctccctcttccccttctaattccatggaccctctgccattgaggcactgtctgcatgtcatggagggagcatatcattgtgcttgtggcttgggccctgctcttttgcagtcctgaggagcttgaatctgttactcactctaaacaacagggccaggagttcatagcccaagggacaggactggtgaatcttagtgcatttaagataggaaaaaagttaatgggtgagaaatgtcagactgccagcattatttcctacccagagaaccttagtaactgtccaggtgggagcctctgctgaagagtttttttttttttttaatccttgtgtctataaaaataatacaccagttagacttcctgactatacactctacaatgtgcactcaagtacctccataggtacctgataagcatcatcacatttagtcctcattatcaacctctaagccaattaatagatgaagatggaaagactcagggcccagtgtggtggctcatacctgtaatcctaacattttgggaggccaaggcaggaggatctcttgagcccaggagtttgagaccaccaacctgggcaatatagcgagaccccacctctacaaaaaatttaaaaactagccagatgtggtggtatgtacctgtggtcccagctacttgagaagctgaggtgggagaatcgcttgagcctgggaggtagaagctgcaatgaaccatgattgcaccactgcactccagcttggatgacagagcgagaccctgccttaaaaaaaaaaaaaagacttagacattctccctatagtatgtggcagagctagggactggctccaactctgtgtgactcccaaagcccgtgtgcccctcactgtgcagtgctgcttcaccatgtgcatgctgtggaaaatttagaaaatacagaccaattaagaaaaatttcccgcaatttcagtacctcaaaacagccactggtaacatgttggtatagttcatgctagttttgtatctgtgtgtgtgtacatttttctttaggtaattggggtcttattggtccacaggcagccctttattcacttctaaggcataaacgtttttccattatcattaaaaatgtcaaacacgctgaggcaggagaatggcatgaacccgggaggcggagcttgcagtgagccaatatcgcgccactgcactccagcctgggcgacagagcaagactccgtctcaaaaaaaaaaaaaaaaatgtcaaacatggccgggcacagtggctcacacctgtaaccccaactgagatagggtatggtggcacacacctgtaatcccagctacttgggaggctgaagcaggagaatcgcttgaacctgggagcagaagttatagtgagctgaaattatgccgctgcactccaacctcagcgacagagtgagactatctcaaaaaaaaaaaaaaggaaaatgtcaaatataattttcagtagctctttaacattccatgacctctaagttattttgcttcccatcacagctgtaattcaacaacaactttgggatttattttcaacatattccctttaaactgtgaggattgaagagatacagtataacatttagatgagacattaaataaagaggacccagtggtgtttttaaaaaaccattggcattgtagttactacttttactcagtgaggaagatgtatgataccacacctataaaatttaaccctaagtctggatttttttcttctgcttctgccagaaaaaataacaagcttttctgaagtgagaagctgttctcagccacgagtcctgtgcaagatcactaatgattacctggcatttctgcgacacaggcaggtcctcaggtgagatctccagactttactgctggggcaggaagcgtaaatgattcagaagatggctaccgtttctctccaagccttttataagttggtgcaaaagtaattacgacttagtgtttttttaaaaaagttgaaacccacaattacttttgtaccaacctaataccttccctcctgtggtcaagtgggctctgttagtttgtttcaaggattactgatgatgtttgacagatcactgttgagaaggggtcacagaggtcccttgatatgttcatgtggtgggaggcttgcaccaacttttttttggttataaaagggtattattttattgtccttattaatactaataatagagcacacttattaaatgcctttcaataacacgtaattaatttaatacctctaggagataatactattaagtccaatgtttattttaataatttttaaatttctttgtatggatgtagggggtacaggtttcttatatgcatatattgtgtaatggtggagtctgggcttttagggcacccatcacccgaatggtgaacattgtaccaataaataattgttcaatccttacccctgtcccatctcccaccttttggagtctccattatcttattccactctgtttgtccatgtgggcccattgttttgctcccacttctaagtgaggtcatgcagtatttgcctttcagtttcagagttatttcacttaggatagatggcccctagttctagccatccgactttttactctggatgatattttcatgtgggtgctacttcaagtaaagtagcctggtagagagattgttttctggaagtctggatttctgaataattcatttcagtgtttttaactgggctgattgtgcattttgtatagaatggcaatgtcatcaagcatctaaagaaatcatctcaatatgggagcctccgggggtcagtgctgtgtgctttaggctgctagcaaaagctgttcctttaggaaaaaacagttactggtgatttagataaaaacttagtatataatttagagctgctcttcagaaaagcacccgttagtggacaggaccagttctacagtaaagtcttcactggtccttggcaggatggtaattgtaaggacaatggaataagctatacataaaaccaaatatcttcaatataatggactgtcttgcattctgaagtgtgtaccttttgctttgttaatgttgaaatggccctttcttttttgtgtgctgtcacaaagtatgcactggtaaatatttgtttagtgaatggatgaatacaatgatgatgacagcaaataatcatgttggatttttctctcgagtccttacttggcaaaataaaagctgacctctcagttttggtttcccaaatactgtggactactccagaaaattcaaatatctgggaatctttgacctataggatacctggtttgaattagagctttatgggtgggactgattcattctttgttcattcgtaaagctgggcctgcccttatcctatgccaggtgctgtgctctttcccttaagaagatgtgattatttaatataggatgtagcatccctggtcttggtgagttgcatgaaagagcctataggaggtagggacttgtgccggagagctgttagcgctttggagggtgttgacaggtcctgagtatctctgctgcccaggtccctgcccaccctctgctcttgagcccctttctgtgtgtgtttttcacacaacaatctacaacacccacttgcccattttccttgcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggtaagggctaggatctccctagcacatgattctctggctcccaattaatagcagataaatgagttttttctcataaagtgcttgaaaagccttccaggtgctacaagctgttaatttaaaatgtctttttttgcactttcttttctaggagagagattgatgacttttttaaagcagatgaccctgagtccactaaaagaagtgcactttgtattttcaagattgccaggaaactgctgttcctattcagaatcaaagaggataatgaggtaaaacgataatagcaaacatgtataatacttccatatgtcagatcttttataattattgatattaactcagttcttatagcagctttatgaggtaattactgtcaccctcacatcctgtcccttttgttttcttgggacctgttttggagggattatgcccagtgcttttaggaatcttttcacattgaccattataagcacaagttgaactcagatgcatgcaagagtcaggaagtttaggtaaatgagtaaaaaaaacatatatgagataaaacataatacaaaatacaaatcatattaaacggtaactgacaggcagcagtggtaaggacatcaaaaggagtagcagggtctgtggcctgccccatccacggggagcagctactacacacctcggtggtggactcatactctgatttttttttgagatgaagtctctctctgtcgccaggctggtgtgcagtggcgcagtcttggctcactgccagtcttcacctcccgggttcaagcagttctccggcctcagcctccctagtatctggaactataggctcgtgccaccacgcccagctaatttttgtatttttagtagagatggggtttcaccatgttggccaggatagtctcgatctcttagccttgtgatctgcccgcctcagcctcccagagtgctgggattacaggcgtgagccactgtacccagcctctgattttttttttttttttttaaagagatgccaaagatctgagtttttatgctcaatgttcgttcattcattctttcatattctgagacagggtctcactgtcgcccaggctggagtgcagtagcactatcacagctcactatagtcttgacctcccaagtctcaaacgattcttctgcctcagcctcctcagtagctgggactgcaggtgtgtgccaccatgcacagcaagtttttgtattttttgtagagatagggttttaccttattgcccaggcttgtctcaaactcctgggctcaagtgatccacctgcctcagcatcccaaagtgctgggattacaggcgtgagctaccatcaatgttctaatttgtaaatcttggcaattaatttgaaattttttaaatatcctgcaaatcatacaaaaggtgccagtttgcaccttagggattagaatgatcagcctgaaaagtgtaatcccagaaaagcagctagttatctgtaatagtactaacaatgccactgaggcatgtctccaagttaccagctgttaggctgttaggcattcctattgctaagcttcacattgtgccaaccctctctaggcactgggcccttgggaggaaacaggacgggcaagatctctacgctcatggagctcatagcccagcaagagagggaggactatgcaggcagtgaacacatgattacgtagatgaggacagataagctggaggaggtgaacctcatcttacagagaaggaaactgcagctcagggtggtagggcagcttgcccaatatcacatggtttaagggcggatccaggattggtatagccaaaatggaacctgttttctagtttccacttttcttccttttgcattacaggataaaagtgatgatacagcagcctttggctactggctgtgaggcaaaagtcagtatccatggtgcttaagaaaaggtaaactggagagcacagttgaggagacagcagcaggcctgcaggaatccaaatccagtttgccagattgatactgttttttgaaagaagcctcaatttgggtttttatgtgaagtataccagtttctaaaacatttctatagggttcctccagctcttgggccaccagttggagaaccctttagtctttatgatcttcagtgtcctcatctgtaggaaggaactgcatgtgattatgtgtgaatcacctggcataatacctgcacgtgccaggtacccgctgaaggcttgttttctttgttttcactttttgatggattgtgggaatgtataacccccagtgtgtctctttgcagagatttgagaagttgtgtcgcagcatcctgagcagcatggatgctgagaatgagcctaaggtaagtggacgggagccgcagtgtctcccacaagctcttaagggccaacctactgggctctgaaagttcctgttgaatattaggaccaattcacacacaaatgcaaataagtagtggatggaaaacattaccaaagtacaaatgattccttagtttcttcatgatccaggtagctacgttctgctcttgccacaacacaggatagtaaattttcttactaggctattttgtctttgcgtttagtgttaaaataagtcctgtttacagcttatttgtccattcaggtccactgctttatctggcactggacctaactaataggtccagttccaacagttagagcacaagtgatatgatctctataacagcccatgacattcctctttttcccacctataggtgtggtatgtgtccctggcttgttctaaggacctcaccctcctttggattcaacagatcaagaacattttgtggtactgctgtgattttctcaagcagctcaaggtaacaaaaaaaaaaaaaaaaaaaaaaagcaaaaccagaaacagtacgtatgtcattttcacctgtagactttagtctgtattttcagagtcactatcaacgagagttgctagttgagccactgttctggaagagaggaattttgattctgttatcaatatgagccctcctttggtgtgtgttggacccttaaactgcttgccacgccacagcctccatggcagggaatctgtcactttccttcccattcatttaatgtaatcagtactttatgatctacattattatactagtcaggcctcttgttaaaagtacagaagccgaacgtgagcacagctagtatcacgtaccagttaagcaaggaagagaacgttgtgctctagaatatattcagtaacgtggcagctagagtaaggagagctagggggttctgattctccctctcattcttttctctcatccctgctcccttttggggtcacctcgtcctttcctgctgtaatcatggcaacgagcagttttgactttatattcttactctgtcttgactaaagggaggagaggcctcccgaccagttcaaaaatccaggtttcttgtaggtccagtgaatcctgggttcatctctgaaccagtcacagtggcaagaggaatggggtactgccactagcccagcctggtcctgtgttcccctacccccttcagtgttctgaaaaggatggacaggggtgtgagcagacatacacaggagccacttccactttgcttataaggata

SEQ ID NO: 516 - DNA, 54585 bp, Homo sapiens
tggacatattttaaagatattcacgatagaagaaagcacaaattaatgaataaacaattggatagatgacgtgccttgtttgatgtgagaacacttaataaaaggttaaaattaatgagctaagggaagaaaacatggctaaaagggctggtagctctgtaagggtggggacagggcggggaacagagtcagggagacaaacaggatgctgggaggtgagaaataagggtggggagtagtgggcaatctcaagaggaactaacaaggccgttgcttatagttacccagaaaacctacgaacaataacagacaagcagatgcagctcagaaagaaacagcggagcagctagaagcccctcctgctgagacaacgcaccagacacgttaatggtgtttgggggctgcaggtcatctctcacatactcacatccacaactgctgacacctctgtttcccgtcgaatcaacagatcctggcaaaagacccccagagaggatgaatggaccttgatccaggagttttaatatattcctatctcttcagaaataggaacttcggctctactcattctagtttgctggcttttctatttttggttttggtgggttttttttgttttgttttgttttttgtgtttgtttttagcttttcttctttggaaaggtttgtcaagtaaatactgttacgtgtcattttgaagaggaaattccagttccaagaaccagcacaggtccaactatccaagcagtctttaaaaagccaaagagtcggccgggtgcagtgcctgcaatcccagcactttgggaggccgaggcaggcggatcacaaggtcaggagttggagaccagcctggttaacatagtgaaaccctgtctctactaaaaacacaaaaactagccgggtgtggtgggacatgcccataatcccagctattcgggaggctgaggcaggagaatcacttgaagctgggaggaggaggttgcagtgagctgagatcatgccactgcactccagcctgggcgacagagctagacttcatctcaaaaaaaaaaaaaaaaaaaaaaaaaaaacccacagtcaataaaagacgtttgccttctctcactgcccttgattcctagagcctccctcttcaccacctcctgccccgctagactcagcccccttcaaaatcccaatcaaaggactgcacctctggctctgaggtgctttcaaagggccaacttgcaaaactgtgcttcagatctgacacttaatcatacacaacttgcccgtttctttctttcttagcggttttttttttttttttttttgagacagtcactctgtcgcccaggctggagtgcagtggcacaatctcggctcactgcaaagtcgcctcgcaggttcaagcgattcttctccctcagcctccggagtagctgggattatagacacgtgccaccacgcccagctaatttttgtatttttagtagagacagggtttcaccatgttagctaggctggcctcgaactcctgacctcaagtgatccaccacctcagcctcccaaaatgctgggattacaggcgtgagccaccatgcctggcattttagctattttttaaaacacacttgtttcttattacaaaaggaatacatgctcattaaagaaaaaaactcagaatattgaaaggcaaagaaaaaatatcccccctactcctatcacttggatatgagcattattatcattttcatgtttttgtgtattagcaaatcttttttaattgccagggtgatgaagaactctccactgttcatgtgggagaaccatgtgtttaattttttctaggacagatcagcaaaacttccaaagcatttgtgaaggcagaatggcttgccaggttgggagaccaaggaataaaaggctgaagtcctcttcccagccaagtaccaggggagcctgtgcaactgagcttttacacggagggaaatgcttcaaacttcagggttttggaagtgtgggcatgcaatgcacttggaatgagcagaaaagaaaaggtggcaagaccacttccctagagcacagtgtacaccctgcctctttgctggcttagtcactaaggtagaaaaatgctcacacgtgcacatgtacatgtgcatgtgtgtacagggtgagagagagagagatgacatatgtatatatacatgaatagatgtatgcaccctttgcttgctgccttctgctctgcactgttggagctttatactgacattaaacttcatgtcatttttatatgctatcatgccactcacctgcttaaaaaccttctgtggtttcccgatgtcaaattccaattttctccacaacatggccttgactgacctctcctaccttatctcactccactcctaagtgacccaggttcctgttggaccctttgcctccatgccctttccagatcctaaaatgtgatttctagccccttctgcagccatgaagttctaacacagatatcacctcctccatgaagattttgaggatttcctgaccagatgtcatttcttttgcaagactgtaagctccttgaagacaaaaaccaaaccacacattactgctcatattttggacaaataaatttacctttttatccatttaattctcatatcattgtccttttctaaattttattcattatattcttggccgggcacagtggctcacacctgtaatcccagcactttgggaggccaagacaggagcatcacttgagatcaggagttcaagaccagcctgaccaacatggtgaaaccccgtctctactaaaaatacagaaattagccaagggtggcacacacctataatcccagctacttgggaggctgaggcaggagaatcgctggaacccaggaggcagaggttgttgcactgagttgagattgtgccactgcactccagcctgggtaacagaatgagattctgtctcaaaaataaaataaaataaaataaaataaaataaaataaaataaaataaattgtattcattatattattatttctgcattgtgtaataattaagcagaataatacatatattctctctaattccttgaatgcagggattatgtcatacatatttcttgcactatcacccccacccgagacctatggtaaaagttcaagcaatactaactgaagtagattaaattcaagatttaaatgccaataattattccttaacatagaggagagggatggaaacataaagagtccaccttactccaaaatagttgaaaaacagcctcattccaaaacaagggaggtagtttttcttactttgtgggtctcccattctttacttactctgactaccagcacaggaaaaatctaggtagtctccaactcagcaagaagttgcagtctctttgtatgtgtaggacattgatttggaaattataaataatttcgctttgaagtcatagtataaataatgttttaaggtctctgacaggtctccaaaagttgactgaaactcttaataaagaagaaataatatgttttcaataaaaagtagaaaataaaactactgacatattttacttgcaaaataaccaataaacaatgaaatacacgtgattttttttttttttcttttgagatggagtcttgctctgtcgcccctgctggagtgcagtgatgcaatctcggctcactgcaagctccgcctcccgggttcaagcaattcttctgcctcagcctccagagtagctgggattacaggcgcatgccacagcgcccggctaatgcttatatttttagtagagacagggtttcaccatgttggccaggttggtctcaaactcctgacctcagatgatctgtctgcctcagcctctcaaagtgctgggattacaggtgtgagccaccacacccagcccaagtgattatttttaatttgaataatcatgattcaaggaaagcagatttaactatagaaaaaggatatcttctaaccattctctcctggtggctatcttccatgtttctcagacatttttttttttttttaatggaattaagacatgacttgagggcctaagtcttactctgcccatagctctgagtaatttcaggatccacaaggaaccatgtttaacaccccagtcactcttttcactcatctcttcatcttcagggatcttctccactcccttctagttctcccacttccgcaggcactccctggaccgcaccatcccctaggactgcttcacctctaaatactaaacttacaggtaggtccccattctctgacaactcacctcctaaccttccaggtcactcactccattattcccaagacacccattcttcaacctatttggaatgtccagttcaccaatcccttggctatttctctacagccttattctgttttacctctctgagttaggtcccaagaaccaacatttccactgtgccactgtccttggattgcactgtcctgccaaacacaatccaagacaactgtccacctgcactagaaatgctgagagcttctggaggtgggagtggatcatacatccagtctgatcttcaccagaactcatggtcacctaactcaacctcggtatttcctggcaattctaaattagatggatggatagataataaaggtggaaacttgcagagatgatgcagagaatctccacaccttttgtaatgttttagagatggataattcttagactagcatttctaattttacttcaaatcatatagctttgttttcctttaaggtaaatgtatctgtgctgctcgtaaattcacaagcacatgacacttttctgccttggtagctttgtctgtcatcacacgaggaggagaaatgccctgggaagaaatagaaaagctctaaagtagattggaaaagaaataagaaatctcaagaaaatgtatttgtgtagcaggaagagactgcctgagatgggatatactgtgatgtaagtcacaaaagagaaagtggaggtttgcagtggcttgtgtccactagcccctgaatccatttcaacatggtgttattgtcctggggtagcttagctgtcatacattaattaacaaatacttatggaacaccttctacttctatttgtcagacactgttctagaagcttgagaaaaagtgaataaaacaatgtccctgctctcacagagctcacatcctaataagaaaaaaaggtagcaaataaacaaaaaaagaaagggggtttttagttaacgatatacaaaaaaagaaaagaaaataggacaatgactaaacaatgaatgggcatattagtccatttcgtgttgctgtaaaggaaacacctgaggctgggtaacttataaagaaaacacatttatttggctcactgttctgctggttggaaggctccttccttgcatggcagaaggtgaaggggagccagtgtgtgcagagatcacagggcaagagagaaacaagagagccaggagggaagtgccaggctcggttgttttttttttgagacagagttttgcccttgttgcccaggcagaagtgcaacagtgcagtctcagctcactgcaacctccgcctcccaggttcaatcgattcttctgcctcagcctcccaagtagctgggattacaggcgcccaccaccacacctggcttctatctttttttgtatttgtagtagagatggggtttcatcacgctggccaggctggtctcaaactcctaacctcaggtgatctgcccacctcggcctcccaaagtgctgagattacaggcgtgagccaccaggcctagcccaggctcttttcaagaatcagctttctccgaaactaacataggaagtgttcacttattccccatcctcagggagagtgttcatctatccatgaaggatccactcccatgacccgaacacctcccatcaggccccatctccaacgctgaggatcaaattttgacacgagatttggaaaggacaaatatctgaaccatagcaaagaggaaggggggtatgttttaaattgtgtggtcaaggaagtcattcctgaggaggcaacatttgagctgaaaacagaatgacttgaaaaaaaaaaaaactatccacatggaaacggaaacgttggctttctctcacgaatacaagatggctactacagcttcaagcatcacatcctcacctaacagcttccaaagcaggtctggggatttccttgtatcaggaaaaaaaccccagcacacttcccttcatgtcccacttgctagaactaggttgcatacctaccctccaaccagtcactggcaaaagacactgggattggctgggagtaaccagggttcctctgctgggaccaggcatgggtatcctccactgaggataggcttcccacacctaaaccagactggcctgctgtcagcaaggaaaaagcgcaaagcagctaccacaaagatcacacttgagattgtcatgtaggatttactgaacacctgaccatgttccaggcactgtgctagtgttaggaattttaaaaagacccaggcatcgcttttactatctcactctgttgcttaaaagcactcagggggggtaactccctcttccctcctcttcaccatttcaaagcccctggactgatggaggtatagttcactgccacttgcctccctatagcccccactcacctcttcagctcagaatgactcctccctcctcgcaactcataaaccacatttattcctttgacaaatattcattgaacatctgggccctgggaatacatttttgctgaaaagacaaggtccctgccctcatagagtttccagtctagtgccacagagagatcattaaatagccaactacaagaacggaaagtgttacaagaggggaaataggaggatccactcccatgacccaaacatctcccatcacgccccactagatgttaccagagcacctcaacttgtccaaaggtgcagtgagagaatacatatttggagaaaatgtcatttaagtcaagactgaaacgatgtatagaatttagggaaatgggagtagaggtcaggttgagaagacaaggcttttctacctagaaaaatgagcatgtgcaaagggccagaggtgggaagagagagttggaagaaaggaacggaaagaagttcagcgttgctggaaaagagtaggaagagagaagaggaagaagtgtctgtaatgacaggcagaggccaggccagcaggggtggaaagcttaggacttcatcctatgggaagccattgaagggactgacacgatcaggcttgcattttggaaagggcactcttactcccgtgctccaatgcctttttcatgcttcagcccatactacaaacaggatgacaggatgaccaacaagacatggtggcaacaggctgggccagcatagtggccagagagtgggtagtgaccaaggaggtccaggactcagtgaaacatgggctatgccctgctagcgagaagaaaggcttaggtgcttctgttggggttttgttttttttttgttttgttttggttttttttttttttttgacagagtctcactctgttcagtggtgacatgatctcagctcactacaacctccacctcttgaattcaagcaatcaccctgtctcagcctccctacatagctaggattacaggcgtgcgccgccatgcctaatttttgtaatttccgtagagacgatgtttcgccaacttggccagactggtctcgaactcctggcctcaagtgatccacccaactcggcctcccaaagtgctgggattacaggcgtgagcgaccgcgccccaccctgttgggcactttgaagaatgatggtgtccttcactgagctacccagcactagatagattcatttccgacaagttgcatttgagcagcttcccacagggcaccgaacacagtgttcactaattaactgtttaaaatggcttttcttctcctttgccgcctgccccttccatatcaaaaccactcccttcttatcttgggtcacacttttctccgacaggcctatttcgctcttcccctttgcgtccacacccacatgaacaaggtaaaaaacatggtttatgtgcttcaagttctcgtcactgtgtccctggagaaaaaaacgtacttttttgagcacctactatgagccagtttcaccagccattcctagcacggtgttccgctaatgcaaaccttaaggcagccaatcagccatttaatgatgtcagtgatcaataaatggcaattagtaattgacacgaatccaactctttttttttctggaatgtcttttattcattatgaagaaaaaaaaaactcacaccctttacattttaaagatgaagcttatgggacagcacgacgtcccatgagccggcgtcggttctgggtatcctccacgtggcctttcctggacttgcgttatttaaaatatgcgatttcactacttgaggttaccgagtactaattttacaatactgtgtagctacatgaagcggctcgaaatatactattatcactccgttttaagcagcacgatgtctggatgaagcatcaaagcgagatgggtcaacttaaagggcctttaaaacatcttgaagcaataataagccatacactgaagcaggggcggttttaaacattacacagaacttaaaacaatcgaacgaattcgtcctttgttctttttattacattaattattacattaatactgtttaaaaagaaactcaaaaggcattaaacttaggtaccaatctacacaaagtcctcgaaggggcctggcttggaccgaacgcgcttttgtgccgccccgctcgctcgcagcaccctgaaggccactgagcttagggcgctaggtccctagaagcgacttgaaatgagggggtcgccaggccaggccctcgctctgcaggggaggatccgaccaaagtttgccaagtttccaggcaagcccaactgcgcaaatgccgctttttagctccagcggcaggcctggcccgtgggagttttgccccaggggtctccgggccttcaaagaaaagtcccacgaggtggggggcgccgcctgggccgccggccagggggacccgtcgccccagggcacaaagaaagagcgcgcctacagggtgtcccctgaccccggcgactcggggccagggaggctcggcgcgccccagcggccgctcttcccctcccgaacccgcccggcccactcgctcctgcaccgcggccgcctcggctcggcttttctcttgcagtgagctgagtgcgctcagccgaggaggggccgcgccgcgccgcgccggccgcggggcccagcccttcccgccgcgcccggggccgcccttcccgctggagccggctgatcgatggccctggcagcccgcgccccccgcctcggctcgcccgcgagcccggctgtgtgttttggaagcagcgcagcgggccgcagccgtgtgacgcccggagcgggcagcgccgcccttccttccccccgggctcgggcggcggcgcggcggctgggccgggcgggagggctggcggggcgcggactccggggaggagggcgcggggaggggacgcgggcggggacgcgggcggggggcggaggccgcgccgcgcacgcccagccccacggccgcgccgcgcctcgtgggacaggttgggccggcggggcggcgcccggctccggggaataatgagtgtctgtcaggccgtccccgggtgactgggcggggcggggcggaggcggcgcgggaggcgggggtggcgggggaagggcgcagggcggggtgcgtgtttgcgcgagtgactcggccgacccctccggcggctgcctccacccaagtgggtggggacccgcccagcccgggcggccgcggcggctccctctcccctccctgaccctcccaccccgggtcccagcctctacttaccccgccagccccgggaggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagtaagtcccgtctccctcacctctgctccgcaccctggtccctgccgcccccctcctcggccagtctggtttcattttttctcctggagggggccgcggggaatgggtcgggggtgcagcgctggtgttggggggggcgcctgcgggcttgggaaagtgtggcggctacacttagccggggtgggggcggagagcaagcaaggaggagggggtcacgggttcgcggtgaaaagtgaggggttgaggcgaggcaccgtgcggaccccgggtgcgggggagcggggctggcagcgcccgccgccgtcccgggcagggcgcgggcgggggctcacctgtgtggtccccggcctcctcccgcccgctcacgattccctccaaagccccagaaatctccgtgctctccgcgtgtggcaacgttgtttggagaaaggtagcgccgcggccgcgcgctcctgctcctccccctcccggtgcccccccaccaccaccacaacccaggctcccgcgtccttcccctcccctccctccgcccgcgccccccgccgcccccctcccaggacacggcgcgcggccgctcgcccgccacagcaaacttggagcagtctcccggccctctggaaagaaacttagggcaattgggattggaggcagcatcccattctcggttctggagcccaggagctgccagggcgtctggatcctccggggcaggagaaatgagctggtcgggtttggagagtcttcctgggggcatggagagaacctgccgcagtgcctggagcaaggattgcagcgtggctgaaggcggaagacgccttaggcaactgcctgcagccgagcctgatggggacccagggacagatccctggatcaggacccatgggacctacctaacatttccaagtggctttcttagagatggcagatgagatctggaattgtcatattcatttttttgggcagatagctactgacaaggagaagcacttttctggtttaaattttatagcagtatacaataatactagaagaatgtgaatgagacttatttttaataagtcaagttaaacggaaattggaaattgctcaccttcttgtatttcactaaaataaacattttacacttaaccactgaatttcttactcagaatttatgtttccattaatatcacccaagacattttaaatatattgattatattctcacaagagtctggtatatgggaaaaagtatgaagtggtattctgacaagtacctgaaatgtgccagcaaaatcaagtggggaataggccagttgttcattataggtttttccacacagcagttttgtgctatccttttctgtacgaatttgaggagcatttttataagagaaattcatctggatgatctgcctcaccctagggaagaagacttgcttttaggggaaaaaacaatctgctagcattaatatctacaaattttttggagttagtaatagtgtttaaggaaagtgtccacgagtgatttcttctggtttgaaaagaggtatgttagttgaccttaggctgttaatagaaacctgaaattagatgttcgattaaattaaactccctagagaaactggtatcttcatttctgcagtcagtgggctttgctgcagaactatttattagaagaaaaaaacctaatgtactatcggtaagttcaatgatgatacattgtaaagaacatttagcttgcatgaaagggaatgcaagtacaaaaatctcaacatgggaataacaaagaaaagtaactgcttagaccacaaaaccttgtcaggtacaaaacgacaacagagttttgcagaaagctattgttttattcactgcaaagtttctaaattaaaacccaatcttcttgttgctatgggcacagtgatgctctttttttcctttttttttctttttttttttccttacctgtacttagtctgcacacaccacattcttaaatctctgataacgtaagcttgagttaaacagtcctggctaacaaagtaaagagaaataatgggaaaggaactgtgaatggattttactatcttaaaaataacccaaagggaaaatagacattttagaatgacttctagaaattagtactctggtgtacagattgcataataatttttagataaatgtcaggaacagaatcacattcttaaaaggcgaatttctataaacgtgtgtatatgttgaacagatgagcagctctgcaaagatgtgtataactgcatttgaaaaagacagtgaaaattttgggttactgtagatgtcccacagtctgtcttggaatttagttctgtgactaaaggaggcttacagttgctccaattttggttctgtggggtaccccaattgtaatctgaattcctaacagcagtgctctatcttttttcctcttgatgcactgaggctgaaccataatcattaccctaactcggaatttgatctgagctagggactagccattggaatggggcagaaagggacaaaagaaatcaggagggaggctagtgttcattaggaaggtctctgctgcttgaatatgataaaatcacatttcacttatgatgtttactgtatgtggcagctcttatttgtaaatagggcaggtcccctgtataaagctggtgttattattcacacccgtagaacaaacacctccacccccctgttgttgtcttaaaaaactccagctgctcatgaatatagggtcagggagggccggctaaatgtttctctgtgctttctctccagcacagccagcagagctgtttcctgttctttgtttcaaggctggggtttgcgtcatacattccaagtggcatatgtgtgctctttcctgtttcaggctgttttctggtagatcagtagcccagaccaggctgaggtccctgcccctaaactccgtatccccacccatggagttatcatgtctctacacacttgatattgcttaagacgcctgtgttatgtcataatgagaagtcagttaacctttttacgtacaccctttgctccactgcatttgtctgggtgaataaatgcttttacctttttaaattttttattgctagattgtgatttggggaaacgtgggtccatcctggcaaagaaacctaaaggagttttgtttgtatttgtttgtaattcttgtgttgaagtggttagggcgtttgttttaagataggcattttgccctgaagctgtcaattttggatcaggattaacaccttacagtttagaagacctagcattatctgaaagatgtggcccaccctcgttcacgtttaacccaggctgctccaggtggcttccgtggatggagaatttaagcaatgttggcagcctggctttagtttaagtcttgcttatgtttggaaggagaaatctttagaaaaatcattgaagcaaagcctaagacattgagaaaatcccgggattatttctttttaaggacaaagatttaaatatcaggataatgttttaaggacaaagatttcactgtgcaatattctacacctcatttccaacccgtttttaagaattaaaaagctcaaaggagaactggcattaacaaattcatttaatgctagattgtttggaaaattttaatcttctattttgaaaacaagaagaatgctcttctcatttttgttttacaataatatttttcattttttaaaaatattctatcagttgtgggttaatgaatttctaggataactatttaagacctgccttaatattagttttctgttggttcttgagaaactaagatttaaggaaatatttgcttgaaaaagaaaagttttggaaagtgcttttgtaaacttacttggggattttttttttttaatcaaaaggaatcatctacagcatctctgtggaattaatttaaagagttgctgaagcagcaaatcaggctctcttctccccaaaattgatgataatggtgcgttttaaatgtcacattccaccacattctttatgtataaatggaaaatataaaatatgatattaagagagttattagtatcaaatagttggctactgataaccttctatgaaaaaagctgggagttttagaagtcccaataacttctttctcctttgggaaaagcagctggaaatacttagctgacctgtaggacaagagacttttaagcttaaaattcataagtaactccaatcgaagcaggtttttttgtttgttttggttccaaagttgttaacaatctaactaggtttggtaaacagagtctttatttggctttccccaaattctttcttctctcttttgcagggagatgaagtggttaatagagataattagggtctaatatattctatcagaaaaaaattctgcaagcttctaaatgctaagctgaatagttggggaaaattatcctatcttatagttgctatgattaccagaaagatgggaacaagagttttaatttcttaaccatataaatcatgattcctaatttaatttcattgtgtctccatcgccccttgagatacttgccttcttaatattttcaaatcaacatttttgctataaaacgacagatttcttaggcagcatttcttgttctctgttttcacacccagttgagtttaagaaaaataaaatacacacaacctcattctttaaggtactaggaattacaattacattattctggaacttggattctttctgaagtgcatcatttatcattggttctagctttttaaaaaagcaaatccctagaatcttaaaacaattgatatctagtttgctagtatgtgatattctagtcagaattcctcttgggagtgagttggaagagggttatggtggtcgctagcattctcattttcaagaccactctgttcctttcttagaccatgtttctcatcttaagcagtcatgcccgagctggagacaggaaaccagacagcagtctgccctgataagggacagcattgtctgaaggcggggaatagccctgcttttacccccaactcagctctctttgcttgaaatttagtagtcatagaagaggcacaatgctgttgacagtttctgaaccaaaactaggattcatttcttccaaagcaaaaaaatagtgtcctcggccgggcgcggtggctcacacctgtaatttcagcactttgggaggccgaagtgggtggatcacctgaggtcaggagttcgagaccagcctagccaacatggcaaaaccccatctttactaaaagtacaaaaattatccgggcgtggtggtgggcgcctgtaatcccagctactcaggaggctgaggcaggagaattgcctgaacctgggaggtggaggttgcagtgagccgagattgtgccactgcactgcagcctgggcaacaagagtgagactctgtctcaaaaaaaaaaaaaaaaaaaaaaaaaaaaaagatgtcctcttaactggccttgtccttattctgtaatgaatgtgaccatattctctggaacagtaagaaaataaaaaaatgatctgtgcattttgtatccgttggccagagagtttgtagtaaaattgtttctttagcaaaacaggctcctggaggtttttgaaactcactccattgtgtcggcaggctgaattcattatcatttctccatctaattatttagaagggctggagacagaagagagcaagttaagtggccctctagcccatgcatttcatgtaacccctgggtctggctcttaccctgtttcctgtaagggggcgctccctgaggcagaccctttgcaggaggacccagaattgccctgcttagtctgggacatcctcaggatggttgccagtctctggaaggcttgtggatcctgccagggatggcccagagctagtctcaacccaaatcagtggagtttggccaaatctggacataagagatcaaatgagtattgaggtcagcggattctgccctggagagcgacctgcaaatcaagtgtggggttttttctctggcctatatgctgttctttctactaccactgttgtttaagtgtaatcactgaaatccactcctttatctgttcctgtactttgcatccctggtaccttccaaagcttcacactccaaagcctctttcatttgtaagatcgagttcctgttccgctgagtttccaaaccagggagtttttctctcccaggctcccaaagttttcacatttactttgcattttagaagatgaggtttcaggctggcttcaccagccgctggacagagtttccatgtaggacacctggtgtaccatcattccagggcccttgcccttaatttatcctagcatgtgagaagtgtagtttgacatccattcatttattcatctcacaagtatttattgagtacctacttattagagctaatctcaaattatgtgcaatcattactctgagttatgccataggatggagtagatctacagtgatctaacctgaaaaggcattttgaaatcttaattgcctgctggaacctccccctggcactgcttcccatgggccagtgtggctgtgcacacccacaccctccctactggggaaagaccccagcattaggcgattttacctaaaagtcggtcccacagcacaggctctgaagcagaacagaaagtgcccgggtctgcaggcagacacgcttctgttcctggctgcagctccaaccagctctgtgaaattgggcgagtcatttcacctctgttcctccatttcctcatttctaaaatggggatgaggacctgacccttccacctttgtgcagttattatgaggatttccgtatttacttgggtcaagctgccaatttttctcagcagttatatcgacaatgcaggtgcactggctaggaagaataattgcctaatttggggccttcagaatgtgtcttttgatcttgcatccaagtgtgcgtactgagacagggtgggcagcaggggccagttggaaggagtggaaactgtcactaatgtaaacagactgtccccacgttctgtcttctccggggaccaacctgttcacagaaatcactatcatgtacttactgttggtggtgtaatgttgtcctctgcctggggaggtggaagagtggtgtgccaaggccaccagtcttaagtcagactaccttgggttcaagtcctggctctacgagttagcagctgtgtgatgttaggcaggttacttgacctctctgtttcagtgttcttttcagtaaaacgggaaggtagtaaccacctcattgacattaaacagcgcctggggattgccaatcacgaaggtggtggtgattggcaggaaacctgtgacatcacttagccccttgccttccttgatcccttttcaaaaacctgtgtttgtgcacacaccccttccccttgcagttcccccccacctgcctcctctcctccctttctcgctttcttttttctattttagattttaaagtacagtagagacctcgacactagacttgtttagaagacctcactgagtggataataataaattatttgaagatggtactaataaggtctctggagtacacatgatgggccaggctaaggttaggggcaataacttttccttaggaagtttggtttactaggtctcccttagagttaggcccttcatccctattacttgtttaagggagatttcaagtgcattcagagggaaagggagatgattgtggaactcctactataagctaagtgctcttatgttagctccttaggcttgacataaaaacttcattcagggaacaagcccgatctcctgtggggagtggggagggagccctctcaggaaggctgaggcctgcctgtctgtccttcccagtactggtggcggtgtgggacgcaccactgggaaagctaagaggcctagactatctaggtaagaagaggcggccttggatcccccagggagcaatcagctggctgcacagagtggggagggccttgagctggtctttgaagaattagggggatttagataagccggaaggggagggggcattccattgccggttgcccagcatcagggccaaaaatgaacaaaggcctgggggtgggcagggcagccggcatgaagggcacttgttggagcagggggcagctcgtgggtaacggggtgccaagcatgggtgcctgagcccactgtcagacccggggagtgcacgggagggaaggttgtgagctggagaaggatgggatgagaagagatctgtgaaaaacgtgggtggcaaggggtgagggctggactggagaggctgagggagaccagtggtggaaaagctgcagcaatgcaggtgggaggcgctgagggcctggcccccaaggcaggaggggagagcaaaggaggtgaggaaggcttcagagatggcctctaggtttccatggtgaaggaccagaaaataaggccaatgggaggcggggagggggcagccttagaggcaggaacaaggaggggtagggttggtttgggccacgttgatagcagtggttcaaaatgcttttctctttcttttctgcttatttttaaagggagagggtaggcttcgctcatggttttgtatccaaagtttcagtggctctctgggaggaacttcagtggagaatcctcaggagcagaggaatgatcacagccccatggttccttctggttatttttaagattctaaccatccctgttcaggccggaatttccaggaactggctgctgcccagcgccaactggtccctcccaacctcccactccctgcagggtggggccccatgggtggaggctccttagggtggagttgggtgggtctccagtgatagggagggcactgagcagaggcagatgagaggcagtgtggcctcacgcagcccttctggatttgattatataacacttcatagaggagaattgtgagggcttaggcgaggccttgtgagatatgtacacagcaggattagacattatgggtatttttcaatttatcttgggttgcctgcccttaaaactaaaacacaaaattgtcagagagcataaacaagtgtgtaaccctagtagggaaaatgattcgagtttgctgcagtttctctaagaagggtgtggaatgccactagccagatggccttgaacttagagggtagcataggtgtgggtgtccccgcccccagccctgctttgctaggcctcagtttggaaacttgtcaggcttctgcttggttgttacctttgcacctgtccttattgacatgcaaaatcaattgcttcacttggtctttccgaagtacagggtgtgggcagaatcttatctgaagccatgtcctgtttggacaagttggacttgccttggcaactctccatagggtggagcagatgggtggaggcaggaaagtaaaattgggtggcttgttagcagagagaggagagagggtgggttgtttgctcactggatcattatatttcatctgaaatgaaataattaacttctttcccatttataatacacattaatgcaaaataactaattcatgaggggcgaagatttagaaacaccccatggaatttttctccttttcaaaccagtcatagaagagtaggacaggtgaaaatcacagagtggcatgaaaatttccaagaatgtctaggtaggaaattccaggtaggtgccagtgcttagctttgtttcagggagcctccagcttaaaaatgcctgctgacatctgttgcctgtcccctgtatttctggctagggcaactgtccttaaataatacttgagccattgggggattttgaagaatttgggtaaagaaacgaagagagaaaagtttctctggaaaggaagtttagctacagggatgttgcttgcctgcccagttttcctagccaagaattacacacacacatgcacacaccgccttttttttttttctttttttgccttaagttcctttggggagtaagggtaggggaagataacatgttttctctttgaaaaatccaaaaacttagaagagttgaaagggaggcttagcgatggtgtgttagtgtattgctccgtatgcctagccgaggtcagctgggagacggaagtttgcttggaggaaggcaggtgatttggagcctcggggtcagtcctgggttggggaagataatgcaggcaccctttgaggatctgtgggaagaaatgagggcatggagaaaggaagaaatagggagatgagaagggagaacgtcagaggcaggtcttgctctaaccccaagaaacaggaaactgctcctgatacgtacacattctctctccaccttcctcctccctcaggaaggggcaggcagttgtctgtaaggtcgtttctgtaataaatcatgctctagcctccaggcaagctgctttcagaggaggtttagtaaccccctaacctcgtcttccatgaaggactgtgtgtgtgtttctaagccctgcagctcacctgcagccccgctccccactccataaagccattgtgcataggtctcagacaccactggatagggctccaaagcaggactgcattacttctgaaacttcatgtcaatgattcaccaacccttttaatctataatcacgcagtcttgcattttgacagaaatttgacccttattttaacatctgaaaagtcagaagtgcaggtggaaagagcatgaagggaaatctgtttctcctttttgaggaccattcatttttattggcctttctctgcaaaataacacagctggggaagatggcatttgctccagttatggaaaattattttggcggtggtgatgttcctgtatatttttgcttttaagcacctcaataacttagaatttttcataaaaacaattttgcccttccccccccttttggatgcagttttgttatcctggtattgcttagtttagcattagaatgtatttctaagactagctaatgtatttctaaagctagctaagctagttaaatataatgaagatgtaaatgtgtttatgattggaaaatagtcgtcagaaaaaaatagaaccacatttagagcctcctcttctctgtgatacccacataaaatgattaatagaattcctgagcctggttaaaacccactaggtttaaagaccccgaggttggccaactggattgatttactgccggtgtcctggtctctaatgcctgttttagtgcgccacctactggttctgcttcagattgccgtcagtactgtatgatagattttctaagcatttgtggtttacttagcattctttcagaatggtaataaccccagtgcactgagccgcccatgggtaccaaagactgccaagtttagggaccctaattcttccagggcttaagttacttctcagttatgtggaaggcactttgaagactgtacagtcactcttttatgattgtagatcagaacctgtaaacaaattagtaccaatgacaaaagtggtccctgtagtcagagatatgggtgcaaagtatagaaattttttgcaaatacataaacagaagcctcatttctgttcatgtgtttgattctgtttctaaatttagttccttcctagcttggcttccctatcttgtctttgttaaaagttttgattatggaaataataaacttggccgggtgtagtggcttacacctgtaatcccagcactttgggaggctgaggcaggcagatcacttgaggtcaggagttcgagaccagcctagccaacatggtgaaaccccgtctctactaaaagtataaaactaagccaggagtggtggtgcatgcctgtaatcccagctactctggaggctgaggcagaagaatcccttgaacccaggaggcagaggttgcagtgagccgagatcgttccactgcactccagcctgggtgacagagtgggactccatctcaaaataaaaatacatataaataataaactttaaaaatagaacacagatgtgtagaaagctgtcccacccaccgccactcccaagaagctcctgttaacagtttcgggtgtgtggttccagacgttttctttgcatgtcctttatcttcttgttttatatcctgtgactatcactaaaagcatcatcatttaaaagctattatcagaagctaccaaattggaaacaaagtgcttgtagacatgtgaaatagtgagtttgattctattctttgtgatatttgaattttgcacggactttttttttaatgtccagggatgcattatttagttaggaatttcaaaaataggtattctaatcctatcattccttctttgtttattaacttaaatacttctgtaatgagaacatcccttcatcaacatttggattactttgaggtacatttctgggcaaataaacatacccttgtaattattttttagtaaaagcaaatcaggttctgttagtgccagtgtgtttttttttttttttttttttgagaccagagtttcgcttttgttgcccaagctgagtgcagtggtgctatttgggctcactgcaacctccgcctgctgggttcaagcgattatactgcctcagcctcccgaatagctgggattgcaggtgtgcgccaccacacctggctaatttgttgtatgtttagtagaaacggggtttcaccacgtcggcaaggctggtctcaatctcctatcctcagtgatccacccgcctcggcctcccaaagtgctggaattacaggcatgagccaccacgcccagtcagtgccagcgttttatactagactatgtttctcttaggattacaagtcttgcatttccttaaacttagataaaacaaaaaattaaagaacaatagtgatttaaataatgtcttaatgataaaaagatgtagcacattaatgtgtaattcatttctaaaaggattcagtagtcgttgctgtgggcattagacaaagtcattgaaagctatgtgagctaaatggtagacttagaatttgaacgaaaaggaactccagagcccatcatcttaatttattctgctgtgctgcaattagtggtcgtaaagcgtgcaggatgacatgaagtggggagatgctggcctcgctcagaagctgttgttgcagtggtacagttgtgaagtgacaaggccttatatgagacctcatacaggatgtaggcagctgttaactttgaaactgaatctagtcagagttttatttaagggtgggggatagacctctaaggctagtgtatgttagcaaagaggcaaacgccagacatttttgctccggaagttggaaccaacacatttagtgttgtgtgtacagaatatacatccagattttatgtgcatatggatataaatgagggcaaaaggagtgtgtgtgtgtgtgtgtgtgtgtgtgtgtgtgtgtgttttaatctcacttgatagacctaaatccttgagaagcagatagggagccatgctctgcattttacaaatgatcactcttgccccatggctgcgttagtttgcagcctgcttgagtctcaaaaccatggctccttccttatacacctgagaatgtgaatgctttaatttagaagcatttgcatcaagatactctctagtgggatagatgagtctggaagagtgaattcagtgtaaaaagctgggggtgaggaggtgggaggctgccacagggtgaccagccgtgagtcagggctgctaaatgatctgacctcattgatgtaagcaggagatctcacatcttttgtttatggtccactgtgaggcactggacaacaattcttagaaccatgttcatccgtacagctgctagtctgggaactgcttaataatagatcccaagacacaaaagcgttttcatccctcattacgaaatcatctatttttcactggctgttgcggttagttcttgctggaatacataagagggtagtagcactattgatttgagcagcttggtatcaaattgtgtttgcagattacaatacaccctgtgatggaggaaaatataattttgaagtcaaggccttatgtcgagttattgatgaaattcgtgtgttgtcatgagattcaaaacaggctttcttcaatgaatcaacgaagcacaagaacgacatagtatcacttccatcattgtatatgaagatatcttagtataacccgtagagcaccaacacaacaaattataggattgctatcatggaggtggggatgggggtttttaacactgaaatacaagaaggaatccagaacccgggattcctgcagcttcttcagctggaactcactctagaacttgttcactttgccactcaaaccagggtgatctatgaagaccttacctctaaccaaagcactgagcacttaaaccaaatttggctaatgagtgcctgaagtcgatttctgaaagtgtgtctagtagcaggacagtgtttctgtaactgaggagacacatttgaacattgagcagactgaatattttgtcctgtgaagaagcagttggcttgatgtagattagtgttagaagtggactgtacagaacacagaagaaaatagaagggatggcaagcagagaacaacagaagaaaaagacaggacaggatcaaggtggacatttcctttacaataggctcatttcctaatgaggagaaatctgagtgaaaacaagctaatattcttcatatgtgaaaagtgcttagaaaacaataagaagtggtggaggctgtcaagccctaagtaggcatttctcaaaagaagaaatccaaatggtcaatagagctgaaaaaaaataacttcaataaccaaatcaatttagaataaaaatcatttgccatcttgagacttaacaagttggcaaggtgtttatcttttataacacaagtgataacacatgttgctggtggaggtttggggaaacaggttgtattttattaatgaaaataatagttcgtctttgccaggtgatggcatcaggcgctttgggaaatgtatatacttctcacccaggaattcccctacagaaaacttatcctaaaaattaatggtgtgcaggaggatatatttaaagaggctcattgctgttcgtaatggcgaaaacttagaagcaaccctaagtgcctaataaagaggaagaagttaagtaaactgatgtgttcacacagtggcacgggggatttgatggtgcagaaccatacttggtgcagaaccatacttactgtaaaagaaacattttcacataaattgttcagtgaaatgataggtactaaataccatgtacactatgagcccagttttaaagagggtttgttagaataaaaatgaaattttaatgatggttggttctaggttttctttttgctcgtctttttttcccctaatttttctgcgaccaacatcggggaaaagggaaggtgtttaacggtcatatgtaatctgaacccctaaagagttgcacggcaatcccaagcaagctttggcgctcagaaggggctgtacatagtgttccagaaaagtcagggtttctgtattgagttagaaatgctggttggctctcatctggttatgaccatggagtctggttttaattatgtaaatggcatctttcataggtaagggaaacaaattccagccattccaggggtaggggagaaaaaggagtagagaagtggggtgaggtattatatttcattttattatttatttatttatgttttttttttgaggtagtgcctcgctccatcacccaggctggagtgcagcggtgccatttcggctcactgcaacctccgcctcctgggttcaagcgattctcctgcctcagccttccgagtagctgggattatagacgagtgccatcacgcccagctaatttttgcatttttagtggagacggggtttcaccatgttggccaggctggtcttgaactcctgacctcaggcgatccgtctgcctcagcctctcaaagtgctgggattacaggggtgagccaccttgcccaggctatattttatttttactagtttgtatttaaagtaaccttgagacttagatggataccttgttttgttttctaggccaaacaccagagcaccctagaaggtttaactaaaagaatgctcatgtttgacccagttcctgtcaagcaagaggccatggaccctgtctcagtggtaagttttccaagattgaacacctcgccttattttttccaagtgatgataacattattgtgtgttgaattattccttgaaatcatggccgggcgtggtggctcacgcctgtaatcccagcactttgggagaccgaggcgggaggatcacctgaggtcgggagtttgagaccagcctgaccaacatgaagaaaccccgtctctactaaaaataccaaattagccgggcgtggtggcacatgcctgtaatcccagctactcgggaggctgaggcaggagagtcgcttgaacccgggagatgtaggttacagtgagccgagatagcagagatcgcaccattgcactccagcctgggcaacaagagcgaaagtccgtctcaaaaaaaaaaaaaaaatcactcattgcttgacaggcatttcataggcaaacttttctcaacgccaccaggtatgagtgagctaaatactgtcctagcagctgtggatcctttaaatgggatctgcgcttccttaagacccgtgcccggtgtccccctaagatatgatcagcatagaacttaggccacaggtgaatcctctcatgacagaagtaagtttacaaaaattcctcagcccttttgtgtgtaaaaatatattaagaataggatgatttgcttaaaaaccaatgacaacagccatatggagctgtaactatatgagatgactgagggaagccagcgagagaaagacttggcagtgaggacggaatctcgtttacttggaagagtctggctgggtaggaattacgttcattgtccttttcagcaccttagcgctaagccagcccctcatgggagccaggccactggctgcttttaggccgccagggactagtgaggagtctggggtttctgcaggtacaacaccagtgccatgaaggtgagacatggtgacagaggaaggtgtctgacttcagagcagggagtggtttcaacttgaggattctggttgagtgaatattgaataacaaggcaatgctcccactctgtcttgctcttttcttccacgggcttggaaaatattcacaagggggaaaacttggcccgaggtgtgtatctgaaggttggtaatgacacgcttgcaaaattagatcatccttgtgcatgggctctggaggttcctgccaaaaatgtttatacaagacacgggggtcacgccgaggcccttggagctgagttgccatggatattactaagccagtaaagtgtttaccagtatctataatgcaagttaagtcagaggggctttaaggaaataacatttacattccagcatgataactgaataaccaagtgtctgaatatggtagcaactgagcaataaggattttattaatcaaaaaactaaattactttttgagatggagtctcactctgtcgcctaggcgggagtgcagtggtgtgacctcagctcactgcaacctccgcctcccaggttcaagtgattctcctgcctcagccaccatagtagctgggattacaggcgcatgccaccacgcccggctaatttttgtattttcagtataggccaggtttcaccatgttggccaggctggtcttgaactcctgacctcagataatccacccacctcagcctcccaaagtgctgggattacaggcatgagccaccgctcctggccaaaaaactaaattacttcgaatgttattcagtgctgtcattgtattcatcaaatccccctccccggcatcactacatgatcacgttagaggaaaatgaaggtataaaatttccccattagttatattcttgaaataggaataggtttttagcactggagaatatgattcattttacaattggtgcagagccatcagtgaggcattttactgttcaatgtacctccagtgcttttaatcaagcatgaacataaggctcaagagtctaatataaagctaaaatgaagatccacattgctaaattggtgtgatatatataattaagtgcaaggaaatgcacttaaccgaaaaaaaaaatgtggaataaaatgaatttgaagtaactgttaaacttgtattgttgtaacgtagtaatacatgaagttaaaatatgtagaactgattttgcagttaatggtctttttctccttcatgtgctagatttcaactgcagctgacacttttagaatttagtttcaccaaaagttactgtcagtcctttaaaatgaaggtgtttttttttctttttctttttttggttttaactttcttcagcaggaagtatttttttcttaattcagtgcaacctcagttaacagaaacatttgagcagtggggtgttaaaatgattttacttaaacaaattaaaaagcttttgtttccactcttaagtgttcaaatttcgtctttcctgccttcataggtgaagtatattgaacctaatttattattcctttttctttttaattcagtctttgatctgaaggtaaaagtctttcgctattcaagtcaacgttgtaaacattaaggcacaataggacatttgtaaaagtatttttaatttctatagatgaataaaaatattttatggtaacttatttctccccctcttcccaccccctaaaaggatagcacagcagaaacaatcgcttgtttgtgcttttgctataggttagagaaagtgaggacatgtcatttccctcttaatcaaatataagccctcatactgttctccactagccttgtgctttgaggcttggggtcaccctgttaaaatttgctagaatgaggaacagaggagactctccctccccaagtctgtgccttcagtctctgctacttacatccacccagtgttggcaaaatcaccagcagctccccgagcttctgttttttttttttgaaaaaattataaaatatgaaactgtgtgtaaaaaaatgcgcatgtacataaatttttttttttaccatttcccaaaagattgaaaattaaaggatttaattcaggaagtgagcaaggaaacaaattgtaaaaaaacaaaacaaatcaaaaaacaaactttaaaagtattcttctattcctgtggaaagattacttttgaagaaaggattaataatattctgttatcttcagtcatctaacagactccttatagataggaaagtatgtcacatcagtaatttcctctgctcttttctaacagaaacttttcatggctttttcaagcctggtggaaagagagctttctacctctgtttgcatgggggtgcatgccatttgctcttcccagagtgtgtgtttatacacgcaccatgccttcctgtgcctggaaccctctcttggatgaagattcttttgacttgacctgtaatggacattcactttttttcatgttgaggaatagtgaaatagagatttcatccatgtttccgtcattccgtccactgaaactgtcttataatggaaagctcgccaaaactattcctcataaaatgagaaactattgcaattatcaccttagcataaagtgatagagctttgggaaattatccaaacatggtacctctttccctgttgcaattaaaatcattttttcaaagttcaaaataattagtatattattcttcaccttatcagtaataaaaacctgctaagagagtgtgtcaatttactacacattcatcaagtattaattgagcacctattgcaggccctcatcacctcacagtgcagtgagaagcagcagtcaataagtaaatgcacactgtgcaggggtgtgaacatctgagtacatgttacagacggaaataactcttatagcagatcagtggttttgtggaggtttttttgttttggttttttgtgttttttttttttttttttttggtttggttttggttttgagacaaggtattgccctgttgcccaggctggaatgcagtagcaagatcactgcaacctcaaacgcctgggttcaagcaatcctcctccctcagcctccccagtagctgggactacaagcaagcaccaccatgccccgctacatttttgtttttttctgtagagacaggatctcattatgttgcccaggctggtctcaaactctcggccttaagatatcctcctgcctcagcctctccaagtgctggagttaaaagtgtgagccaccatgcctggcccagcccattgttttaagcccttaagatccctagtgggggccagaggcagaagcgggaaagacccatgtctgtgtcttgtctttggactgctctgttccaggacacagggtctcttggactaagcagcatgcacagagggcactggaggtccatccgtggccagaggcacattttttgcttcatcaacatttgtctctgatttggatatggggccagtacagccgtgcttgtatgcattgctttgatagaacataggaactgtctggaacagagcggggaagactgttaccaggttgtacctgcccagagcacacaccctgccgtgtcagtccctacacggcaccagattgttggaagctgattgcaaaagcttgtgtgtgccacccaaataaagtgaaccagcttgagggaccacatgtcttcacccttttgtgaggcagttgggctggaaacagttaattatctgcccagagttgggtgtctgtgtccaaatgtgtctctccccacagttagtcttgtaccttacaataatcgcacatccaatagagggaatgagggcattcatttgagaacagacttatcagcaaactgcataatgttgataaagcttagctttatgtgtggctttttctgtcttaatggcttgagaaacctgagaatattattagatttgcaaatctggaggttctaaattcctactctcccaaaactcaccccatgcatagaaaaatccagcaatgacagcaataaaactgtgtcctcattttgcttcccatttagctgccaataactattggcattaaaatctaggtcatagggaggtcttggaagaacagggctgaaaataagggagaagctacattttcgtcaatagaaacaatgctgcctcccatttcctaaagttttttcctagtaccagaaccattgccctttggagaattatataaagcacattagactttaggactaggcgaaatcattctccttcctatatttaattactccctgaaaccctccagtgtacatgatttataatggatttattttgttgtgttgttaatgaaccttgtgcctcttttaataatacccatcttaatatttaaatttaaatctatttaatacttaatgttgctatcttttggatctcttgcgttggtactgtgcgtgcctggctttaaagaaaggtagagaatcttttcttcatttgatccttgatctataactcaaagctgtttttatgcattttgtgttttctgattttatatccttcatgttcttgtttttaagcagtattagtagtgaaaactggctgcgcgtggtggctcatgtctgtaatcctagaactttgggaggttgaggcaggcagatcacttgagcccaagagtacgagaccagcctggacaacatgacaaaacccagtctctacaaaaaaatacaaaaattagcgaggcgtggtgtcatgtgcctgtagttccacttcctctggaggctgagttgggagaatcatatgagcccaggaggtcgaggctgcagtgagctatgatcataccactgcactccagcctgagtaacagtgagaccctatctcaaaaaaaaaaaaaaaaaaaagaaaagaaaattctttttccctcctttaaatagacctttagtatctttattttttatctctgtcatttagagcattgctattcaaaaggtagcctaagttcccttggtccactccccggtaattcaaaatttgcattttaacgagtgctccagggagatggatgtgcacagtaaagtttgagaaactctggttgggagcagtagagcccgtgacagtgagcatctcttgtataagcagggacaagaagggatttccaggatggcatgtgtataagctcgttgtgtaggttatcccataaccttgatcttaaccatgaggacctgacatccaaaccagataaagataaacacagttatgtgataaagtttcactgactgactcctccctaacaggctgctctgcaggcctggagcagggactgggcatctggaattttaaaaacaacacagatgattccaatgcataaccagccgaggattcgcccagaccaagcccagagaggaaagagggtgatctcagtaggaatccctatcaaaaccactgctgccccacagtcataactcacaatagtggccaccagaggggccaaggagacccagaaattaatagtgcatttacgctgtttaattacaaggcaccattgggttttcttggttgcatcccaagttagtattgcctctaactcttaaacacatagggttttagagctggaagagaagcacaatatgttgtttatcactgtcactgtcagacattcaagtacaaagaattttctgcaggtaagcaggcttgacatgcaaaatttcagtttccctaaaatgcctagtaaagatgatggtttatgttgagtttaatttttttaaattaaaaattaggttgcattctacaaagaaaatttacaacaaaatgttagttaaggaatagaagtaatttaggtgaactccatggtcaaggatagtgcccattgtgtgaaattatgatgactggtttgtatttaaagctggcagatgaaagttaggttatcctgatatttaaagagagaaaggtgtttgaagataaatgaggtcagttgtggaccagatcttgggaaggaaacagactcttctgtctcttctgcactcccttgtttgtgccccagcctcatttgatgagtgggtagcagggtatagaggagagaacacagggcctcagcttgtgtgaatgactttgagctccacatttccttatgtgagtcatatcacgttagctgtttcttatagttccgtgtcatccacagacttgccattcaagtctacagcttcattcagattctgaataagaacactgagcaagttagggccagggacatcattgccgcagtgagggtggccttcagtacaaaggtgtgtatggtgactgaccccctcctggtttgcctgagactgtagagtttcatgggatgtgggactttcagtgctgaaactagcacagttccacgctgactaggattgttggccagtcctaggcatggattgtacagctgctgaagcccatcaaatgaaaggtactgcctatcctgcagccccattcttgcttattatacacaagtatgatgagaaatcaatgtcctgctgaagttgaagacactacttatcctgagaaagagctgtcctgccgaagttagacatcaaagctagagagcatttcctgctcatcaagaaaccccaccagaaaagcaaccaggttggtttggcttgactggttcttgtgatgcccacctctgactcctaatgataatggcccccaagcctgtgctatcacctgtcttagaattttgccaggtatcggccttaatgtttgacacaggaatcatcttaggattaaatttcagatttttcatctgcagtagtgaccacattgatcttagttttaatatttttgagaccgcctctcatagcatttttaatgttgagaccacctctttgagcatttttttaaggtcacatatatatcgaaatctaaactattttgtaaagcccatgtaattgttaagtgccttgttagcatatttttcttaattcatgtttcaagtaaatggacttatttggctgttgacacgttttccttttcttttctaatagtcatacccatctaattacatggaatccatgaagcctaacaagtatggggtcatctactccacaccattgcctgagaagttctttcagaccccagaaggtctgtcgcacggaatacagatggagccagtggacctcacggtgaacaagcggagttcacccccttcggctgggaattcgccctcctctctgaagttcccgtcctcacaccggagagcctcgcctgggttgagcatgccttcttccagcccaccgataaaaaaatactcacccccttctccaggcgtgcagcccttcggcgtgccgctgtccatgccaccagtgatggcagctgccctctcgcggcatggaatacggagcccggggatcctgcccgtcatccagccggtggtggtgcagcccgtcccctttatgtacacaagtcacctccagcagcctctcatggtctccttatcggaggagatggaaaattccagtagtagcatgcaaggtaaattccgccactgctccatgctgctgcacttgcttagcgtactggcgcttcaccagatggggtgggtgaggaagcatgggggcaagagctgttgaactcttcaaaggaaatactcatctgcctaaggcatttccttcccccgcccccccaaagtgttgatactggaagagatcccaagaatcaggctgtctgtttgataccatgacatgattactttcactatgtaatggtcaacttggggatagaaagaatcttgactttatgttgctttcttgaataccaacatggttctaggtacaaaaggcatttaataaatcctttttgattgtggtgaaaactaatggtgatcaaaagctaccttgtttatcagctggtcatagaggactaaggggttgaaaggaaataatccagaattataagaacgaatcatttcagggctggtgtcttataatctaggtccctatatttgctgcttactggcaaaataatggtcaggagaggtgagaatctcccacagatttgttcctgctatagtctgccaaaggcaaataaacctgtcatatctgtgttgtaggtaggagctatgcagtaagcttttaaaagctgaaattggtaaactgtacgtgaagtgacttttctatttttattttttagtacctgtaattgaatcatatgagaagcctatatcacagaaaaaaattaaaatagaacctgggatcgaaccacagaggacagattattatcctgaagaaatgtcaccccccttaatgaactcagtgtcccccccgcaagcattgttgcaagagtaagtatatttaggtctacccagcatttgcatagtagtgtgcatcttggaacctggagcagaagcacaagatttcacacgtgtgatgtggtgtggatgaccaggaacggcttgtgatctgtggccgccactggtccagtaccactggtcaagatgggagaatctctccaaaaacaatatgctgttacactgacaacgttatgacaaaagttacatcaagttttcatggaatcagtcatccatgattttgcaccttaccacatgaattatttttgttttttttccattcttccaggctatgtatacttagtttttccattatgagaatccttgtatagattaaacttggtgttctgtggatcatgtaaagttttcatgtggacacacatagtccttacagagtgtatagtatcctgtagaattgctatccagtaggaaggctgtgcagtgttggtcagcatccaagcacctgaatggtggtttcttgtaggtctaacatggtataatgtggtagttgccacacacagcttcagtaacctcatttgtgggatcctgctgtagataaccttgacctccaccagtgattacactgaaggctgggtttgtagttgctaagaagatggttttcgggtccaacaaggatcccacctctgctctctgccatatgtatgatcttggactagtcacttaatcttgctgccccatttctgttttcattattgattgtagttgtgattgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccccgctccctctcacaattaactctacagcagaatgtgaattctctgattttagaataactattttatggtaacttcaaatatatcctagttgtatccacattcagcttgggtaggtaccttcatagtagctcatggattaattgtccactgcacccaatcatagtcatttttggtttgggttgtcatatgctccccaatagatgaagaagagaataactcttagccgacttcatcagcaggtagggagagagtctctgatggagttatatttcattattcctcacaattgcatagtgccctcttacctcaaaaaaaaccttcccaggtgttttcaaaggaattattttattcctccacaacaagcctgtgggagtcggagcaaaaggcaaagtgattacctgagacattagataactcgccaatattcaccctgctaacaactgaggggccttgggcttgatctcctgcttccgaatcagggcttttcctgccatcttgtcatatccaacccattgcatctgctcatgcactcaagtgaaaggaaaaaatgactaggcaaaatggacacatcttagaggtggaattaactctttttttatgttgagggatgtttctggcaaggtaactagcaacgtggcctgcacttatagttgttcctgcatgggtgatgaaagagatgctataaaactaaataaaaccaactgcctccaagggagggatccgttgactggacaagtgttattccaaagtctgggttattatgagttgcaacgtaaaacattacataagaagatttgaaggcaatattctgtgctctgaatgctgctcaaaagaaaatacttttattttaagtaatattcttttgatgatctcaagctcagtggcttttaatgattaatgagtaatatgcttattttaatgctgacctaagaatacattctgcttctcaaaaaaacgcaacagattagccacagctgggacatgtactctttaagtaatgttctcacagatgtgattaagtaacgtcttggagtatgcccagtagcagcccacgtaggaaaccagctagccaggaaagaatcacttgaaactaggcacccagtaccactgcagtgaggcagccccaataatatttgccttaagaaacgcttcctttccagaggcagacttaaaagtacagctttgaaatccatttgctcgattgtggtgtggcaactttaggattatttataaaggcactcaaaggtacatcaaattctatttgttacagatttacaaaaagatttctttgttctaaatatacaaaactatatttagaacaaaaagcataaggatcagatttccctattgagttgtgtatgcgaattatagcaaacttaagaggggctgtctcagctcaaaacagtggacaagatatcttatatgtattagctctgtaacttcttggttataataatcccaaaccatctctttgaaaatgggagtggagaccaaaaagtgtgagatcccaagactcttcatctagccttggcctgaaccaacatcagcgtcttcagagatgcggcaggttaactgtgctcagaatgtttgagggacacagctcaagcagagatatcctggtttggggacatcctcaaaaaactcatgaaattaaacaaccatagggtacaaagttacaaatagactattttgaacctgaaaatattcatggctaccatttatagctttatcttgggaacagacattgttccgagatataaccttctgagataacattattatcatccccagtttacagagaggaaactaagacacagagagggcgagatcttggcccaggatcacagagactgtcagtgacagagctggatttgtaactggagcccacagcctttcggtgcacctttatgtgtaaaataaacaactggaaagggcagtcagaattactgcacagaaacgattagattcccaacccataaaatccaataattgggagagatttctaaagttatctgaaaaagatagtctcccagtatcccaaagacatataaaagttttatagttaataattaaatttctaccccagcactttatttcctgaatttcttttaatggaaatgaaatattttcattagatggcattaaagctgaaagttaaaaataaactgaacttttttctttctattgaaggattttaaatgaataattcagccttataaaaactctgtctgtaaacctctcactttgctgtgttctctgctgtttgcacatatatatatatgtatatatatacacatatatatacacgtatatatatatgtacatatatatacatatatatatacgtgtatatatatgtgtatatatatacatatatataattgaagtcatttttcttttctccctcctcactactttatgttcacttttccatgtatctaaacttggcctattttatccatctctaccacccttccaggtattagagtaggaaggtgagagtcaaaactgacagtttcctttgctcataataaagcatgagcagtaaataaataatgttttttttaaaaaaaaaaagcatgagaagtaaggtcacttaagaaacacaccttttattctttttctagtcacttcttagcatgcctgaaaaagtgattgacaagggatgtgtattcaaatatttaccaagacaagttttataccaagagactcccttttgatttttatggataaatttcttttattctttttttaagctcacgagttagagtgtttactctcatcaaattctttttttccttttcacacaccttttttctcctcaaacacttaggcaaaatattcctgtattatatggaacattttaggagctatagattcaaatatgaaagagaaagaagtctttcattacagttagaggccaatgacatacacttgtgatatatcaagtaattagtcattaggaaagtgaatgagcagattagaacattataattacttacattaatcagcaggggaagcctgaggaacttaacagacttttcccagctcttcctccatctcccttttctctccaccaccttcttgctgaaaaaaagcttagattgtaagatttttaacaggatttggtttctaatccacccagggaaggtgcaaactcaggaatgagagagaaatcaggaaggtagggagaacgtcaggcatgccatgggggagccggcaccacgtgagccagcatcatgggtgaccacaacactacattgaaattctccctcatacaggaatcacagtgacagtggaggtttgagtttgtgaagacagcaatgccaacttttttgttgttttttggaagagctggcatttgaaaattgcacatgaattggcagtctctaagggactccaattaaatgccaattacataaaggataaaaacgtagatataccctacaatgtggtttcctgagacttaggagtttgatcttttccatttttccctagccaacaataatgaaaatcagagcagcctgtgaaaaaatatagtgttcagcattgcctagaaccacaagattctataagtaggcagaagttgactgaggaaaagagcctccccagcacttggtgcctgcctctagcatagcacttaacccttcttactgtcattacttatctccatgtctgtctccccctagagtgtgagctcctcgagggcaggaaccctgtttttattcatctttgtgtcccggtgccaagcacagtgcctggctcatggtaggtgctcactcaatgtttgttgaatgaatatagcagtgcttcttgggttgatcagctaatttctttttgtttattttgttgggattttttgtttgtttgtttttgcccagtgttgttaatgcttttagtagactgatgaaaaaggaagagcgtgctctcaacatttggcctgtaaccttggctttcacaggaatcacccttcggtcatcgtgcagcctgggaagagacctttacctgtggaatccccggatactcaaaggaagcggaggatacacagatgtgattatgatggatgcaacaaagtgtacactaaaagctcccacttgaaagcacacagaagaacacacacaggtaatagaaacaccagacccacttcatctttcttcttaagaagtattagaatggaatgcaaaggttgttacgatcaaagttttcaggcatcttgaaagtcaccacagtcatctccagatgtgtcttctccagattagttgtgcagaatgaagatattgctaatgatttgcctttgtaataagttagaatagattcaaagtaatccccaaaacaaggccactcacaatcacttgcagttctgtgctctctagcaaaggagggagaaagggttggagccttcgccgctggaatgggggaagtgctttcacagtcaaggatgtggccttcctgtgagctatttcacatacctgcattgtaaattcatgagagcgaacagtctttgtgcagcacaaattaatgcaacagtttaacacaaacaattcaaatagaagactgtccttcaaggaaagaaaagtgaagaaatgtggttaatatttgtcttctaaacttgagggaactcttatgccgttgcctaccatatttgttctaggatttcttccatctcgcccaatactgaatatagagcatgagcagccagatcatataaaagtcattacatggccgagaaaaatgtgaaattggtctcagtgccaaacattttggtagtaaaacatcttaaggaaataatacaaaaatgttttaacagccaggtgcagtgacgtgcacctgtggtcccagctccttgggaggtggaagcaggaggattgtttgagcccaggagttcaagtccagcctgggcaacatagggaggccatgtctctaaaaaatattaaaaatgacatcttttaacagcctgattgaccattagtagtggtgatgtatgtacagtaaggctcatctcacctcaaactctttgatgtggaattctagtttgacagcagtttgcatctgtgtacattttccttagcagtgtaggttgcttttctgagtcttgcaaatcatttttactcagaaaatttacaaagaggaatctgaggtttggaagagaaaagggaaggaaagtggcaaaatggaagtgaagtttttaagtgaatcctgggaggaggcagaggaagctaacacccacagagagagctgagggtgatagccttgtatctagagcaacgcccaaacagcagtgcaaatcgatgattactgagggcatccttgaggcattagtgggaccgaagaggtggatgttacccacttccagcctaaaattaaaaggacattgaatatttgggtgacagtttagatgtaggaaaaaaaaaaaaaaaaaaaaaacgcctctttgtgtgtgtattctgtaccaggaagcagataatagaaatcctgcatatctcattcaaatgccaaggaatggtaatccctcaaggcttctagagaacaaagggtgttaaatgggagttaattttgtcatactcatgacccttatgactaatttaaaaggtaagattgccataacagcctttttatttgtgagggtctcccttcatcctggttctccccatcattttctcacaaggagcttttgttcctcatctgtaaatgatccttatcctacaggagggggttgtgaaaacctggctcaggacagatggggaagaattcgtatattttagtacccctgaattaaagcattatacttaggcctaattgttattgactaaacaagaaaataagatgttaatccctaacagatacttcagttgttagagacttcatatttttggaaaactattgaaaagtttaagaaaatcccacaaactttcaatttggagttctcattatctcattaaatgaatagcactgcatataattaagctcccaagcaggtttaagatttgggagatgtgcaaatacagatcaccatgtgttcattcactatttggtagtccctcagaatggatttcagtgactctgtgttttaagaactcttaaaattctcctcccgtttttttggcagagagccaatgaaacattacggtattagttcattttcttcttgcttgtcttgcagtagtttataatgcactgtgttattgaagaacaaatgtatgaacatatcttggaaataatatttgtcaagcattaactcaaagatctttactacctttacagaaaaaaaaaatagctcttttctttttccttttgcaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgttttcatagcatggagtcggaggagagggccatttagcagggggagcagaagaggcaattcctcctgggctaggggttgtcagtgaggtttcaacattttgttagctgtgtgcagcattcccagagcttcagtctctgtgcatactcagctttgtagaaccatgctgcaaagccatataccgatggggttatccatgcaactatctccattcctacaatgtccttaatatgagatcatcaaacattgatagtagggactccatggaatatttgcccagtaatggtaagaaatctttcgggtaagagtatggatggttcttcttttacccaatctgcttatagctttttttgtaaacagggaaatgttgagtggtacttgtattcccttatcaaattaatcacatagcttttatacagaaactcttcctgtgtgagctgttaaggtgccaaattggctgtcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgcaaggaaaatctttttgttttgaccgaggtaaccagtttatgtgtgttccaatccatagagaagtgggggaaagggcgagaaaggatcagattgatctgggatcagctttgagcctgagttcagtgaatagcctcatgggcatctcatggaattgatgcatttgctgtggcatatttaaattttgttcaaaagatttgaagcaagaccttgcaaagactcttaacattactgttcagcttgcttagattgtgttaacagttcatttaacaaagatccgttttaactctgaacaaaagcaacccagagcggccattctctattcccatgctggtcaatacgctttcattaccaattggcccttaccaaacttttcttatatatatatttgtattttactatgatagttgagaaatttagcctcttagtcatttttagctgttattgtggaagacctcaaatacaagattagatgcccttgaacatgttttaatgatgtgtgtcatgttactatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcatatactatatacagtatgcaatatatattatatacttgttaataaaaccatcagaatattaaatgtgatcatgtgattacttcatatgcagtgatcactagagcaaaacttacagagcaatgtaagaacccttgcttagaacattacttactctgatgggcagttattgttgatggagggacagaaaaatagatctaactggaagatgaactaccggaattaactcagccctcaagctatgtccctggttttctgaaaacagccaacaggaagtctcctaggctgaaatcataaaactgcagacaatccagcaaaaatctacaaactcacctagttcattcttgaaatacttcttgtatttgttatttatgaacccctgcctgcttccaaaaagaacttgcagcattttgtattaaaagacgcatgtgtataatactttaaacttttagagtaaaatatcaagactctcatgttggggagtggggaacgaggaacagaacaataacgcattaaagtaaataactctggataaaagtaattatttttcaagcctttagtaaccatgttcatggacactgcattctccagcatcacatgaagaagaagtagtttccgatagggatttagagttgagttttgttttgttttgtttttgtttttgtttttgtttttgttttttgagacagtctcgctgtgttgcccagcctggagtgcaatgttgtgatctcactgcaacctctgcctcttgggttcaagcgattctcctgcctcagcctcttgagtaggcgggactacaggtgcacgccactgtgcccagctaatttttgtaattttagtagagatgggttttcaccgtgttggccaggctggtctcaaactcccgacctcaagtgatccacccgccttggcctcagaaagtgctggtattacaggcatgagccactgcacccagccaaggatttagagttcttttgtttaaggcaaaatgtaattacctctcctcttccctctgcatccctgcaatgtaattgaaactgaggctagcttgttagatctcagcagtttcctccagcctggacttcatcttagcaaaacacaagataatgtctggccagcacttcccacatgacttactttcacaggttggagatgaaaggaggttgggagaaggctaaattcagcctttggggcactctccagccttctctggggaacttctctgtttttataccaagatagttgattgcaagatcaaaagcaagtgtatatgactataaatcctaatggaatattggcttgaattagtccagttgactggctgtaatccttccactatatttcttttttgtttgtttgtttgtttttgagacagagtctagctctgttgcccaggccggagtgcaatggcacgttcttggctcattgcaacctccacctcccaggttcaagcgatcctcctgcctcagcccccgtagttgctggaattacaggcacgtgccaccatgcccagctaatttttgtatttttagtagagacggggtttcgccatgttggccaggctggtctcaaactcctgacctcaggtgatccacccacctcagcctcctaaagtgctgggattaccggcgtgagtcactgtgcccaaccctttcattatatttcttatgcatgacttgacacttgctgagttcaaagtaagatccatccttctaggaagaattgttacaagctggattctgcccgggtgaatgatgaggatggtaacaaatgtggattctatgagaaactaaattctttggggaaaatggttgaacaaatttaagatgttccaaacaaaaaaatatatataaccatttcccattacagtcagccctctgtgtccatgggttccgcaatacagattcaacctagggcgaatagaaaatattcaggaaaaattaaaaaaaaaaaaacactacaataataatacaaataaaaagaacacggtataatagctatttacattgcattacattgtattaggtgtaaaatccagagagaatttaaaatatacaggaagatgtgcatcagttgtgcaaatactatgccattttatgtaagagactttagcatttgaggattttggtccctgggggtccatgcataccgacggatgactatattttaaatgctatcaggttaagaaagcaggattaggaggcttactgtgggccaagtaagattatcaattctaatctgaaagagaagaaatggctgtgttcagggacggatactgctaaaagataaacttgggcacattaaaatcttaaaagagtttatttgagcagacagcaattcatgaatctggcagtaccagttgcaaacagttgcctgattccaggagactgaataagctgttctcagaagcaaaacaaattatttgatggttgaagtcgaaagtttgtagttagaggttagttggcagtttctaattggttaagattgtttccctaggctatgatcattccctctcatttgggctttggtttgcttacacggaaaccaaggcatgggagcggtctctgcctaatgatctcccaattcaattatcaaaacaatggattgagatggaagtaaatacatacacatatacatgtaaaagttaaactactagagacctgacttaccggtgtgtatgcataaaactcaacaatgaattttccttcaagtgtacattcattttaagaatgtaaacggaacctggtaccatttcctattgtctgagcagatcatagtcacactagttagtaatagtgcagtatgtagagagagtgactccgaaattagaataacatgtgctgtaaattagaattatttttaaacttatggggaagtgggaggttgattctcaccaagtccagatatgcttattggtttgagagcttctgctcattatatctctggttttgcattccctacaggcaccctgagtggtggggttaagaatagaaaacggaagctggatcttcaggctcctggatcatggctgtttcacactgcatgcacttaatgaattcgatgtttcttccttttctcatgattcaggaactctaagaacttggtgtttaaagaactcagaaaggtggctcttggggactttcaagccttgctgatctgctccagaagaggtatcacctcctgctgcaaagtacaagagcttgcctgtcagttacacatctccaaagctatgttcatgtgttccctcaactaaaataatatcccacccacacattcaccaccagaatgagatcctcatggctgagctgggaattgctcgtctttatgaagacattgttagatggtagtttgtttccaaaccaagctagagtccactagtccagtgcagtaagaccaaacatccacaccaaggttttgcagcaggagaaaggagggcatttatttgcagggcaccaagcaaggagaactgggcagctcatgcttaaaacccaaccttccccgtgacttttaattaagcaagggttttaaaggcaaaggtaaatttcaggaaagcaaaagttataagcaaaatcttaaatgtatccatggagtttatacattgggttggcctaaaaagatgggatatcttgcagtggggctgtacaggtcatagggagattcagagattttctgatttgcaattgattaaggaagggaagatttatctgaagacttggggtcagcagaaacgaatattaggtctggcccatgggtgtgacttcctccaggatcctcaggaagaactttagaacaaagagctatggtcagagctcggtccttagttcccccttatctgaggtctacatgccagcagatggcattttccatttggtggagttctgggtttctgaaaagcaactgagggacgtgagttaaaatgttatctttagtttctacagggaaccaaacatctggtaactctaacctccttggctatggtttaatgctactattaccttcttgcttatcaggttgctcatttacttctcatggctagctaggtgcctggaattccccttaaaggaactccagaatttcttttatttccattcttgggggcccaacaggcctctcagagaagttggtgatccatctcagtttaaggaataggtgagcctgagttctgctcctacctctgaccctaacttctctctctcgccccttcacagccagctaatcgcttctgaggccacttctgggtcttttctcttctgtccattgccattgagctcctgtgtttctcactggggctagaacagaagtgtcttcactctcccacttcaatcattctccaccagacaccaaagccatctttcccaaactaagagctgactgttatgcccctctgcttagaatccttccatggtcctcactgtactgaagctggttcttcttaattcagccctacccccctttaaagcctcatcgtttatcattaaacttttgttttcattttcctgtttttttctaagaaccttcaaacacctcccatactcagtgagattgataggtgcacaaggcattcagggagatacaaaactcttactcatttgtcaaaatcccactcaaaagttacctattctttgagctttccttgaatgaactccactcaccctctctgcggagatactctctccctacttcttttttttttttttttctttttgagacggagtcttgctctgtcacccaggctggagtgtagtgccgtgaccttggctcactgcaacctccacctcccaggttcaagcgattcctcagcctcctgagtagctggaattacaggtacacaccaccatgcccggctatttttttttttttttttttttttttgtatttttagtagagacagggtttcaccatgttggtcaggctggtcttgaactcctgacctcgtgatccacctgcctcagcctctcaaagtgctgggattacaggtgtgagccactgcgcctggccctctctccctacttctttctgtaaccacataatccttgagtttccctcaattttcagcacttatcaccctgcatggtcagtctgtccatctgtctccttccctccctagatctcagatcaccctaatatgattctgttctgggtgtccagtgtccaatccccagcaccaggcacaaagcatgcctgggtgtgtgttggaaagtgtgctacggaaggtgtgttgaatgagcgaatgggtactaatagctaacattaagtgaacacttactatatattttgcactattctaagcaatttgcagccattaattagtttaattctcaacactgtaaagcatgtaaccattatcattttctttttacagatggaaattggggcacagacagattaagtaatttacccaaggtcacaaagataggaagcgggagaaccagcttcaaattcaggcctcctatgtccagaacctgctgtcttaactattatatgggtctctggccttggtggccctcaggccatttcgtgcttcctctcaaatttcaacccaggtgtgctatgggttgaatttttttcatacttttactgtactgagccatctgctgggataccctccccctccatcccaggccacactcatccaccccttcactagaaaaatactgctaattcttcagtacttgtaaagccagaaatccccaatgggtaaaggaagggggaaatttgctggtttctataaataagaggtttgagatatacaaatacatatacttgtatatatgtatacatacatatacttgtctatatatgtatctctatgtatgcgtacatatatacgtatatatgtacgcgtacatatatatatgggattacacctgtaatatacaaaatatgcaaaaattagctgggcatcccatacatatatatatatgcttatatgtatatgaatatatatctacatatgtatatgtatatatgtatatgtgtatgtgtatattcatatatatatatttaaaaaattattttttctgagacaccgtctcactctgttgcccaggctggagggcagtggtgtcatctcagctcactgcaacctctgcctcctgggctcaagtgatcttcccaccttagcctcctgagtagctaggactacagccacgtgccaccatgcccagctaatttttgtatattttgtacagatggggttttgccatgttgctcaggctgaccttgaacccctggactcaagaaatccacccgccttggcctcccaaactgctgggattacaggtgtgagccactgtgcctggtctcgatttatttttttttatgtcaggtgaagtgtatctttagataaaaatcattctttttagtgtacattcagtcatatcattacaatgaagacatagaacaattccatcccttcttaaaattccctcaggctcctttatactcacccatcctccaggcctattttatttccctgtaatttcacctcttacatatgtttgtgtcacctttttgagtctggtgtctattgtttcacattatgtatttgagattcaactatgaggttacatgtatcagtaagtttttccttttaattattgaataaggatatacaacaatatgcttatacatttaccagtggaagaatatctggattatcttcaatttgaggcaattatgaataaagccaccataaatattcatgtgcaggtattattaacttttttgttcaatttttgggttttgtgttccttactcttgggtaaatacttaacagtgggattgctagattgtgtgctaagtaaatatttagctctttaacaaattgccctactcttttccagagcagctatgccattttgcatttccaccagcaatgtatgagaattccaaggtattctacaacctcacccacacttggtattgtcaagtgttttgttttgttttatccaaccgaataggtggggcagtatctcattgtggttttaatttgcatttccttcatgacttatgatgagcatcttttcatgtgcctatttgccagccttgtatcttctttagtggagaatctcttaaaatcttttgcacattttgtattgggttgtttgttttcttattattacattctgagaagtctctgcacattctagatatgcgtcatgttttgctaatattttctcccagtctgtggtttgtcttttcattttcttaacagtggtttttgaatagaagatatttttaattttgataaagtttaatttatcaattttttttcttttatgaatcataatttttgtgttctaagaaatctttccctaacccaaggccacatacattttctcttattttctccttctagatttcttatggttttaggctttacatgtacatctatgatctatttgggtttaatctttgcacatagatataatttatgaattaaggttcatatgtatgtccaattgtcccagcaccatttattgaaaagactttccttctccattaaattgattttgcatgtttgtcaaaaaatcaactaaccatacatgtgtgggtcagtttctggattctctgttgcgttccattaatctatgtgtctatcttttcaccaagaccacactattttaattacagtagctttacaacaagtcttcaaattagtatgaattcgctaactttgttattctttttaaaaattattttggttgttctagctcctttgggcttccatttaaattttaggaacagtttatcagtctttcaaaacaaaagactgctgggattttgcttgggattacattga

SEQ ID NO: 517 - DNA, 27890 bp, Homo sapiens
aaaacaaaaaaagaaaaacagtccaggcaaggtggctcacacctataatcccagcaccttgggaggctgaggtgggtggagtacctgaggtcaggagttcaagaccagcctggccaacatggtgaaaccccatctctactaaaaatacaaaaattagccaggtgttgtggcgcgcacatgtaatcctagatactggtgaggctgaggcacaagaattgcttgaacctgggaggcagaggttgcagtgagctcagatcgtgccactgcactctagcctgggcaacagaatgagactccatctcaaaagaaaataaaagagaaaagaaaagaaaaagaaaaagaaacaagaaaagaaaagggccgggctcggtggctcacgcctataatcccagcactttgggaggccgaagcgggcggctcatgaggtcaggagatcgagaccatcctagctaatgcggtaaaaccccatctctactaaaaatataaaaaattagctaggcgtagtggtgagtgcctgtggtcccagctactcgggaggccgaggcaggagaatggcatgaacccgggaggcggagcttgcagtgagccgagattgtgccaccacactccagcctgggtgtcagagagagactccatctcaaaaaaataataaaataaaataaagtaaaaataaaaataaaaaaaagagaagggaagggaagggaaaagaaaagaaagaaaaacaatctccaacgtcacccactgctgctgagatcaactacaaatatctcagccctgcatcccaggcctctgtgacccaccaaaatgtccagagaataaagtgggttggctcaaaggtattgtgaaaagcaccaagtccagcccctcttctttgttcaagaaaaggggaccaaggcccagagaaggcagggatttcccaagtgtcccagagcaagccaagaatgtggaagccagtttgcttccccgccagtgttttctctgctcatcacccagccacctctggcaaccacacctctgagacaagctgatgtgctcagtcttaggatttgcttcagctgggagtaacaaagaaaaaaaaaaaaaaagcagtggctcaatccagacagatatttatctctcaattcccagacctatagagatagtctgtccaaggccagtatggcactactttatggaggggacccagatcccacctctttcttgctcggccaaggatgacttccattcaccaggtcactcatggtccaacatggctgctaaacttcggccattatgcgtgcattcctgctggcagaaaggaggggcgaaagaagcagttcacacttcctctccctttaaggacacttttttttttttgtgacggagtttcgctcttgttgccaggctgaagtgcaatggcacaatctcggctcaccgcaacttccgcctcccaggttcaagtgattctcctgcctcagcctcccgagtagctgggattacaagcatgcgccaccaaccacgcccagctaattttgtatttttagtagaaacggggtttctccatgttggtcagactggtctcgaactcccgacctcaggtgacctgcccacctcagcctcccaaagtgctgggattataggcatgagccactgcgcctggcctaaggacacttcttagaccctgtaccctccacttctacttctatccctttgaaacatggccacagcttaatcataaacaatgcaggaaaatgtctttattccagaaagccgtagcccaaataaaaaatagggttctaattactgaggaaaaggggagaacaggtattaggggaccaccagggttcaatgcctcactaaatccccagagtccaccatgcacactcttcctcaccttgccatgttccaaacacctagtccctcctccatcctgtgcctgagacagggactggttcaccctagatgcccaatgtttgctgaatgactgaacaaatgaaattgacttttctggaatatgtattgtttttccagatcagctagaaagagtttgaggacaaggatcctgtgttatgtgtctttgtattctcctctgccaccatcctccccagctcccaggcaccaggcacacactctagacatgttgcaagccaagttctgccctaactctgttctgctcaccccttcctcaggcacctaaagagtgtcagttgctgtcatgggctgggtgtggtccagaatctcttcaaggccacttcatggggaaatactttcaaagatcaatccaccagctgtttctggactaggtctgagcaaattaatatatctccccaaaaggaaagagtttaaaagggttaaaattgcagaaaaagaaatagatggctggccaggcatcgtggctcacacctgtaatcccagcactttaggaggctgaggcaggcggatcatgaggtcaggagatcgagagcaccctggccaacatggtgaaaccctgtctctactaaaaatacaaaaattagctggttgtggcggcacatgcctgtagtctcagctactcaggaggctgaggccaaacaatcacttgaacccaggaggcagaggttgcagtgagccgagatcatgccactgcactccagcctggcaacaaagtgagactgtctcaaaaaaaaaaaaaaaaaacttatcaaactcccaaattgtttgggccaggctcggtagctcactcctgtactctcaacactttgggaggccaaggtgagttgatcatgaggtcaggagttcaagaccagcctggccaaaataatgaaaccccgtctctactaaaaatacaaaacttagccaggcatggtggcatgtgcctgtagccccagctgctcaggaggctgaggcaggagaatcgcttgaacccaggaggtgaaggttgcagtgagccgagatcatgccattgcactccagcttgggcgacagagagagactttgtctcaaaaaaataaaaaagatggctatcaatatggaaatggttcattcctttttatttgataatttttattgaccacctactatgtgcctggcactctgctaaacactgaagaatcagtggagaaccaagcagatatggtgtgtccctgccctcatggagcttacagtgtatggggaaaggctgatattaataaaatacctctgcagatgaatgagtgactgtaatttacaaggagaaaatacagggtgccttgggaacttatcatagaaacacgccactcagtttgtggtgtctagaagactttcttgtcttgtggtgtcataaaactttttgtcttgtcttgtggtgtcagaagactttcttggggaagctgcgtttgagcggaaagcttgggagtgactaggaaaggcagggtgttccaagcagggggccagccatgcaatgccctgagcagaagcaaattccatgtaggctatgccctgaaaagcctgcaccactgcatcagagagcaagggacagagtggccaggatgaggcctcagaggaggaagagtaggcacagcctgtgggccaagtcaagatttagggctttattctgggtgtcaaaagtaaagggttttcccatcattctgagcaaactattgcaagggcagaaaaccaaacaccgcatgttctcactcataggtgggaattgaacaatgagaacacttagacacagggtggggaacatcacacaccagggcctgtcgtggggtgggggtagaggggagggatagcattaggagatatacctaatgtaaatgaagagttaacgagttaacgggtgcagcacaccaacatggcacatgtatacatatgtaacaaacctgcatgttgtgcacatgtaccctagaacttaaagtataataaaaaataaagaaagaaaagaaaaaaataaaataaaaataaagggttttccatataaggaagtaactgaatctgattcatatttttgagaatgcactctgattttgggggcagtgaactattctgtatggtactgtaatggtggctacatggcccccacagaatgtccacactaagagttaactctaatgtgaactatggactgtgggtaataatgatgtgtcaatgtaggttcatcaatcgtaacaaatgtatccctctgaggtgggatgttgatgatgttgtaacaaatgtagccctctggtgtgggatgcaggtgtaggggcagaatgtgtatgagaaccctctacctcctgctcgattttgctatgaacctaaaattgctctttttttcttttttttttttttttttttttttgagacggagtctttctctgtcgcccaggctggagtgcagtggcatgatctcagttcactgcaagctctgcctcctgggttcacaccattctcctgcctcagcctctcgagtagctgggactacaggcgcctgccaccacacccagataatttttttgtattttttagtagagacggggtttcaccatgttagccaggatggtctcgatctcctgacctcgtgatccacccgcctcagcctcccaaagtgctgggattacaggcatgagccacagcgcctagctaaaactgttcttaaaaaataagtctactaaaaaaaagtgcactctggcaaggggcccaagtgaaccttctgtgatataggaaatgttctacattacaggtgtgaacataagttaaaactcatcaggcgccgggcacggtggctcacgcctgtaatcccagcactttgggaggctgaggcgggtggatcacctgaggtcgggagttgcctgaccaacacggagaaaccccgtctctactaaaaatacaaaattagcccggcgtggtggcgcatgcctgtagtcccagctactcaggaggctgaggcgggagaatcgcttgaacctgggcagcggaggttgcagtgagccgagatcgtgccattgcacttcagcctgggcaacaagagtgaaactccatctcaaaaaaaataaataaaaataaaaataaaaaaactcatcaggttgtacattccccattaaagcacattttgcattttattgtatgtacaatatgcctcagcaaggaggaaacaaagggacttgtgattggccaaggctggcccattgtgaaccctgtgtgcctggacagaggtcctgtgatcttaggaggaacagttcctgaaaagaagtggggcgtggcaggagtggaggtgggggagctttgcattactagaagaagggggaaggggtcctggctagacaaagcaactatgcccaccacaatgtgtaaaagggcagcgcggagagtgaactagggggccacccaccatgctggtatccttccctgccttcctttccttgcagtggtgcttcctcttcctttcccaacaggtagaatctatgatatataattacgtagggacatgcatgcacacatttctatctatccttcatgaagggtatgtactgtccgcattgtcacatgccttgctttaacattcactcctccattcccaccaccttacactccagtcagcctggccctcggtccttagcccaccttcagatccccctactacaggggagctcctagaccaccttagcccagatcagcgggcaggcagagcaaaaccttggaattaaaatatcttcagaagagtccacaaatgcttggaagactcatcattttaatcctgggtggttgggtcgggaaaggcagggtggagggaagtgggggataatggctggctcatctggaatagtcaaacaggaaccttcttctacacatgtaaattttctaaaaaactaaaattcagtcccataggaaatcaagctttaaaaacaaaaagtctactaaaatttaaatgtgcacacattttgcttcagcaattccacttgtaggaattattaagatatcctcaccattgtcatagcaaataccaatagaggactggttaagtaaattgtggcacatcccaaagtggaatattatgcagctgtgaaaaagagtggagaagcaacttgtatactgatatggaaggaacaggtattgggtgaatgttaaagcaaggcatgtgacaacacatatagtacaatacccttcatgaaggatagatagaaatgtatgcatgtatgtccctatgtaactatatataataacttctacttggaatgaatcacaggaaactggtagcattaattgccctctggaacagaaactggctgactggggaagggtcctcttgtacttttgaattatgtataaaggccggatgtggtggctcacacctgtaatcccagcactttgggaggccgaggcctcctggctaacatggtgaaaccccgtctctactaaaaaataaaaaaaattagccaagtgtggtggcagatgcctgtagtcccagctactcgggaggctgaggcaggagaatggcgtgaacccaggaggtggagctggagctggcagtgagccgagatcatgtcactgcactccagcctgggtgacagagcgaagactccgtctcaaaaaaaaaaaaaaaaaagaattatatataaaatgtatttgttacctattcaaaaaaaattgttggctgggtgcagtggctcacacctgtaatcccagcactttgagaggctgaggcagatggatcacttgaggtcgggagttcaagaccagcctggccaacatggcaaaaccctgtctctactaaaaatacaaaaattagccaggtatgggggtgcacgcctgtaatcccagctacttggaaggctgaggcaggagaatctcttgaacccgggaggtggaggttgcagtgagctgagatcaagccattgcactccaacctgaatgacagagcaaaactctgtctcaaaaaaaaaaaaatgttttcatttatatgcgttaaaaatctagtattactggccaggcacagtggctcatgcctgtaatcccagcactttgggaggtcgacatgggcggattccttgaggccaggagttcaagaccagcctggccaacatggtgaaaactcgtccctactaaaaatacaaaaattagctgggcgtggtggtgggcacctgtaatcccagctacttgggaggctgaggcaggagaatcatttgaacccaagaggcaaaagttgtagtgagccgagattgtgtcactgcactccatcctgggtgacagaatgagactctgtctctaaaaaaaggctgggcacagtggttcacgcctgtaatcccaacattttgggaggccgaggtgggcggatcatctgaggtcaggagttcgagaccagcctacccaacatggcgaaaccctgtctctactaaaaatacaaaaaattagctggacgtggtggtgggcacctgtaatcccagctacttcggagtctgagggaggagaaactcttgaacctgggaggtggaggttgcagtgagccgagatcgcgctactgcactacagcctgggtaagaagagagaaactccatcactcaaaaaaaaaaaaaaagctaggcttagtggctcacgcctgtaattccagcactttgggaggtcaggagatggagaccatccgggctaacacagtgaaaccccgtctctactaaaaatacaaaaaattagccgggcgtggtgacgggtgcctgtagtcccagctcctcaggaggctgaggcaggagaatcgcttgaacccgggaggcagaggttgcagtgagccgagactgcaccactgcactccagcctgggtgacagagcaagactctgtctcaaaaaaaaaaaaagaaaagaaaagaaaagaaaaaaagaaaggaaagaaagaaagaaagaaagaaagaaagaaagaaagaaagaaagaaagaaagaaagaaagaaagaaagaaagaaaaagaaaaaagaaaaaaaaatctagtattgtcaagagtcaggacaccacttacataagcttagactgattctacctccatgaatggggttttaagtcctgcctcacaggatcgttggagacttgaaatgagatgacacacaagcaggtgaaatggatatttaagaaatgtcagctcctgtccttcctaagtttcctcatctaaatgaccattggatttccagctcttctgtctgtgtagtttctgaaagataaatgggagggatggtgtccccttaatgctgggtgaccttgatcccatggtagatgcaccagaacctggaaggagcaagcagggagggagggaaagggaattctccctggagccatcctgcctttccctgagcaaacacccagggcgtggaaactcccaggagactatctggtggggcccccggctgcccccagcatgcctgcttctgggaacagggccagataagacaggtgactggcttcagggaggattgggaggggcacaattgaaaatattgacttagggcacccatggtaagagatccttctcactgggtgctgtgactgcgctgggctcttacaccacccacctgattcttgctgagggccaggctacatgtgagcagaaggcagaaggttggtattgtttcatgaaatttttgtttcagttatatatatgtatatatacatatttgcaggtggtgataaaatgaatttcttactgtggaccactgccaaaatagatcccctgctctggataatggtgctgttaatgagtactaccaaagagtgagatcctctaaggtgacagtgtgcaaatccctgggcctggccctggggctgagtgggaggggttggcagtggggggttcctgggctcagtctggaagcccagctccatcgatgtgggtagctagggaggcactgtgtggtagttagggaggtgcagagatggggccctcagaggggagcccaggggctgggaagctgaggacccagagacaggagccctggagagagaccgcacagcagagcctgacaggagcttcctgcaccagcctgtccccactcacagtaccctctgcctgtctctgtctaatctccattggtgtttcagaaagtctggaaatgcccccatctcagtcgtgctaagggcttgtgcacttagcccaatgctgaatggacagggtggctgcctggaactctgtgcttgtggcagtggagcaggactgtggggatgcactgccccacccagctgtgtcctaacccctcctgccctgaaccttggaggttgtctcaagagtcaggcagaccccttcacacactgtgcacacccatgcacacacagtacaccctccacatgcaaacacagaatgcacacacgccctttatatcatacacacagcttgtaaaaaggataggaagggggtggtggctgtgactgagtggagtggggaagggccaagtcccacaatttctagcttctagaaattgtgggtatgacacacccaatggctgagaatagactctgaacctctgaggggatggaaaagccaggatgccttagtccctgactgcaaagattgaaggtgataaaaagacatgtctggccacaaggaaaggccatgtgcctggccaaggaggagtacaagcctgagagctggacagctctgggttccaatgccaaatctgctagtttctagatgagccaactacttggcttctctgagcctggctttccttatatgcagatagtcctgatgccaaggtgtaggggaagcacactaagctctctgctgataatgccctcaaaaacttgctctgcctgcctcttgagccttgctgcacagatcacatgaaccttgggatttgaaagcacactgtaaaccagaaagcactgtgcacaggtcaatgactattatacaggtgtagatatctatggcaacaagcaaggtttcaaccaggtttcaataaaggagcctctttaggaacagctgagggggtcagactttcccgctgtgcaccccctgcttcctggacccctcccagcttctcagtcccaagaagaggcctcctgaccacctccctcccaccccagtggacatcagatgcacacacaagcaaggacattggcagagctagctgaggttttattttggaccaaaaaaaaaaagcaattgaattgttttgtagctggaggcatgggcaaggggggtccccaggtagtaaactccccaggtgggctgagggctagggctgagcctcaggtgggtctcctgttcccagtgctaccctgcatagcggcctccttcccaggctctggggcagcgcaggaggggtaggctgggaggggctgccgcagctgttcacttgggcaggacgtcagaggactcagacaccagcttcccatcacgtgtctcgatcttcttcacaaccacggccctggaggagctggtgcggctgaaggagctggagcccgcgccagagccaaagctggagcccaggctgtagctgaggccggggcttgtgaggcccccataggccgagctcagaccacctggtgagggacagaggtagccacatgagtacagaagcccaccccatggcaggctccatgccccttctccctgctcattcccaacatagccccagggatgggaggttaacccagctctgcctgatcagtgattgcatggttcactactccagaactgtcagggaaaaccaggagcagggtggaaaacagctgccatatatatagctgtgtgaccttggacatttagctgcacctcagcttcctcaactgaagacgtttacaggtgtcatataaaaaataaattacagccaggcccagtgtctcatgcctgtaatcccagcactgatcacaaggtcaggagttcgagaccagcctgcccaacacagtgaaaccccgtctctactaaaaatacaaaaattagctgggcatggtggtatgcgcctgtagtcccagctacttgggaggcctgaggcaggagaatctcttgaacccaggaggtggaggttacagtgagctgagatcacgccactgcactccagcttgggtgacagagcgagacttcgtctcaaaaaaattaaattaaattaataaataaaataaatcacataaaacctgtaggatacttagcacagtgcctggcacacagctatggtttatttgggtgctttctaatagtaaagttactaagtaataaagttattactggggtcctgaatatgtgcctccccaccctaggattctcccaagaacatgagtgctcaggctgaggtcactgtgagcgactgagcacagccccctccctggagctgaggcctccctgggccctgcctcccgccctcatcccagggccctgggacacccacctgcatagccgctggtggtcttcgtatgaatactcatgttctgcatcccagactccagcctgtacccagacaaatggggtgtcaggaccaactcctagcccttcttggcccagaacaacaggaccccaagtcccaaggggcttcagggggctcccaccgtccccaccccaggtcccagggatagggaagcaggtccggtcagaggtacccacacccaccggctctcctcgccctccagcagcttcctgtaggtggcgatctcgatgtccagggccagcttgacgttcatcagctcctggtactcacgcagctgccgcgccatgtcctgcttggcccgctgcagggcggcctccagctcggacaacttggcgttggcatccttaatggccagctctccacgctgctcggcatctgcaatggcggcctccagggaagccctctgtggggtaggggacaggtaagtaggtcaggttgggtatgccttctcttctcccgtgctcccaccctccctcagggtcctccccaccaccacctaggctgactccccccagctcaaattaaatgagactaagggccgggcacagtggctcatgcctgtaatcccagcactttgggaggccgaggcgggcagatcacaaggtcaggagatcgaggccatcctggctaacacagtgaaaccccgtctctagtaaaaatacaaaaaaaattagccagcctggtggcgggcgcctgtagtcccagctactcaggaggctgagtcaggagaatagtgtgaacccaggaggcggagcttgcagtgagccgagatcacgccactgcactccagcctgggcgacagagcaagactctgtctcaaaaataaataaataaataaacgagactaaggaagcagatcagggagacatgagcagtttccaggtgcttcccctccacacccttctcacctgcgacactgtaaggtccccctaccctaactggactagatccctgggttctagactttccttaaagcagcagagctcaaccttaccctgatgcatatgactgattaaagcaggcttgggagcatgtatcacgagccccaacatacctgccccagtcccctttcacctctgtcctggcccaagggaccttccctgcatccctttgcttctcagaagcagactgagaagctgaactgtggctgcccctccaactcctgaaccctggtctaggattccttccccgactcccagaaacttcactcttcctacattatctcctctcaccaggatgtgtccaaggaacccctcccacccccaacccggcccatacctggcctttgaggccctcaatctcagcctggagccggctgatgttccggttcatctcagagatctcagtctttgtgcgccgcaggtcatccccgtgcttcccagccaggctctgcagctcctcatacttgatctggtacatgctctcagcctcagcccggctgcggttggcaatatcctcgtactgtgccttgacctcagcaatgatgctgtccatgtccagggagcggctgttgtccatggacagcaccacagatgtgtccgagatctgggactgcagctcccggatctcctgtgggggaagagggcaagtggtgaggccctgtctctgcacacagggagcccccttttccacaacagcctttcttagggtataagacaggggcagcagaggagaggagcaggtgggagtcagggtcagggagagggcaaagttcctgaaaaaggaactgggtgcaccaatactaggtgcacagagggatccaatgcagctcaaagattaggaacaagggctttggggacagagttgctgctgaatcaccacaccctatgatgaccttggatacgttatttcacttctctgagcccactttctcgtctgtgaaatggggtaatgactcatccctcatgcgagggacagaacatatagacccaataaatactagccgagcaaatattggtggctgtaattagtcagcagtgggcctttgtcttattagtgtgctgggggctgggaggagcctctggttgagtctcagggtggaggcgctgacaaggctgggggaccctcactctcctgcgaccaggaacatacctcttcatatagctgcctgaggaagttgatctcgtcggtcagcccttccaggcgagactccagctctaccttgttcatgtaagcttcatccacatcctgggggatgaggagaggggagcctgagctgggtttccacacccaaccccaaccaaggggctcccaaggtccacccaatggcctggtcacaggactttctagttgcccactttgtggattgatcttccagcccagcctctgcccatcacatgtgcattctcagcccacacaccttcacctctgcttcctgcaacacaccctcttccacctccttctctagggagccttctagagccagatctccagttctactgctctgttttctgaaccatgtcccaacaccgatgtcaagagttctgtccaaatgcacctaccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcgttgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccgtctcaggtttaccatgtcaacattgacacataatttgttcttcaaatccagacagttgagattgaaagggggtgggtactatcaacaattgtgctaggaacctgggcataaacacagactgttccgagcaaacctcatcaggtggtcaccctaattagataggactgcacttcccacaacagagggccatggggacttagtcccaaggtcccaaggggtggaggagagcacggtgacttcagttgggtggagggtgggagttgctcacttgttcttgaagtcctccaccagcccctgcatgttgccaagctccgcctccagcttcagcttctcctggcccagagtctccagctgccgcctaaggttgttgatgtagctctcgaacatgttgtccatgttgcttcgagccgtcttctgctgctgcaggaggctccacttggtctccagcatcttgttctgctgctccaggaaccgtacctatacgaaggaggagagagcaaaaaggtctacatcaggccagggctcaaagtctggaggaaagcaagcagtcttttctcttaattcactcctcaagcagtaaggtctccagaccccaggcacctggttagctgttctggaaagatcacctatgaccagggggagaaagcatggcatgatggtgaggtggggagcaatgtccctcagcattgggtaggggaaggagacaggtaaggtaattatgttaaagctgcatttgcaaaccaataggcctaacttcatttacataggttgtatattacacatcaataaaaatagccaagctttctttgggagtctccggcgcccaggctggagtgcagtggcaagatctcagctcactgcaagctccgcctcccaagttcatgccattctcctgcccctgcctcagcctcccgagtagctggggctacaggcacctgcctgccaccacgccccactaatttttttgtatttttagtagagacagggtttcaccgtcttaggcaggatggtctcgaactcctgaccttgtgattggcccgccttggcctcccaaagtgctgggattataggcgtaagccaccgcgcccggccaaaaatagccaacctttctaaagatgttaagattgaaaaagaggccgggcgtggaggctcacgcttgtaatcccagcactttgggtggccaaggcaggcggatttcttgaagtcaggagttcgagaccagcctggccaacatattgaaaccctgtccctacaaataatacaaaaattaaccgggcatggtggcacgcacttgtagtcccagctactcgggaggctgaggcaggagaatcgcttgaacccaggaagcggaggttgcagtgagctgagatcacaccactgcactccagcctgggcgacagagtgagactctgtctcaaacaaacaaaaaaacttgtaactccttctaaactggaggggacagaaatcttttaagggtacagcctagttccctccaccactctctgcaaatcgctttcttccccaggtcattctgccccaaaattattttttaaaaaaaagtgattataacatcttatcctaatggaatgtgggccaagcactgctgaactctttacatatgtaagtttgaataggcaaaaacttttgcctatatggatttaggggctctcatattcattttatagatgaggaaataagacttggcaagggagtccataaccaggaaccggcagagcagtgcgaaccaagaattcagattccaaagcctatgcttagctgctctctataaggaccccagggctagcaaaacgcagtcaacaagtcaagtccaggcgcttggagcgccaagggcccccgaccactgggttcctggggctccggttcctcccggcttactctgccccaggatttccctcctcccgttcccacaatgcctcccaggagccagtcagcgtgaagggcccaatcctcggggccgccgggggcccggggcccctcaggcagcggagtcccagggctgcaaaacccggcctggctcctgctgtgtgaaagtggagccaggccgctggggcggagcagggacaggacgcgagaaagggacacgggctgaatgggcgaggggcgttggtgggcgaccgcgttatctgaagccataaacttaacaggacgtaaaccccgggcggggcgtcccacgcccgcagactttgaatcctgcatgggctttccgaggccaggccctggcgcctcctccaccccaccccagcccaccccaccccaccccaccccacccacaccgcccccgacgccgagctccgccaggtggaggagagcgtcccgagactgctgcccgcagcccctcaccccgccctcggccccgcccacgctgccggcgcaggggccggggtatgactcattctgtgacccccgcactcaggcctccgggcgccaaaggcctcaatcaatatttgcccgtttgaaccgagacacccacttccttctcctagaatgctagaatcacaccaaacccctatgtaaaaaaaagaaaagaaagaaaaaaaatcacaaaggcaccactggggagcccttggggtagtgctggcgaagaggcgaacctggaggagggtagtccccgaacagctgggactgccgcagggcgatagcttaaaagacggtcagaactcgggttggggtgagaacaataaccgctattattttttataatttggggacagaatgacctgaggaagaacgggatttgtagagaggggtggtgggaactaggctgtacccttaagttgtctctctcttccaagaccctccagtttaaaagggaagaaggaagccccaggattcatcccggctgtccagaccctctccccaccctcacccagcccaaaccaaggtgcacgggaggggtgagtcggaggatggaagggagagtgtcgccagggcgggtgaggcccagcaggacgccagctgggggctggagatgtgcatagggaccgggactaccaggagaaaggggctgcgggcacagtcagccacgcaggggggaccctcaccttgtctatgaaggaggcaaacttgttgttgagggtcttgatctgctccttctcctgggtgcgcacggcctggatgttggggtccacctccaggacaagggggctcagcaggctctggttgaccgtaactgcggtgatgcctcccatgccgctggccccaccatagccgccgcccaggccaccgcgaaagttgctgctgcccactcgggagaagctcgaggagctgatgcgggaaccgggcccactcgtgtaggagcggctgctgaaggcccgggggccagaggtggacaccttgtaggacttctgggtcaccctgatggacatggtagaggcaggagtggaggcaggcgggccgaaccaggcggagatcctagaaggagcggagaagctgcttcttggtgaggagagctctcaggaatggccttttataaaagagatcccagccccgggggatgggggggaaaggcctcgtacctgagtggctaggcccagagggggctgggcctaacccgtcacctgccacctccgggcaggactcaggtgggggcagcagagagctgccgccacccaagggcccgttccaaccctggagcccactccagcaccacccccagaaacccaggaaaaggcagttcagtgaatatgaaactggaagaaatcctgtcctggcacaagtgcctgtaacaagcagacttgcctgggccgcccagccactacaaccctgactcctgggtcttgtctccctccctcctgggggaaataaactggaggactgggaagcatgggaaaaaggggtctcctagtatttgggtctcctctgagctgccgacaccccagagaaactctcctgtgttctccctgattgaagcgattatgagggcctgcctgagctggatgacagaacagctggagtccaaagccttgaatctgaaatcaaccatttgcctcatctttccaggttactgttctacccctagcacctggtgcagtgccaagagggtctgggtagatatttgtggaatgaatgaatgaataaataaatgagtgaataaacatcacacgcgcacacacacacacacacacacacatacacatacacacacagtggctgtcgtccctctacatctgaaggtgcaagataaaaagagatccaaggccaggcacggtggctcacgcctgtaatcccagcactttgggaggctgaggtaggcggatcacgaggtcaggagttcaagacaagcctgaccaacatggtgaaaccccatctctactaaaaatacaaaaattagctggccatggtgtaatcccagctactcaggaggctgaggcaggagaatcacttgaacccgggaggcagaggttgcagtgagctgagatcgtgccactgcactccagcctgggcgacagagcgagattccatctcaaagaaaaaaaagagcgagatccaacacagcacttttcctgaacataacccaggggcttcctctccttccaagatcctaggatcccctgggccaggtgaacactgtaggcctcactgaagggcctagagaatgatgaacagggctagaaggcagagaacgcaggggttggggggggcaagaggagatgggagctatgtcagggacttcatagttcttgctctttgcgggagtcactcccattgctcccagtgagtgaatcatgggaagtgagacaggacggcagggggtacagtggagtggtgtggcactcgtggtgctacctggaccctcctgctttacccaggctcccaacgggccagaggaaatagaggaagagtccctgcacctgtctcccattatcaaagtgagtcaggagggcaggttgggacgtagcacgcacctgtgggaggttggagattggggagctgagcaaggcaccccaggcctgggtggggccaggcagggcatgctgtgggtggaaggcaggaggtttaggtccccaaggcagagattccacctgcaattacctgatggctggggctgggttctctggaagatactgcagggtgtgatgtggggactggatgaaactgaactcagaggaccaacagatgacagccagatccccttgaggagagggacaggtgacatagccctgacccagggaagggggtgaccacctactgggaggacagatgtacagtttcttccccatccttctctaggagagacacccaggctcacagaaagacaggcacataggacccctacccagaaggacagagagacccagaagccccctccttggaggacagacaaacttaaaaagacagacacacagacaagctctcttcacaatgcacgcgtgcatacacacacacacacacacacaccccacacattgaagtcccttccagaaaaatgcatagatcccaagagcgggcacagtgagtggctccttcacctcccctcccctccccaggccctgcctcctgctatgctgaatggagcaagggaaattcagttagcacctatttacaccaggccttctcccagctcctttaaacaatgcctaattttcccaagagtgattggaaggcatgctaccccctccccaacaaacacccgcacccaccagggctgagaagcttttaacagaagaccaaagggagaaggactgggcccagtgccaaacctgggacagggaaggcggaaggagggagggaggggctggtcagacgggtatggcagccctggaaagggaggacaggcgctctccctatcttccctcccccacgctgctgttagagggagcagggggcactcaggtcctgatctaggcagcacaaggagcaaaaaaacagcaccccaaagcctttcctgaaattccagtcccctccaccccacctttctggttccctggttctaggagtgtcccttgtttaaggtgaggacagagggggttgccagggaccctgcagtatgcaggctggagggctgacccagaccttacccagccaggggaagccctttttttctggggcagcccagaaccgtctagggccagaagtgtttgtgtctcatttgtcatctctctattgcccagagaccccagccaaaccttcccccagatgccccaagcacagcctcggtgcaggagaagaggccagagttggcctctctgatggcccctgcctgggacttcagggttaaaggcagaaggagaaggcccctgggactagggccaagtggtgagggaagagagaaccagactggagcaggcccacaggtacaactccttgtaaggcattgtggtctacacacagctgcctgccggacaaaagggaacaacgtgtttgcggtgcctgccctacccagacaactctgcctcaaaccgcctttcctggagagtgaaccagggaaggaggagacactcactccctgtgggccaagagtgagggccaggccccctacttctgatggtgcaggataattcagagaaggccctgagaccctgagcagtggcattaagtcttggggccagtggggtggggaggtagctgttatcatcactcatgatcatgggaagagatggtctgaacaagtttttttttttcttttttgagacggagtctcgctctgtcacccagactggagtgcagtggcgcaatctcggctcactgcaagctccgcctcccgggatctgaacaagttttgcttagagatcaggactgatgatctcattcgctgcaaccttgttcataatagccaaagagtgggaacaaaacaaatgtccaccaaatgacgaatggatttctttaatgtggcatatccatacgatctaatgttacaattaaaaggaatgaactactgatgcatgttggatgcagatgagccttgaaacccgtatgctcagtgaaaggagacagtcatagaagatcaggtaccctatgattccatttatatgacatgtgcacaacaggcaaagcatagagacaggaagtagattagtggttgcctagggaggggaggaatggagatgaatgctaaagagcacagggtttctttctggggtgatgagaatgttctaaatttgatggtggtgggcaggcacaatggctctacctataatcccagcactttgggaggtcgaggcaggaggattactttagcccaggagtttgagaccagctgagcaacataatgagacccccgtctctacaaaaaatacaaaaattagccaggtatggcggcacacgcctgtagtcccagctgccctggaggctgagttgtgaggatcacctgagccccgaaagttgaggccgcatgcattgagccaagactgtgccactgcactctagcctgcgtgggagacagagtgaaactctgtctcaaaaataaataaataaataaacaaatttgatgatggtgaagctgcacaagtctgtgaacatactaaaaatcactgaactgcaagcttcagattgttgaattatattgtatgtgaattacagctcaacaaagttgtaacaaaaagataaccacaaaagcataaatgagctacatataaaaagcaggggctttgtgcccagcataaggggtcaggggaaagaagcaaagagtttgtttagatgccccaggtaaagaggcttcctgcctctgggttaaggcaatgcccgaaaagcacccgaaatccctttaaatgatggagcattttgaaatgttattattggtatagaaatagctgcatttagcatagagacagcagaacaatttgtttaaataggaagccacaggtggtgggtacacccctcaggaagcagcatcatgaataatagagtcaattcgattgctaattttgtgttatgtgcctcaaggctaaaatttttcattgtcaaagcttagcaaatgctgacttttttgctcttgatcagtgatggatctgatgattaaagccagccaggatggaaatggactgcctagagagggagcaacctcctgtacctggagacatggagagggaccttgctcaccagctgtccactggctcagtgggagggggttctcacatctgctagggtttgaattagaatgtccaagtcccgccaactctgaaagcttttgatccacatccaccaccatagagctttacgcactgaagatgaaaatctgtgaatgttctctggtttgaaattttgcttgtgataagagatatgattagaaattattagaacaagagtgagggaggacagcacagccttgttgtggaggaaggagacacaagcccagcagcctgaagatgttgaggtctcccacacttttttttcttttttttagagacaggatctcactatgttgcccagcctgactcgaactcctggatgcaagcaatccttctgcctcagcctcccaaagtactagggttacagcgtgagccactgcacacagcctttctcacattttcaacattctctcaccctcctctccactgatgccaaaccaagaaggtcatcccactgggtgagcatgaagcctaggcggaaggtcccagctatggctcagtccacagagtccttccccttaactctggttctccatcacatcaagatcgcccgtgggagattataacagtatacgtgctcaggtcgcaccccgtctgcattttcaaagcttcctcggtacagccagagtcaggcaccaggctttagctctggtcccaacaccaagacctttaggaacacactttcttcctcttcccagaggaaataggccagagctcaaatccacagcactgcaggttcctgcttagaaagggtgatatactctgtccctcaggaaggaaaacagagtggttcagtccccagaacctgaaactccaccaccgttggccagggccacagagacagagacagagactgcgagaggacagacacaaatgggtcccactcctgacagtgaagacagcggtactggggacttgagtgacaggaagtggaagttattgagaggatttcaaggaaacttcagaagctgacattgcgataggggaagccctcatggtgttcaggcaaccggacaggagtgcaggaaaagaacaaacaggaaggacctggggctccgctataggcatcctgcccacccccaccccagccctgaggattcccctggcctgagctgcttagcactggagctgatatccagaggcccactgttttgattttcctgctgggcaacctgaggactaaggtgggagttggggacagggactagaggcctttattccttcctgtattcaccttttcatttatccacatatttgcttatcaggcagtagtctaaaaaatttcaggagatgaagtatttgggtcctctcaaaccaaaggaggtaggagtctcctttgaccaaggcaaggtatttcctgaaagtccctgttgagaagtgaccatcaggccagacgtggtggctcacacctgtaatcccagcactttgggaggccgaggcgggctgatcacctgaggtcagcagttcaagaccagcctggccaacatggtgaaaccccatttctactaaaaatacagaaattagccgggcgtggtagtgggcacctgtaatcccagctacttgggagactgaggcagaagaatcgcttgaacccaggaggcggaggttgcagtgagctgagattgcaccattgcactccagcctgggtgacagagtgagactccgtctcaaaaaaaaaagaaaagtggccatcagtaatccttcatcattaaatcagcatattgatggctgactatatactgggcacatgctgggaagacactgagggaatcaagtccctaatggcctttactgtacatcagggggagacagacagacatatagtcacttattccaatactgtaacaataacacatacagtgcaaaaaaaatgccttacaaatattaattcatttaaccttcgtaagaacactataaagtaggtgccataatctctatttttaccagatgaggcacagagatgttaagaaacatacccaaggtcatgcagcagtgtggctctttttccatgctcctaaccactatacacacttccagtataacgatggagaacaagaaaagtggtatgggccgggcgtggtggctcatgcctgtaatcccagcactttgggtgggtggatcacttgaggtcaggagttccagaacagcctggccaacatggtgaaaccccatctctaccaaaaaacaaacaaaaaaattagccaagtatggtggcacatgcctgtagtctcagctactcgggaggctgaggtaggagaattgcttgactctgggaggtggaggttgcagtgagctgagatcgtgccactgcactccagtctgggtgacagagtgagacactgtctcaaaacaaaaaaaggaaagaaaagtatttgtgtttttaaaaagtggtctggcagtttaacaaccaagagactgtcctcagagcagcaaccaggcacctaccacagggcaaggtctgagggaaagggactgagggcgggcacattttgatggaaagaggagcagagtcacagcattgggcccaaaggtcccccaagaaggcaggaggactcctgcagtggggaaggcagcagaggggagattccttactgcagcgttgcttgaaatcagtcttacctctgatgaaaatttctgagtctctgttttgcaacccactcctcccagccccagcctcttggaaaagtcccctttacaaagagagcccttcatggtttagaaaacacccctcagtcatccctttaaaaacccacaactcttggggttggacagaactgttgaatgtcctgacaccctggaacttgacaaagcatcccaggtagaagccacacttgcatgccctagcacagatgcccaccctaggcctggcccctttcttgctttcccaatccacgggaccagtgacacttccatgcctgatacagaagacaaagttgcataggactggtgaaaagacgtgggcaggggatggtcctctgcagtcgcctggcctccatgtctcatcccacctgacacagagaggcagccacagtttaggctattcccagccttttccatggccatggcctccatgaaatgataattcgtgtgtggcaggctggggcaaatgaaagggtctgctgaagagcaggtgtggtcaggccaggggctgtggacactcagagagctgatggcctaatatgtctcacagtcatagccacttagcacaggcagcgtgaccaggtacacaggcagcgtgaccaggtaccctggctgggaagcgcttgcttgcagaaagcaacctggttttgtgaaatgaggagctaagggaggagcaggaaggaatggggagccaaaagatagttaaaggcctgcctgccttgggttgaggcttgggatcaagggcactcatcagacctggaagccataaacatccaggtatcagaggaggctcagccgaggttaatcacccaccataaaagcaaccacagcccatggagagcagagtcaggtggcagggctcctcaaaagtgagccgccccaaggccagccctgcccaccccatccccacctgctggagtggaaggaagcaatgactccaaccttggtgaaatctggccatgccccaacacacctgtcagtttcctcctctgatattgcagggtggccctaacctgattctggtattccccgcttcaccaccaccgtcaacaaaagttttatgattctatgtacctttcaaggactctaaagaatctggcttcagactgaaaacaatgagaattttcaggagggcagaggtgcatgatgataagcaggtgtttttgagcacgtgtctttatatgcatgtatccatataaatacaaagcacacatgtttgatgggttatctcccagaacaaacagcctcacaggcccaccccccaccctgtgggcacacaacctcagcctatagcacacacgccctcttgtccctcacacactctctcaggttcacacacaccccacctgccctctcacttgcatggcctgacgcacacgccaaggtgcagtaccacctcacatcctcatctcaggcacaagcatgtgcgtgtaccacccgtcagagtcccgtgcacaccaccttcctacgaacgtcacacacatacctgtgcacacacagccatatataacacacatccaaactcaaatacacggttacaggtttgtttgttttttcttttatacagacagaggtttcactatattgcccaggctggtctcaaaatcctggcctcaggctgagagaggtggctcatgcctctctaatactagcactttaggaggccaaggccagctgattacctgaagtcaggagatcaagaccagcctgaccaacatggtgaaatcccgtctctactaataatataaaaattagctgggcatggtggcaggcacctgtaatcccagctactcgggaggctgaggcaggagaatcgcttgaacccaggaggcaaagattgcagtgagccaagactgccctattgcactccagcctgggcgacagagcgagactctgtctcaaaaataaaacaaacaaaacaaaaaaaaaatccaccgggtgcagtggctcacgcctgtaatcccagcactttgggaggccgaggcaggcggatcacctgaggttgggagttcgagaccagcctgaccaacatggagaaactgtccttactaaaaataccaaaaaattagcatagtatggtggcgcatgcctgtaaccccagctactcaggaggctgaggcaggagaattgctcgaagccaggaggtggaggttgcagcgagctgtgatcataccattgcactccagcctgggcaacaacagtgaaactccgtctcaaaaacaaacaaaaaatccttgcctcaagcaatcctcccaccttggcctcccaaagtgctgtgactcccaaagttacaggtgtgagccccagctcccagccaaaggatacacattcttgattgcaagtggctgaaacccaactcaaacagacttaagcataaaaagatcatttcttataattgagaagttcaagggtgcatttggctttcagcctagccagataaggggctcagtgatatcatcaggaccaagactctcttcctgtcttttggctattttcctccatgttagcttcgtcctcgggcaggccatctccctgctgcaggaagggcgaccactaagggagcacctctttcccgatgcttcctgctgaagttccagggctgactctccaaggctgatataggtcacatgctcatctctgaaccaatccctgtggccaggggaatagaatactatcatgttgactagactagaccacataacaagaccctgtggaggggtgatcagccccacccaacctatagagaaaggggaa

SEQ ID NO: 518 - DNA, 105215 bp, Homo sapiens
tatttttagtagagatggggtttcatcatactcgtcaggctggtctcgaactcctgacctcaggtgatccacctgcctcagcctcccaaagtgctgggattacaggcatgagccaccgtgcctggccctctcttctctgtttttccaaatctgggtcaccatttagcccaattaatttcttctacttatagacggcaacaccacaccagtgctcccttttccgatgcgatcaatttaccacacatttgggggggcccctaccatgtgccaggcactgttctaggttcctgggatacagcaatgaaccaaatggtcaaagatccatggccttgtggggtctgcatcctagtgaggtgacagacagcaaacaagtaatgaaacagatgttcactgtgtgtcatgtagggagagggatagagagaagggtgtaaggaaggacatcccaaggagatgactgctgagtggagacctgggggttgtgagggagggattcgcgtggatatctgggacagtgggttcgaggcagaggaatggctaccctcttgcccactctagatacactgcactcactcgacaaaagccagccctagttagacccaattctccacctactccatacccacatctgtgcagctgaaccctggctagagaaaaacatgccactgtgttggctggcctcactgagacccatgcccagaatcttggggtggggcgccttcatgcttccctgggccattcatcctcccactccccggacaaccaattcccatggcaactttgccagcctccctctcagatgccttccttacttgcttatgtcaccaagaaaattaaagcaatcagaagagttaccactctaagattccaacacctcatgtacttacctacctgattcttgtccaaaaccttccttcctgttactatggatgaaacatgcattgaagtccaatccctctctgctactcaaggaaaactctctcctctcccttctacattagcaatgctcctctcccatgtccctatctcactgggtcattcccaccagtgttgaaacatgccctaccacctcctactatttatttatttatttgagacagggtcttgctctgtctcccgggctggagtgcagtgtcatgatcacagctcactgcagcctccactcccaggctcaagcaatcttcccaccttagcttcctaggtagctgggactagaggcgcacgccaccattcctggttaatatttgtattttctgtagagacagggtttcatcatgttgccccggctgggctcaaactcttgggctcatgtgatcctcctaccttggcctcccaaagtgctgggattacaggtgtaggccaccactcccagccaatctcccacatttttaattaattaattaattaaaatgtaatttttttttttgagatggggtcttgctgtcgcccaggctggagtgcagtggtgtgatcttagcttactgcaacctctgcctcccgggttcaagcaactctcctgtctcagcctcctgagtatctgggactataggcgcacgccactgtgcctggctgagttttgtatttttagtagagatgggatttttcaccatattggtctcaaactcttgacctcagatgatccacccgcttcagcctcccaaagtgctgggattacaggcgtgagccaccgtgacctgcctatttttttttctagagatggagtctcattctgtcacccaggctagagtgcagtggcatgatcttggctcactgcaacctccacctcccaggctcaagcgattctcctgcctcagcctcccaagtggctgggattacaggtgtgcgccactatgcccagctaatttttgtatttttagtagagatggggtttcaccatgttggccaggctggtctcaaactcctggcctcaagtgatccacctggcttggcctcccaaagtgctgggattacaggcgtgagccaccgcacctggcccacattttaaacaaattgaaaaaccctctcttcatggcacttttccctctaattcactttacccaacaaaactcctagaaagagttgcatagatggctgtctccgtctctccttgcacttgttcttcttctggtctctgctcaggtgtcacttgctcagtgggaccttccctgacccttgtgtttaaaattgcacccctccctatgtcctctttcctgcttcatttttcaccatagctcccatccctttctaatatgtactgtaaggcatgcacctattctgtttattgtccatcctccccactcaaatgtactagaatggaagtccaaataggacagggatgttcatctgttttgtccactgctgtatccccagcacctaggaaagggcccggggcattacaggtgctcagtaccatttgttctgtgagtgaatgcatgataagggcaagggcaaggaacagcaaagaagtccatgtgtctgaatggagcaagaggaaaggatagtggaaaatttggaggcagaggaggcaaggcaccagatcacatagagccaaggaaaggatctaagtgtggttcaggatgccattggagggtttgcactagggaaagccatgatctgactgatgttactgagattctgggcaggtcaagtaaaaaaaattcacattccatgagtgtgtccctgtggcaggcagtttttgtatctgtgtatcatgaacaattgtcctgcctcagcctaaagctttcctaaaggaaagctgggtgtcgaaaatggtacctgttgcacaggcagggccatgggaaggaatgatcactgctttgcaggggctccatgctttacagcttgctatggactgaatgtttatgcccactgccccaacattcatatgttaaaatcctaccgcccaaagtaatggtattagaaggtgggactttggggccgggcacggtggctcacacctgtaatcccagcactttgggaggttgaggcaggcagatcatgaggtcaggagatcgagaccatcctggccaacatggtgaaaccctgtctctactaaaatacaaaaaaattagccgggtgtggtggtgtgcgcctatagtcccagctactcgggaggccgaggcaggggaactgcttgaacccgggaggtggaggttgcagtgagccaagatcacgccactgcactccagcctggcgacagagcgagactgtatctcaagaaaaaaaaaaaaaaaaaaagaaggtcatgagggtagagcccttatgaatggaattagtgccattaaaaaagaggcctgagggagcttggtcacccttctaccatgtgaggacacaggcagaaggtaccatctatgaaccagagagcaggtcctcaccaaacacccattgacaaaaggagtcaaactctgtaaaatatttgaagagatttattctgagccaaatatgagcaaccatggcctgtgacacagccctcaggagatcctgagaatatgtgcccaaggtggttggggcgcagcttggttttgtacattttagggagatgtgagacatcaatcaaatacatttaagatatatattggttgcatccagagaggtgggacaactcaaagaggggggtggtgggggtgagggcttccaggttataggtagattaaaaatttttctaaccaacaattagttgaaatagttatcaatataaaaaaagtctaggttgtgataagagactgtggagaccaaagtttcatcatgcagatgaagcctccaggtagcaggcttcagagagaatagattgttgggctgggtgcagtggcttatgcctgtaatcccagtactttgggaggctgaggtgggtggatcacctgaggtcaggagtttgagaccagcctagccaacatggagaatccctagctctactaaaaatacaaaaagttagctgggcgtggtggcgtgtgcccgtaatcccggctactcgggagactgaggcaggagaataacttgaacccaggaggcggaggttgcagtgagctgagaccatgccattgtactccagcctgagcaacaagagcaaaactccatctcaaaacaaaacaaaacaacaacaacaaaaccagagagaatagattgtaaatatttctcatcagacttaaggtctgtgttgatgttaatgccagagaggtgtaatgaggcatgtctgacccccactttcaggttaaattttagagtgccctggctgaggaggaagtccatttagatggttggggggccttaggattttatttttggttaacaccctgaatttgctgttgccttgatcttggacttcccagcctctcaaaccatgagaaatacatttctgttgtttataagtcacctagtctgtggtattctgttataacagcccaaatggaccaagactagtcaactagaatattgaacatgttttcattcaagaaaacaaaataaaacattactggtaaacacttaaacaaaaccatttacactctgcctacctactgataaaattttttaacttttcagtattttgcttcttaaacaactgttatgcaaatataaacacctttttttgagatattaaagttgtttccaagcacatgaaacagacaaaaacagcctgtattaaataaccacagctgggattctaaatgctatgcagagaatttgaaagacctctgcctcttatgtattaaacagcagcagtaaaacatcagtagtctcctggccatttctaagtaccctttcacagtggtatattattcagtttgatgcccatgggataccatctttatttttttttttaattttttttttgagacagggtcttgttctttcacccaggctggagaacagtggtgcgatactacagtcatgtgctaccatacctggccaattttttaaaaattattttttggtagagatgggatctcactatgcttgttgcccaggctggtcgcaaactcctggcctcaagcattcctccctccttggcctcacaaagtgctgggattacaagagggagccactgtgctcggctgggatgccatctttataatctattttgtaacggtgtaaggtgatccattgactaagagaggacaacccagttggggcaggaaatacatggattgtggattcaggtttgtgtttagttgatggagatggtgcaactgttctagaatggcagtgggggtggagagtaatgcctacaagcttctggaatgctgagcacttcagctaagccaagatacggggaggcaggagggcatcaaggattgtgggctcacataggtgccaatgtcacaggatacttggggtgttgcttttccagacagaaacctctgtggctagtggtgcctttgcccaagttttgctcaggcctgctggttttgtttcgcccacttagcctgacaggctgtgctcagctcgtgctactggtgtggatcccatgcttgccaagggcaagccagccatggagcagcgagagctgtgtgagcaagcaagcatggggtctggccactgcacacagccaggcatgccagctgtggcagtgcaggcagctccaggtgccagcacgggcacagctgtggctggaccaggcgtaccacaggcaacttccaccgctggcactggggaatgcggtggcacctggaagcttggagacaccaggaaccgcagagccccaaagagggtatcataaccctggattggggtgctcctaggtctgggctccccaaagggctgcagcttttctctccttctctcttttctccttctctcttctctccttctcgttgcccacaacgtggcaagcaaggggtgtgtttcagtcctgtttgtgttacagatcttttagtgccaccatttgcccagtgggtcccaagttcttgtcctgtgtccacaaagaatgaagtatgcagacaactggagggtgagcaaggcagaaaggagcctcactgagtggcagaactgttctcagtgggtatctcctttcctcaggcaggttgtcccgatgagtgtccagctctcagtggagaagagacccacagtgggtagctgccttccacaggcaggttgccccgatgtctctgcagccttcagcagagagacccagagtgggtagctcctatctgcaggcaggtcatcccattgtctgcctgagtctggctgagtctggttttttttatggacttcagaagggaggaagtgtgtgctgattggtccaccggcagccataggcaggcccaggaaaagcaccataaattctcactccagtctgcaggactgatagctcagcccctaggtttcaggctgtccctgtcttgaagggggcttcactggggacccatcccatttcacccaggagcctgattgccccctgctgccatcaacctgctggccatggcacccatggcacccaggctgttcatgctgaggggtgcctgcaggtacatgccgaactgccctcagcctcaccctggcctccctcccatgctcatcggcacccaaagtctggagggggccgaggcggcaggggactggtgtgtcagtgctgccctgagtgcgtgcacccccagctgggtcgtgacagtatctgggctcagcttcaactttgctccaaaatcagaatgggcaccaggagaggccaggcaacaggagcaggcacttctgagcctgtgggagtaggggggctttctaggtccccgggagcacagggatgcccaggtctgcagccacagctgggtggatgcagctgtgcctgggaaggcagggctcccgccccaccaactcagaagggagtggggctcctgcctgttcctagctcctaccagctctatggagcatgcagtcacggcctcacctcgccattgcagctagcatcatggcagtggctgctccagatggaccactgctgccatcaccaagataggatgaaaagagaagacaaatgtaagagcactggttggtgtctgtggctcctgcaccagggtcccagctgtccaaactgaaaacccaggaagctggctctgagcttactggactttgcagagggatggccatatattcctagcactttgtcagctacaactgccatatttggaggtcaggcaaagtgagccagtcttccactccaaaatccagtttttaattaataagtattacccaacacctaaggagtgtttaattatgattacctctgagaaaggggatggtaggcaacttttaaaactttatatatgtctgtattgttcaaagttgttatagaaacatgtattacttgtagataaaaaaccaaaaaaaattttttaataaaaatacttcattttagtatagtgctttatagcagtgcttctgtaactttattgtgcaaataaaccgcccagaaatcttgttaaaatgcagattctgattcagtaggttggcaatggggcctaagattctgcattttcaacaagctccctggtgatatggagtccattaaccatactttgggtttacggcagcggtcctcaatctttttggcaccagtttcacagaagccaattttttcacagacgggatgaaactgttccacctcagatcatcgggcattagattctcataaggagcgtgcaacctacattcctcatgagggtagttcataataaggtttgtgcacccctctgagaatctaatgccactgctgatctgacaggatgtgaagctcaggcggtaatgccagtaatggggagtggctgtaaatacagatgaagtttcgctggcttgcctcctctcacctcctgctgtgccactcagttcctaacaggccacagaccagtactggtcagtagcccaggggttggggacccctggtttacagaatataaagcacattcatatatattatcttatttgttctctgtcacaactctggcagataggggttcactaattcacttattcgaccattaggtactactattaatatataccaggcacttggcatacagatatggtcaaatggagtgggaaacctaccacccaaccaaacaaaaaaaaacgcatgttaaccaacaaataaataattataaatagttatcagaactgagcaggaagtaaagagggtgctgaaaaagaacaacaggaaccactctgaggaggcctctaagaggaggtgacttcagcagggatgggaaagatgagccactcagtttaggggcaagctctgggcagacaccaggaagctcctgcagctagagtgcagggagggagggaagatccctagatctggcccagaaggctgcggcaaggggccgatttcaatttaattctggggtaagcactgaggatttaggtagagaagtgtctgttctagtatttgccttaggatcacgatggctgtagtgtgggaaatgaaacctctccaggatcgcctgggaactggtatagggagtcccgggccatgcgggggcgccaaggagtcaggcctggtgtccctgcagccgcgcggatccacttgcagatgggtccctctacgaataacgagcctactagggcacgtgcttttactgctgcactgaggacgtgaaatgcgcgcaggcacaacgagactttcttctttttcgctctttcagagggcccgggctcccatctacgctttgctggttacgttggcatgttgggcatttccccctctctgcctcagtctcccgacctgtcaaagaggacggtgggccagccatgggtgacacgcccgtgcgcctctccaatagtgcacctcgggcaagccgggcggcgggcacagcctggacggtgccggcctcgagaggcacaaagggctggctttccaccggggaaactgaggcagtggagcgaggagcggcgtcctcgaaagtcctcgcaaactcccagcgcctgtgttgggcccatgcaggctacccaggccgcccgtctccgagcggaggaccccgcccagcgctgccaggggcggggccgggctgaggacccgaggctggaagggaggtcggagcacccaattcggtccaggactcgcagggggcggcagtggcggcggcgaagtcccgtgcagtcccagtgctagagcgtgggacggacttgtggggcacccctcggtgttctccagccaggcctgggggcaggaggcccagccacgctgccgggtgcaggcctgcccctgggcgcccgcccgcgcgccgtccccgcccctcggccgccccctccgccccggcgcgggctcgggacgtgcagagccggcgagcgagcagcagggactgcgcctggcgcactcacttccgcgtcccgccgccctccggcccgcgcgcgccgatccgccgccgccatcggacaatgggccgccagccccagctgccgtgaacttcctgccgctgctcggccgcccgtgcgtcccggacggcgttcctgccaggcgccggccgggatcgcagctccggggaagcagcggaggacccagcgcctggaacgtacctgcgcctcagccgccgcgcgtttgctccggcccgactcgcggcctcggcgccctcccggccgattcagcttcacccggcccagtcggctgctgccttgctgtgagtttccgtgtttggttgcctaaggaggatgtgattttacttttttgctgttttctttttccttttataatttgaagaggagaaaagaactccgctgagcaggcccgggacggcgaagtgccaccagctaccccaacaaggacgtctccaggggaaagggagttggaagcaaacttggtccagctggcgttgaggtctcaacttcggctggactcttaaatcctggggtcatgcccttcacgctaggcaggtggaagtctttacttgtactgggccggacttgagccccgacccttcgccagcatctccccgctgccctcaacacacacacacacacacacacacacacacacacacacacacacacacacacacacacacacacacggcacctgggctaggcccggacacctgtctgcagcatggataagtatgacgacctgggcctggaggccagtaaattcatcgaggacctgaacatgtatgaggcctctaaggatgggctcttccgagtggacaagggtgcaggcaacaaccccgagtttgaggaaactcgcagggtgttcgccaccaagatggccaaaatccacctccagcagcagcagcagcagctcctgcaggaggagactctgcccagggggagtagaggccctgtcaatggagggggccgcctgggcccacaggcccgttgggaagttgtgggcagcaagctgactgtggatggtgctgccaagcctcctcttgctgcctcgacaggggcacctggggcagtcaccaccctcgctgctgggcagcccccgtacccaccgcaggagcagagatccaggccatacctgcatggcacgaggcatggcagccaggactgtggttccagggagagcctggcgacttctgagatgtctgctttccaccagccaggcccctgtgaggatccttcctgcctcactcatggagactattatgacaacctctccttggcaagcccaaagtggggtgacaaaccaggagtgtcccccagcatcggcctgagtgtagggagtgggtggcctagctccccggggagtgacccaccactgcccaaaccctgcggggaccatcccctaaatcaccgacagctctccctgagctccagcaggtcttctgagggtagcctcggtggtcagaatagtggcattggtggccgcagcagcgagaagccaacaggcctttggtccactgcctcctcccagcgggtgagccctggcctgccttccccaaacttggagaacggagcaccagctgtggggcctgttcagcccaggaccccttctgtgtcagcacccttggccctgagctgccccaggcaaggaggtcttccaagatcaaactcggggctggggggtgaggtttcaggtgtgatgtccaaacccaatgtggacccccaaccctggttccaggatgggcccaaatcttacctttccagttctgccccgtcatcctcgccagctggtctggacggttcacagcagggtgcggtccctgggctggggccgaagcctggctgcacagaccttggcactggtcccaagctcagccccaccagtcttgtccatccagtgatgtccaccctgcctgagttatcttgtaaagagggtcccctgggctggtcttctgatggtagcctgggatctgtgctcctggacagccccagctcccctagggtaaggctgccctgccagcccctcgtcccaggtcctgagctgagaccctctgctgctgagttgaaattagaagccctcacccaacgtctggagcgagagatggatgctcacccgaaggctgattactttggtgagtgagaggctggtggagttgcctatggtggggcgatggggttcttgagattggggaacatgccccctaccagggatgctgtgggctgtagttacctctctttgagtggcctgtttttttatttttttgttttgggcttcctctttcagctgctttttctgattcagaaacttgaaagcatcctggggcagaaagcggaccttgcagctggggttacccatgtgtgaagggtgcagcagggtgggattgctcatgactgctctcagaaaagagaaatgctgtgactttggatttcaagggttttgggtgtgactttagagcctcttgcagtgacaggctcatataggacttcagtgggaccagctttctcaggggcagctacccctgagcgttcagtctgtagttggttgggcagatctggttgatctggctgtttgagggaccagtgattgaggcaggggctcttgactgccgtgtgtgtgtgtctgtgtgtgtgtctgtgtgtagatgggtacttatgtgcagttgaggcaggtcaaacactaccatgaaagacttgtagagcagtggatcttttttttttttttttgagatggagtctcgttctgtagcccaggctagagtgcagtggcacaatctcggctcactgcaacctccgcctcccgggttcaagcaattctcctgcctcagcctcttgagtagctgggactacaggcacgtgccaccacacctggctaattttttttttttaagtagagacagggtttcactgcgctagccaggatgttctcaatctcctgacctcgtgatccgcccgccttggcctcccaaagtgctgggattacaggcgtgagccaccgcgcctggccagagcagtggttcttaagtgtagtccctggatcagcagcatccctttgcctggaaactgattagaaatggaaattcttgggccccacccaagacctactgaatcagaaactgtgggatgggacccagccagccgtgatcctgctgtgtggtgagatttgagccctgccgcaccatgtgcctcctaacccagcctacacccaggtaacagccaacagccaggttgcaccacagccgtggcacaaactatgatggaaaatgtgtcttcctggttttactcaaacttgcatgttttgttttattctcttttttaaaaccacaaactcttggagactgctagcttcaactttttttctttgcacgaggtttagtggtagttgtatctttctgttgagtaatgattagttgtctcataagagagctaactagaaagacagcctattcgcagagaatcggaggggtttttctttttcagtttttaactttggataattgacccccgtgttccccatagcctgagtcctgctggggtagcagctctgcctagtggagggcagggacagggaaggccctgggagaggaagacagctggcttactgctgtcagtctacgcttattctccgtgaacgagcaagtgtcccaaggtcctttgagggaccagggtctgaggcactgggctgctggatgtgtgcagcttatggtagcattgtgttttgcttctcatgagaaccttgtgggagccagttctcaccccatactcagcaggctgaggtcagggtagctgtttatggcttactttttttaaatttatttttatttatttatttgtttatttatttatttattttgagacaaggtcttgccttgttgcccaggctggagtgcagtgcaccctagacctcccggactcaaggcatcttcctacctcagcctcctgagtagctaggactacttaagaggaagcaggggaggaaggggacgtggaggtggggggtcctctctaggttgcccaggctgttcttctgggctcaagtgatcttcctgcctcagcctcccaaagtgctgggattacaggtgtgagccactgtgcccggcctactggtttattttttaaagcacatggcaccatcttactgtgaactatcttttctcctcagcacattcccacatttgggagtaatagttagctggaaatactgtgggtcttttaatttaaacttttgtttagttgtaaatttcaagctcattggacaacacaaacagcagttttatcttgagatgcaagtttatgctgtgcatcagagcaacggtattagctgacgctactcatccattcagcatatattaaaatttattgagcacctatcttgaggccatgctctattccaggtcttggggatacatagtgaacaggacagacaggaacctctgcctccctggagcagacaatgtagtagaaggaggcagggagtgaatgaagtaaataagcaagtactagggagagaatcaaggtagagaaagggaatggagccctggggctgggggtggcagagagatttccagttttaaattgggtgatcagggaatgtcccacctagaagatgcatttgagcaaaggcaggcaggagactggaccatgtgttttcccagggaaatggtgttcttggcagagcagacagcaagcacagagtccctgtaggcctggtctgtgctgggcactgtactgaacacttgatgctgactattgaattgactggtcacagcatccttggaagctggttctgccattatgcccattttactgatgagaaaacggaagctcagggagattaaattacttactggcggtgtcacaggtcatattgggtactgctgggacttgaacctgacagttcagttcagcctcagggcccatgtgtctaaccagcattgccaaacagtctcccaagcagagatttggaagcctattttatttatttatttttatggtttttttttaattgagatgaaattcacataatgtaaaattaaccattttgaagtgaacaattcagtggtgtttaatattaatacattcacaacgttgtacaatgaacacctccgtccagttccaaaatgttttcgtcaacccaaaaggaaaccccatacccataaagcaattgctccctgtttcccccatcccctcccagctcctggcaacaaccaatgtgcattctgtccctatggcatttacctattctggaatttcatttagaaacggaatcgtgtattttattcattttttgtataaacttcacagataagcaagcacgcacagtgaaaatcgagcctctttccctggtctgtctagtcaagtgttctgggtgtaataagcatgtgtgtgtttctgccagccccagtggtggcatgctgttccactgcacagcgtcttggcagtggctctacatcagcatgtgttcagctggctatacgtggctgctgtgcaatgtgcctaggtcacctaaggtcacctaagcagccctcactgatgggcctttggaatgtacccacctacaaggggcaggcgtagctgcaagatgagctcccaggagtgggactgtggggctgcgtggtttgtgtcctttaggtgtggcttggttgcttcctgcagagctcatgccagggctgagctgccagctatgtaggagagggtttgctccacacctgctttggtggcagagcttccatctgctcttctgcgacctaccttggggcagaggaggaagtctttcggtctgaagattggcagtcattgcctggccctgtgtggggaccatgaagagaccacatgctcctccagaccactcctcccttgtcggtagcctgaggaggctggacagctgaggggctccctcccacagatactttttcctcccctacatctggtattacttgaaagattttgtctacccaacacgctacatttgttaaataatggttagattctacttccaaacagaagaatgtttaatggtgcagggcgcttggcagtgagagtcagagtgacacaactccccatgagaggtgatgtcactcaggccaaaagcaaagcaaagtagatgtttgggttagcttgggccccttcctaggttgaactgaaggtgtccctttgggcatttgactttgtgggaagagcttgtgaatccctgttgccacctttgtaagcccttagagtctcaagatgcccagtttccagttactgattaacttggcacgggaactctcctggcactttccatggctggtctttgtgggtttagtaaaataggatcctacagaggcgtgtctctttccctactctgctgggcctacttcctcctccagccatcctccccaccccctgtccccgttgcctctttgtgtctctctgtccatgttgttgggtttttggtcttctaggcgttgctcctggcctacaccacctagtgcagtgtggcttctgttttagcaccactgctgacactgcagaggtggggtgcagagggcaccgtgcctttgttagttgtgccccaccgtctcctccatgtgatccacctatcttcctcacactggtcctcttctccctttctaaggaaaaaggacacaagccgggtgtggtggctcacacctgtgatcccagcgactcaagagactgaggcaggagaattgcttgagcccaggagtttaagaccagcctgggcaacatagtgagaccccatctctacaaaaaacacaaaaattagccaggcatggtggtgcacacctgtagtcccagctacttgggaggctgaggtgggaagattgcttgagcccaggaggctgaggctgcagtgagatatgatcatgccactgcactccagcctgggtgacagagggagaccctgtctcaaaacaaaaacaaaaacaaaaaaccccacaaataaaccacttgtcataggctgggtttcctgggaagctgactgagacagagttgaccatacaagggcttattaaaaggtgcttttggggtccccacctgtggaagatggagaaggaatcaggagtgggtagaggagagctgagctgctgggacctgaccccgcagggagcctgggagctggaaaagtcctttagggtcatcctagttggcctgacatggcctggccttcacactccctcatggatcagctgttggctgtgggctgcccaggaagatggtgactttgggcgaggcagctctgtgcagctgggatagtctcttcaggggctgacaggagggcaacctgcctgccgcaccccagcagctgtgccctcccctgtcctcgccttcatcgaagggcctttgcagcatccccacagtgcccccttcctgggggcaggtaggagcgggtgacttgggcattatggttctagtagtagctaccgtgtgtcaagtgccagtggtgtgccgggcactggagttcagtgctttgtgggccttgttggcatttaacctgcacacttagttttgatgtaggcaccattctctgtttacagttgagaaaccgaggccagagaggttaagtgacttgctcaagaccatatgggtacaagtagtggtgctcccataccagtcgggattttgcttctgctctgaccacttgcatggtgggactaggtggtctctcacgtctgagtggatgccttctattgcccctccagattcattctccacccacgtactgtagggagcttttgtgggctccttgcgttttccatgccttcttcccccatatttcaggctgtggactttttttttttttttttgagacagagtctcgctctgtcgcccaggatggagtgcagtggcgcgatcttggctcactgcaagctccgcctcccaggttcaagccattctcctgcctcagcctcccgggtagctgggactgcaggcgcccgccaccacgcccagctaattttttatatatatgtttttagtagagatggggtttcactgtgttagccaggatggtctcgatctcctgaccttgtgatccaccctccttggcctcccaaagtgctgggattataggcgtgagccactgcgcccggcctgggctgtggacttttgtgtcccctggacctgaagcccctgtgctcaccctccctgctgtgggtgggcctggggatctgtcacggctaaagctaaccaggagagagccacattctgctcgctgttaggaccagaggggtgggaaaggcaagaataagcaggttccagggtctcctgtacccaggaagtggatggacaggcctgctcctcaccagcatggagaaaggaagggttggcattgtgtttggtttttctgtctttggtggatgtcctttcagcagtatcctaacccagaaaactgcagtgacagaccccccttagcctgggatcctgaaagcaggtgtgactcctcctgagaatggccctgccctgaccggggccagggagcctgtcttacttgattttactttcctggcaatgcacagggttaaacgagcagtccaagcaaggaacatgtggatgtcctatctatgtacctacatgtcctatttgcatgactacagatgccctatctgcatgtctacatgactacagatgcccttccatctgacagtctgttgcacactgagctgctcctcgttttcatgactttttttttttttttttaaattgagacggaggctcactccgtcacccaggctggagtgcagtggtgcgatcttggctcactgcggccaccgcctccccgggttcaagcgattctcctgcctcagcctcctggatagctgggattacaggcgcgcaccaccatgcccggctaatttttgtattttcagtagagacagggtttcgccatgttggccaggctggtcttgagctcctgacctcaggtgatctgcccgccttggcctcccaaagtgctgggattacaggcgtgagccactgcacctggcccttcatgactttttaattactgtttatcagactttattagcaatagatgcttgaaatatggtgcttaattccagcctagattaaaaaatcgagcatttttcacataaaaggaaacaacatgggctagtcttgtaataaagcagcccctccagaattccagaacagaggtctgtctgtgttccccagaggcactggctaaccagcctcctcccatatcaggcatttcattaaacccaaaccaactgctgaagtggaagaaagtgacagaagctcaacagctgtgtgcctctgtctgagtgactggcatgactagatatgatgacgtggggactgccaccagaatgccttttggagatgtgccataatttgaaccagccgaatccaggtttccattgacatggaagtaaatttctgactctgctggtaacatttgtcagtgacattcaagactccaatctctctggccctgcagatgcacacccagggatatggggatgcccaatcctttagacatcgggcagtctctgtgcattcttttaaaaaattgaggcagagtctcaccatattgcttaggctggttttgaactcccagcttcaagtgatctcccacctcagcctcccaaagtgctgggattacagtcgtgagccactgtgcccagcccatgcatttttttaatggaccaggcaatcttcctaagtcaggaagacatgtattcttaaccttttattgatgtacgatgtacacatatcatagatgttcacaaagtgaacccatctgtgtagccaacacccagatcaaggcagaacatgaccatcacccaggacgctccttgtgcccctgtacagtcaccaccaagtgtccaaggatcagctgtctgatttctgatagcaaaaatgggcttttaaacaaacatgggatttgatgtaacttttaaaaacttggaaaatgtaaaaacacattatggcatgtttggggatggatgaatggagatcgtgtggctgacctgggtgaagcttgggctggagacagcaaggagttggtgccgtctgcccagggccacctccactgtatgtcctcctgggctggaagctcgccctgtaacagcggtgactcctgtgtggtcagtggtcaaggactggataccgtctcggtcctctgtgttctctgaagggatgtgactacatcatgtgcctcagccccgtccctgcatgccatctctctccacagcacttctcttcagagttttccaggggcagaggtgaggaagctctcaaacttcatttagataggttcatctttttgctcaatcagcaggtcaatgatgcatacgtgtcaggtcacactgtgttctcagcactgggttgagtgctgtggggaaggacagccagtgcgatggattcacactcctctcactgtgaccttggagaccctcgctctggcccacccctcctgtgcctcaccttgctccttcttccccgtcatcccagccttgttttctctgagcctgttgaggtccttgccttggtggctcccaacggatgttcttctggccagtgctgtgctgccaatgccaccaatcccttccaagcaggctgatctgctgggagctgtagccctggcgcgtcccgacatggattcccacagcgtctgcctgtcccgtcatgctttctctctggagtcctccctccttggtatggtatgtttctgctctgttcttttgtgaccaggaaagaatgtcttgtttcttccatccagccctcctgctctttccattaacagtccagaacatgaaacggttattttgacatgatcattcttgccaggggtcttaaaaagttatgtttctttacatctgttgatttgtgactgtcacataggagacagaactgtgcaagaaagacacatatttgggagtcaggaaaccaggtcttctgggcctgataccaccagcagctcagggtgtgatgttgggcaagtccctctagctctattgagccaagatgacctctcagggtccttcccggcccaaagtcctgtgacagtggcattaggtataactagatgcctgggtttcagctaaccatgtaacagggactgggcagcattattgttggcagtggcagagagcctggaaaggcagaggccaagcggcctggcatcccagcccctttccagacctttacggaattaaaaaacaatttttatttttagttatggttacatttgcaattgtaagtggtaatcatttttactttagatattctggaaaatacatacaattaaagaagaaacatgaatcactcatgtaccttccattcttagaataatcagtgttaagactgtctgcagaaagtatccagtacaaagtagtggctgagcccactggtgatacagaatgtatcaggcactgtgattcttggatctctggccaaatgtagaatcatttactgagctaaaggccaatttgcttggaagagtgcatctaattaaagtgagattagaaaggacgaaaggtgtcctttaggaaataaccacacatggcaagccactggtatgatgatgatcaccaaccctgcaggccttttgaggcgctcattccaattaaacttgtcatccttagtgcagggggcagctgggagctctggtttgtggcgttcactgtccttgtttgtaccggcatgacccagtcctctccgtgggctcctgtggcgccctgggtgttgttgggtctcaggcctgatcatttgtcataggacagtgggctcaggcccagcagtgtctgggccagtctcccttctttgtcccagtgccccacatgctgtgggctccgtggatgcctgttgaaggagcggagggacttccattaggccgtgaaggtggaataagggatttttagctggggttatggctctgagacagttttactaaaattggtctagcagtttctctgccagacacttttctaagcacttcttatgctttactcacctgtattacgttgttcaatcctcccaacaaccctactttattaaccccatttcacagatggagaaactgagctacacagaagttaagtggcccgcctagtacttttatgaagtatctttgctgagtctggctgctgagttggagattttgaccactgtgttgtgatgcctcttagctcttggaagtttctcctttctaacaaagaagaaacttcaggggctactgtggctagggtaggtcaaggctgaggtctttttgtactctggtggagccagggccattccaggagcagcaaagaaggcagagtgtggaggcatgcctgagctgactggaggagttgggtcccactcttgcaacgagaggctgtctccagctttctcttctgtccaggagcctgtgcctgcacaagtgcctccctgcagggcagtggacagagccccagaggctcggaggcacatgggctgccttgtgttcctctgaagaggtgtgggttagggcaagtggaccatgtcctcaggggtgctcgtgtgacatccccaagtgctgcaggcataggtaggggtgtgccagcccatacttcccttgggcgtgagcaagatgccttgtctgggggtcaggagcaaccccaggctgtgtgcagaggtgcttgaaccaaattttgttttgttttgtcttttgtttttgaggcagagtctcgctctgttgcccaggctggagtgcagtggcaatatctcagctcactgcaaccttgcttccgagtttcaagcaattctcgtgcctcagcttcccaagtacctgggattacaggcacactccaccttggccggctaatttctgtatttttagtggagacggggtttcaccatgctggccaggcaggtctcgaactcctgacctcaagtgatccacccgccttggcctctcaaagtgctgggattacaggtgtgagccaccatgcctggcctataaccaaattttggatgacactgtccttagagtccatccagcaaactgaacagaaaccttgtcctaaaacaaaacaggtcaccgaaatttccaaggcgtggcaacgcagggtagcacttgccagcgaatatttatatccactccagtttttgttttccatttttccccttacagggaaaccagctggacacagggtctcggggtcacacgggaaggcaggagactttctgcttgagtgtttcaaagggagttcttgggatccacagccaggttatttttaagttttgagagccatgagtttaaacttggccaagttccttcctcatctttcttgttgtgtgactgtcgctgtgtccccggggagtgaggatgggttactcccggttactgaaagctggtggggagcatctcaggggtctctacctccctccccacaaacatgttttgtagcacacaaaaagttctggaagcctgccatgatgctgtcattccagggagggagtttgcatttagcatgggtcctccctgcagctagttctggaaggatagtgactgaggtacttagaggacctagtgggtaaggcacccctcttagcaggcaggctccaagtcagggggtgagcacatattccagcaggcccgagctggccagcatgtgacggccatttcaggtggtaaagcaggagcagatttgctttttgtgcccgaaaccccttctgacaataacagcagcttccctgttcccctgcacctccctgtcagccgagttgatggatttcctttcagcagggtggaaccaagttatggccacgtttgctcgcgtgatggttagggctggccctgaggttttgcatctgccaaaatgtcgcctgttccctcccctcctgctacctcagtttgcattccttcctgatgatgcagtgaggtagtaaatttagaaagaaatggaattgggggcagctcagctgctggccatggctaggttccagggcatttgctgacagttatctttacattaaatgtgggcagcaaggattgcattgcaggcctgattgtgctgctttctggctgtaagcttgacttttctgcttcacttttctgtcctcagtttcttcatattatggagactggaggtcctgtgctgcttataatcctgtgtcctttcccttgctttgagcctcagagccagttttagattcagggttgttggctgggagaagactcttggctctgagggtgacagtggtttagggagaacttgcttcggacaccttgtgtgtatgggcgggggcatcgcaggcatgtacattggttgaacttggaagctttccctcatttgcttgcagagaagcccactgacggagtgaagaagcctgagttggggagggtgtgaaaaacgtgtacaatgacaaagtttgtttagaagcaagagaggccctgtctctaagaagtaaggagaatgacgctgggcacgtggctcacacctataatcccaacacttttggaggccgaggcgggcggatcacttgaggtcaagagtttgagaccagcctggctaacacagtaaaaccctgtctgtactaaaaatacaaaaattagctgggtgtggtggcgcatgcctgtagtcccagctactcgggaggctgaggcaggagaattgcttgaacctgggaggcggaggttgcagtgagccaagattgtgtcattgcactccagcctgggcaacagagcgagactcggtatcaaaaaaaaaaaaaaaaaaagaaggagaatgaagaaataaaaccaaacactgaattagtgataaggttcaaaatagaaaccgaaagacctggtctgtagaagttactcatgagatatttgttgaatgaatgaatcatggtatgtatttataatattacccaatcagaataaaaaagggaaatattttggtgacagtgctactgtttgctcagcagtagtggctaagaaacagtggatgctacataggtattttctccataacttgtgcctggtagtagctgtgccaattttcaccagaccttgattacctgttagagttttgaagggagagcttatctggtgaggacttgggtgacgttgcttgtgggaggagggccaagcacggaatggaagttgaatgttagaagtgctagacctccagattcagtaaacttggagaatccctgtcccttgtggtaaacttgagacttgactacattttgcggttaagggaatttcagtcggtcagcatataacctgggggagcttcatgatgttctcttcttttttctttttaattcataggtgtgatcatagtacactacagcctcaagctcttgggctcaagcagtcctcttgcctcagcctcccaggtagctgggatacaggcatgtgccaccgcgcctggctctgaatggttccttggtttccttggtgggtggagctccagattcctgaagctggagttgtgggcatgaaccccaagtgggtcactggctttcctgcggggttccacagccctcacttacccctgccccagacctatctttgcattaccacatccagaaaaagtagttccaagccaggataactcattcattcagcagctattattgagtacctactatgtgcaagagactgaattaggactactagggcttccttttgtcacaaacaggtattgcttagttcctcctgctgtatctgagctccttggtagtggggtttttgtctgttttgttcactgttgtatccccagggcccaaggcactgcctggcacacagcaggtacccagtggaaacttactgaatgaggctgggtgcggtggcccatgcctgtaatcccagcactttgggaggccgaggtgggcagatcacaaggtcaggagatcgagaccagcctgaccaacatggtgaaaccccatctctactaaaactacaaaaattagctaggcatgatggcgcgcgcctgtaatcccagctactcgggaggctgaggcagaagaatcacttgaacccgggaggcgagtgagccgagattgtgccactgcattccagcctgggcaacagagcaaggctctgtctcaagaaaaaaaagacttctcgaatgaatatgtgtacactctggccagatgtggggagcagatactccctgacttcctcctgagtgtcagtgcctttagctgggacacacattctggcatcaatccataccctacactgacgtggtagggaggcaggggcactgggctgctgtccacatccctcaccctgaccagagttactcagatgagcgctctcatgtgggtaggagatgcctttggtagctgaggactagaggggccagaaagggttgggatacatgctttatctggatagaaacttatagagttccagggactagctcaccaaaggcctgcgcaggtttggcagggagcagggagacatgctggcaggcatgcatggtggctttgatttgaggagctgttggtgggaatgaaaagcctaataagcacgtgggctttggatctgccaccccccagctctgccaacagctgtgagaccttgggcgggttgttcagcagccctgtacctcagtttccccatcagtaaaatgtgcatatggttgtgaggactgaattagctagtatctgatctaagttgtccagtacgggagactggccacgtgcaactgtgaagtacttcaaaaggtggcttttctgaactgagatgtgcttttgaagcacatctggattttgaagacttggtatggagaaaagagtggcttattaatatttttcatattgattctatgttgaaatgagacttttggatatattggcctaagtaaaacattaaaattagtttcacctatttttacttcctaagtatggatacttgaaaatgtaaaatcgcacgtggcttgcatatttttctgctgggcagggctgtgccttacaaagcacttagaacaggctgtaacacatggtcgtttgctgtatacattctcttgctttgtcattttctcaaaagcatggaagcgtctttaccttgtcccatctgaaagccaagcccaatcgatttgttcagaaccacaaatgcttaaacaaaaagatcatcatttgttcaagggaggctgatttcatgattgccaaccaccaagtgagcccactgaggccaaatgcctgatgcaagggatggcaggctgctcccacgcagccttagaacgaatccgttcccacttgaagcaggggggctctggggtccgaagctgctgtgtgcacagggcttgatggagcaggtggtcattgcagctgagccaactttccagcgccttaaaaaatacactcagtttagcaagtacaggcagaaagcccaaagagatggcccatccccttgagggaggtagagaagtgaacgatggtgtttcctgtcccaagaggtgggaggaaggctgtttgggatttggctcatcaggggccacaggctactgggatgcctatgtcctatccctctgtgtaggctatggagccctttcctgggtatgggcctcccaataagcctgtggccaatgcaggggcaggctgggaggtggctttccaggcagcttgcaaaggcctgtttgtctgaggcttgtcctgacatcactgaggctttgcttgcaggtggcagggacttacacagaggctctttgttggccagccacagaggtcagttagaagccatgaatggactggagctggcagcccctcctctacccatagcacacagctgccacctctctgggttgcccatgcctgacggtgggtgtgtgaggtgtggggagaggcatctctgcccaaatttgtagccagagagcagaggaagtgaagttggtgggaggcggtgaggaaggcagggagaaagaaaggaggtggtgttgaggaagctagcatggcttctgcccagctctgtcatggtttgcaggtgcgcgctctctctctctctctctctctctctctctttaaagacaaattctcactctgtacccaggttagagttcagtggcaccatcttagctcactgtagccttggcttcctgggctcaagcaatcctcccatcccagccccccgaataactggaaacacaggtatgcacaaccatgcctggctaatttgttaatttttgtagaggcagggtctcgctgtcttgcccaggctggtcttgaactcctgggctcaagtgatcctcccacctcggcctcccaaagtgctaggataacaggtgtgagccactgtgccaggccttttgcaggctatttgatgtctgcattggatacttggggtcaggctcaatgcctggaagtcatttagtgtcattctgctgtgctctattactttaagcattcacaagcctttccacactctcacttcttgataggaggagtgtctaggaattgttttcaaaatgctgtatttgcatacagagaaatgtgtagttcagtgagttttgacagatgcatgcacctgtgtgacccacattcctatcaagatatagaatagttccatccccagaaagttccctcatgcttctttccagttagtgctcacctccaggcaactacaattctgattttttaaaatcatttattagttttgcccattctaagatgtaatataaatggattcatatagtatttatatacagttgatcttcattatccacagattctgtatttgtgaatcagcttacttgctaaaatttatttgtaaccccaaaattaatactcacagttcttttgtgatcattcacagatataacagagtgctgaaaagtttgagtcccctgacgcctatcttcccagctgaagtcgaacaaggcaacgctccgccttcttgtttcaggtcatgcagtaaacaggtgtccttttcatggtctatttagtgccatggtttttgcatttttgtggtttttgttgatgattttgctgtttcaaatggcccccaggcacagtgctggagtgctttctagtgttcctaagagcaagagggctgtgatgtgctttacaacgagaatatgtatgagagaagctttcttcaggcacgagctacagggctgttggctgagggttcgatgttaatgaatcaacaatatatactaaggaaggtgtctctaaatagaagcacacataaaacaaggtcatatattcatcagttgatgaaagtgttgtggtcagaagttttcagaaacctaaccctgtatttctgccagaagcagtggttcagtattgactgattcagtattcttgccaaataatgagaatcaactatagtactcctttgtccagcttatttcactcagataatatctgtgaaattcagctatgctgttgcattatcaactgggctttttgcattatcaattgtgcttttgttttactgctgagtaatattacattgtatggatacaccacaagatttgtttttccatttccctgttgaggtttttttttttttttcatttttggctattatgaataagtctgttaggattgtttttgtgtaagactttgggttttttttttgtttgtttttttcttttgtaaatatgggatctcgctatgttgtccaggttggttttgaactcctggcttcaagtgattctcctgccttggcctcctaaagtgctggaattataggcatgagccactgcaccttatatgtacaagtctttgtatagacacaggctttcgtttctcttgggtaaatacctaggagtagaattgctggatcatggagtaggtgtatgtataacttttttagcaactgccaaaaacttttccaaagtggccgtgccacttagcattcccacagcagtgtgaaagttcctctgattctccagctgtttttagaatttcttgggggccctgctttacttgttgctttctaagccacctgttctctgagctggcaacgcttggctgataccctcccaatttcctctgttaaaatattatcttcacaagatattttattcctttcttgatagtgatgggctgtgagcccatcactattttactttgcttctttgctctcttaagagtttgatttaaaaaacatttttttgtttttgcttttaccagttttctctagtacagaaatcctcttaggctgggcacagtggctcatgcttgtcatcccagcactttgggaggccgaggcgggtggatcacgaggtcaggagatcgagaccatcctggctaacatggtgaaacccagcctctacaacaaatataaaaaattagccgggcgtggtggcgggcacctgtagttaaaaaaaaaaaaaaaaaaggaaatcctctgcccgggtgctgtggttcacgcactttgtaatcccagcactttgggagctgaggcagggggattgcttgagcttagagattcaagaccagcctgggcaacatggtgaaactttgtctctacgaaaaataaaaaaattagctgggcgtggtggtgcgtgcctatagttccaggtaccggggaggctgaggtgggaggatcatatgagcccaggaggtcaaagctgcagtgagccatgatcacaccactgcattccagcctgggcaacagaatgaggccctgtctcaaaaaaagtgataataataataaaataaaaaataaattcctgggtgtttttttttttttttgccgttttttaaaccttaaacacagctaactgtagaaaagtcagaaagtatagaaaaaaattggaaaggtcaccgatcatcctactctagggataatcactgttaggatagacttttttttcttttacacatagatatttaattttaaagaatttgagtgaactaaaattaactttgttgtagatttggggactttagtgaaagttgggccaatagaggatgtcggggagcagaacttcccctcttctctcttggggtcctggtggggtctgaaaactaaattgacataggtaaatagaagagcatacacatttaataaaagttctatgtgacacgggagccctcataaacaaatgaagacccaaagcagtggcaaaacatacatgtgtttatatgaggttgaacaaagagaggcatttgtgggaaagtaaccaaattatgtggggaggctaaaggaaagtaagccttattttaacaaggtctgtttgtacagaattttctctgctgttactctccattgaagagtgtttgttttctcatggtacagggagggcaccttttattttattttgtattttatttgtatggatttaggggggagaagtgcacttttgttacatggatctattgcctactggtgaaatctgggttttagtgtaaccatcaactgaacagtgtaaattgttcccactaagtaatttctggctgggcagtaatcccagcactttgggaggctgaggggagtggggatatcttgagcctgggaagttgaggctgcctgggccacatggcaaaaccccatctctactaaaaatgcgaaaaattagccgggcaaggtggtgcgtgcctgtggttccagctactttggaggctgaggtgggaggactgcctgagactgggaagttgaggctgcagtgatccatagtcacgcctgtgtactccaacctgggtgggttgacaacttgtctcaaaaaaaaaaaaaagtaatttctcatccctcactccccacccaccctcttccccttcccttctaagcctccaatgtctgtcattccgcactgtatgtccatagggagggggtaccttttacatgggagttttcgtctcctgaagatgaagatgcccttcttgcatctgctgtttttcaagtgtctttagtttgatataatactatgtcaaagtggcatattttggggcggcatcttcagccagccttcaggggcctctagggattaaaaatagagttcagaagccagcatatgaaacattttccctttctgctacttgttggcaatgctgcttccctctggtttaagaaactttctgggagacttgtgtcaccccagtttctgcctttatttttcgcaggaatggctgggttctattttgatatgagtaattttggaatcagaattgagaactgggcccccttcctcctgaccccaacagggatctcttgccagctgcccccaacagggatctcttgccagcatcttcctgacaaacctctgttccttgctgtctcactctctcgagggacagctggacaagtgtcaatgagttgagattgttagaaggtttttcttctccagccagcagccttcccaaagacctgacctacttagcaggcagatggatcctgtaaaaacaaaaccgggtcacatccctcctgggcttggaaagaatccttcagtgcccccgaccccttcttcctcacccacagaattggagccaaagtcctgaaagtagccttggaggtcctgccttccccaccctgagtccctgctgtgtgctgcacccgggtccccctcctggctgtgagcccatcactattccagtttctttccactgcacaaggtagttgttcaggcccctccctgaaagatgtgttggttcttcaagattcacaagcaaatcatgcctgtgtgtgcattgcagatagctcacttacattagatttgatatgagaaagtctttttttttttttttgagacggaatcttgctttgtctcccaggctggagtgtggtggcgcaatcttggctcactgcagcctctgtctcccgggctcaagtgattcaagctgaggttacaggtgtgcgccaccatgcccagctaatttttgtatttttagtagagacggggtttcaccatgttggctaggctggtctcgaactcctgacctcgtgatccacccgccttggcctcccaaagtgctgggattacaggtgtgagccaccgtgcctggcctatttttttttttttttttgagacagagtctagctctgtcgcccaggctggagtgcagtggcaccatctcagctcactgcagcctctgcctctcaggttcaagcagttctcctgcctcggcctccctagtagctgggactacaggtgtgtgccaccccacctggctaatttattttattattatttgtatttttagtagagatggggtttcaccatgttggccaggctggtctcaaactcctgacctcaggtgatctactcacctcggcctcccaaagtgctgggattacaggtgtgagccactgcaccagtccaagatagtcttaaaaagcaatgtttttgtcttttctaagaaagggccctgatggtttgccctgcgttacactcccaggcaggcacagaaccgatgttaaactctccattttatcacatgaaccctgcccagtgccctacccattcctcccacgccaggctcatgactgcatgtcaagcacagttgtgccaggtgtctacctgctccatttctcctcctcccagcagccctgcaaagtgcccgccaattttctctcctgttttgaagatgcgaaaactaaagcagagagccacaaggtcactcacctggtaagctgcagaactgaacaaagtgtgcttgtgaaactttctgtttgttctaaggagacaactgtgggtgggtggactctgctggaggctgtcccttgcctggctggcagcaaccaagccttctgcttctgacttgctggggagcgggaggacgggaagggctgtcggtggggaaattggagagaatacaaaacctcccctcagctttaataggctctaccaacagttttcactttgcctcttttccttctctggtatagccttcctcctctttggtgaatgcagattcagagcatctctaaaatctactctgtgttacttctgaggagaattcgggattttattttttctggaaaaatgaaaggattttcattctggttcccttctggttccgtgtggtggggcacctcactgcctgaggtcactgacctctgagcccttcttgccactccagtcatctctgccccacatggacacactcagccgcctgctggagtttgtgttttccgtggttggagggaggcaggagggcagttgaaagcgtgctgagtggggagatgggagcagggagctgtgagaaggagagaagctaaggtcagattgcgtgcgtcattcattcattccttcactcacttggtagatgtttattgagcgcctgctgtgagcttggcacctgctcaggtcaaaagggtggctgagtcctcaagggccctgctgtcctatggggacagttccaatacagtgtggtcattacccagtggaggagtagggaggggcgtggggcagggaaggagagagctcagtccggagagtctgggaggcctggggaagaactcaggaggttttgtgaagtgcagtgtgtggaatgtgggtgtctgtgaggagagtggttttatctttttatgaattcactgtgctaaggcctggaagaaaacacctttcctagaaagggagggaaggaaatgaacttttatggggcacctctgtgccaggagcagaggtaagagcttacatgatctcacttaatcctcaccgctaccctgtgagatgcatttattgtcacagcccatttggtgggtgaagaagccacaacgatgcccgaggtcagatctgaacccagtgcttataccaaaacccactgtttacagttccactgcaggagggaggctgtggacgtggggaggaaggtcttgccgctgggacccaccaggactgcagggtggtccttaggttcagcaagagtggacccgaattctggggctagtgatgctgtgattcctgatctgcttgctgtttaccaggagtgcttactttgtgaaaaattattgcgttgtaaacttaacaatatttgggcttttctttatgtatgcatcactaaaaatgttttttaaaaaactatactctctagaaaaggacaatgaggtaatggttttggaaatcataaaatgtttttgttgcttgtcttatctaaactgattaccagttgtgtgtataataaatgctagctcttctttatttatctattatttttttttcttgtagagacagagtcttactatagcccaggctggtcttgaactcctgggctcaagcagtcctcccgcttcagcctcctaaagttctgagattatagatgtgagccactgtgcccagctgcgagctcttctttatacttgagtttagattgccagatttaacaaataaaaatacatttgaatgtcagataaacaacaaataattttcagtataaatatgtaccatgtgatggtacttacactaaaaatacttgtttatctgatattcgaatttgcatgggacagtcactaaaaattatttgttgctatgcttaaattcacgttttaaggctgggcatggtggatcacgcctgtaatcccagcactttgggaggccaagatgggcagatcacctgaggtcaggagtctgagaccagcctggccaacatggtaaaaccccatctctactaaaaatataaaaattagccgggtgtggtgatgggcacctgtaatcccaactactcgggagactgaagcaggagaatcgcttgaacctgggaagcggaggttgtggtgagctgagattgcaccactatactccagcctgggcaacagagtgaaactccatctaaaaaaattaataataataaccaaccccccgcccccccccccaaaaaaagcacattttactgggcatcctatattttatctggcaaccctaaattaagctgagacctgaagggagtaaggagtacaactgagccttatttgagagatcagagaatttccaggccagatggaaggaaataatccagtagagaagcaaattggtggaggatgtcggatggggtattctaaattgctggtgggaaaactgaactgatgtcaagagtgggtatgtggagtgacctggaaagggagaagcgatatgaatgttgcactactcagcctgcatgatggggtcaagacactttctgctggaggttgacatttgttttagtagtttatgttgatgcaaagatcctgggaaacatgcatgattttgagccttttcacaaggaagggtgatgttaaaagtgagctaacttgagaaactggcttcaaaatctgggccaatttgagcaacaaaataaataatggtagaagggtattgtaacccagagaataaaataaatatccacaagtccttaatgatgatataaatacataagtggggagaagggaaaacttttgtacagaggattccattagtaaaatgtagaaagaatgatgaaaatgaagaggtcagcatttggaaagaccactgtaatagttgttgctgtcaagaatcatcaatggggctgggcatggtggctcatgcttgtaatcctagcacttggggagtccaaggtgtgtggatcacttgaagtcaggtgtttgagaccagcctggccaacatgatgaaaccctgtctctattaaaaattagctagaaatcgcttgaacctggggggcagaagttgcagtgagccaagattgcaccattgcactccaacctgggcaacagagcaagactctgtctcaaaaaacaaacaaaaagaatcatcaatggatgctgcatagtgggcaaaaatatgataaggaatctcaaatatttcttcataaagctcttgcgctaattccaaagagaaaaagagtaattttacagtggagaaatctggccaataccaccttaactaagtgatcaagttaacaccagcagtaaaatgttctattctgcatgttgacatcatgtacacccatgtatgatgtactgaggagggtacaccatcactcctgggacattcctgccaaaaatgcatatcctcagtctgatcatgaagaaacattaggcaaaccccagttcgggacagcatgcaagataattggcctatactcttccaaagtaccaaggtcaagaaagacaaagactgaggagctgtcccaggttaaaggagaccaagagagacaaccactaaatgcagtggatttagttccaggattgaattcctcccttcccctcccctcccctctcttttttcctttccttttcccttttctttccttacagggtcttgctctgttgccagactggactgcagtggtgtgaccatggctcactgcagccatgaactcccaggctcgaacaatcctcccacttcagcctcccaagtggctgggtctacaggcatgtaccaccacacctggctaattttttaaatcttttttattttatgtagagacaggggtcttactctgttgccaggctggtcttgaactcctaggctcaagagatcctcccaccttgacttcccaaagtgttgggattataggtgtgagccactgtgcctggccaacattttcattattatagaaacgtttctattaggcagtgctactctagaatatgatttttaaaagttgtgtagtatttacttaactttacctctgcattggttatttatattttctatttttcgtatttaagtgtttaatattttgatgagtagttttgtacattctttcttaaacaacagcatttaataacaggtatacttcacattaccgtaaatccatcaattgaaattgtgcaattcaggctgggcgcggtggctcacacctgtcatcccagcactttgggaggctgaagtgggtggatcaaaaagtcaggagatcgagaccatcctggccaaaatgctgaaaccccgtgtgtactaaaaatacaaaagttagccaggcatggtggtgcgtgcctataatcccagctactcgggaggctgaggcaggagaatcacttgaaccagggagttggaggctgcagtgagccgagatcacaccactgtactccagtctggcgacagagcgagactccatctcaaaaaaaaaaaaaaagaaattgtgtaattcactggtttttagtgtatttgcagagttgtgcaaccatcaccactatctaattttagaagaattttattatcccagaaaataaactctactcccactagctgtcactccctgctccgctgtcctccagccctgggtaaacaggaatctactagctgtctctgtgcacatctattttggggagaattttaaattattttccttaggaaaaattctgttaaattacagtagtctgccctcatgcgtgagggatatagtccaagacccccagtggatgcctgaaactgtgggtagtactgaaccctatacacactgtgacttttcctgtacacacatacctatgataaactttaaattacatatcaggcatggtaagagatgaacaaatacaattataaaatagaacaattatagcacaattatagcagttcactgtaataaaaattacgtgaatgtggtctttctctttcaaaatatcttgctgtactatactcacccgtgttttgacaatggttgactgagactgaggaaaggggagactgctgtatggggtcaaatagtgtgaacttttttaaaggaatttttttttttttttttttaaacagagtctcatgctgtcacccaggctggattgcagtggcatgatcttggctcactgcaacctccgcctcccaggttcaagcaattctcctgcctcagcctcccaagtagctgggactacaggcgtggctactgcacctggctaatttttgtatttttagtagagacagggtttcaccatgttggccaggctggtctggaactcctgacctaaggtgatgatcccgccttggcctcccaaagtgctgtgattacaggcgtgagccaccgcacctggccttttaaaggtttttgatgcatcatgccaaactgccctccagaaaggttgtccacgtttatgcttccattaagagtgtatgagagagccctttctctacacctcggtgacactgttatcatccttattttccatctttgtcaatcaggttagtgacaagtggcatcccctctttgcatgtgactcctagcaaggaacacctttttgaatgctgcttggccattcctatttcgtattagagttgagaaagctcatcagcctctgtgtggagagactcgaagttaagaccctcgtgaggaaaaaggaagaccagacagaagggtataaccagaggctgcaggctgggctgccctggcgatagctggaggagagcttcatgtaggagttgggggtggggtgcaggacttgctcaggggtactttgagctccttgtttccctgtagagtggaggccaggaatcatttaggccagggaatagtagtgtccttgggcaaaagtatacctacgggcagtctggcagggcaagctcaagctcacagtgattgggaaattgcattagaaacttcctttcccactgtgatgaagtaaggccatcgttggttttgaggccatgtgtgttttaatggcaagttcagaatgaaaaaaagtaggctggcacaatgaccctatggcccatagtggtcttaagtacttcctttgtggcttggtgatggctttacccattgacgtgagagctgcagagtgtgtgagggagagggcagaggcaggggatgtccaggatgccaggtaggatgcagggtgttgcgttatctacatctgtggttctcgtccctggctgtgcactagagtcagctggagagctttggccttacccccaaaacgggaccctgtctctggaggtagtgttgggcattcgcacatcgattctgtacagccagacttgagaagtgggaatttgatatgcgtgttagtcaggagcccagcagcagccacccctggagatcttttgtgagcttttagagtggctgggggaagactgttgctgtgatcattggtctagctctgtcccaaggacttggctcctcttcagaacctgctgatgcccagagctgtccaggtacacaggcagcaacttttggccaagaaagagccttgctcaagctgtgtttgggataactcataaaattatgttccaggctgatctttctagcatccctgcagatgctgactggatgccctgacccttgccccaacccctttcagcatacagtaggtggttcatagctatgtgatcttgcatgatgtctggtggtgtggtgggggcactgctctgggaggcctcccttcttcactgagagggaagtggcacaaaataaagtcgagatgtgagacgggggtaggagcagggccacattcattggctagcctggtagagcctttttatttaaaagctttccatcggccaggcgcggtgtctcacgcctgtaatcccagcactttgggaggccgaggtgggcggatcatgaggtcaggagatcgagaccatcctggctaaacagtgaaaccccatctctactgaaaatacaaaaaaataaaaataaaaagaaattagccgggtgtggtggcgggcgcctgtagtcccagctactcaggaggctgaggcaggagaatggcgtgaacccaggaggcggagcttgcagagagccaagattgcgccactgcactccagcctgggcgacagagcgagactccgcctcaaaaacaaaacaaaacaaaaaaaaactttccatcacaacaggagatgctgacttggtcgtcaccctggttggctgcatcctcagcctggctgtggacaggaaggaggcaggaattgtcttctagccaactgtcttgctaagggtgctctgctatcttcctttttttttttttttttgtaaatgctgcctttgctgggagagtggagtaggtgccccccaaagttcaaattgtttttcggctttgggtgtgcagaagatgatttaataccaattcagggtaacttatttcacgtggaaggctgcccaggccaggcagggttgtatctgcagttgaccagttttgccgtatgttaatggttttcagataatcttcctggaaccactgcagggggccaggacagcctaggaggcagagtggtctctgtcccaccctaaatcatagtgatttctcttatgtgtgttatatatagttgaggttccattgatactttttaaaagaaaagtttctacccatttaaaccatttgagaaccactgttgtgcacagagaaagttaggtcagcctgatttttatatatagctcactgatgccattaatatggagcctaaacaaacaagaaatgccgagtacctcacactcagtagatgccgaataagcatggaacacagttgtgtatgtgcctctgcctttcctgtctctgagccttcatttacctagaacaccttcctgctgactctggtttttgaatgtgttcagtgcttatttggcatctactgtgtgtgaggcactcagcatttcttgtttgtgggatcctttggggtttgaatatgccccccacagttcaagtgttggaaactgaatccccaaggcaacagtgttgagaggtgggacctttaagaggtgattaggtcatgaagactctgcccttgtgaatggattaataatggtatatctggagcgggttcctggtaaaaggatggatttagcccccttccctgctttctcttgcacatgctttcacccttccatgatgcagtaagaaggcccttggcagatacgggcccttcatccttggacttcccagcctctagaactgtaagaaataaatgtctgctctttataaattactcagtctcgggtattccattatagtagcacaaaatggattaagatatggcgatactaaaatatacagccagagccctgccctggcttatttggctcagtaagcttatttgtttgactaatatgaggagacatacactgctaaccctacctagtataaaatcataagccacaaaagagaggtgggagaaatgtttgagtaatccttggtggatcattgcctcctgctgcacatcttttaaaacgggaaactgtcccttgtttttgccctttcctgtgagaatattatgatttttaaaagaatcttgtatagccattttggaaaacagtttggcagcttcttataaaactgaacatattcttgttgtataatccagcagtcaccgtccttggtatttacccaaatgagttgaaaacttatgtccacacaaaaacctgcacacgaatgtttatagaagcttattcataatgacaaaatttggcaagatgtccttcagtagatgactgcatcaataaatggttgtatatccagacaatggcatattatttagcactaagaaaaaatgagctattgagccatgaaaagacatggagaaaccataaatgcatgttagtaagtgagagaagccgatctaaaaggctgcagagtgtatgattccaaagatacaacattctggaaaaggcaaaactttggagaaaataaaaggatcaatggttgccaggggtttttggggaggaacagatgaataagtggagcataggggatttttagggcagtgaaattagtctgtttgctactgtaatagtagatacatgccatacacttgtccacacccatagaatgtacagcacccagagtgaacccacacatgaactgtggacttcgggtgataatgatgtgtccatgtaggttcctcatttgtgacaagtgtaccactctggtgggggctgttgatagggaggggggctgtgcatgtgtgaggaaggggatatatggaaattctctgtagcttttgctcagttttgctgtgaacctaaaactgctcaaaaaaaaaaaaaagtaaattcattgaaaaaatactggaaggaaataggccaaaatgataaatatcattttttaaaaataattcccactgaagtctgttggcctattgactattaatgatctttcaaaaatccactgtgctcccccacctcctttggtgtccccgaaggagaggccctgggcacacaaacaccttcttctggggccactccatgcccagggttccaagggccacatttctctgtgcgtaggggtgggcttggccttcatctcctagctgcagccaagaaggagctatgctgccatcactgagctgggatttggggattcgctggtgccccaaaaccatgaagatactaagttttagggataagtagaacccctggaccttttcttccccggtactcccttagcccctcttataagtgcagtaggatggactggaaaggatatagataagtcagcctgattttgcgcattagatttaatctttgaacttcagtttcttcatgtataaagtgatgatgttttatagaattgttgttaaatgaagaaacacatataaactgtctagcaccgtgttggcacttgtgatgtttaataaatgcccattctaggctagatgtggtggctcacacgtgtaatcccagcactttgggaggccaagatgggaggatcacttgaagccaggagttcaagaccaacttggtcaacatagcgagaacccgtctcttttttataaaatataaaatgaaaaagcccattctaaagatggagcatcagggactggatgaacctcctgcctaaaacaaccaaaaaaaaaaaaaaaaaaaggccaggtgcggtagctcatgcctgtaatcccagcactttgggaggccgaggcgggtggatcacttgaggtcaggagttcgataccagcctggccaacatggcgaaacaccatctctactgaaaatacaaaaattagcgaggcatggtgttgcacgcctgtagtcccagctactcaggaggctgaggcaggagaatcgcttgaacctgggaggcggaggttgcagtgagccaagatggtgccactgcactccagcctgggtgacagagtgagaccccatctcaaaaaaaaaaaagaaaaaagaatatatgaaccaaaggttttcaagacactggacatcaagaaggtgattcttgagagataggaagcaaatgaggtgagcccagtgacagccccagctaattgcctcgagagaatttccaggccttggcacagggagggagaagagaggcagaacctggtggactccctgagttgaaaaggagctgagagtctatggggaccaaggcagctagtttgtaggactctagcaaaacctttgtgaagcaatatctgataaagaacttgtatctagaatgtataagaagttctcataacagtaagaaaaaaaacaggcaaaagatttgggcgtctcactaaagaagaaaaggatgacaaataagcaggtgaaaagatgctcacacacaacatcagttactagagagatgcagattaaaactacaatgagatgctactgtataacctattacaatagaatggataacatttaaaagactattcatgccaagtgttggcaaggatgtggagaatttggaactctaatgagctgctggtaggaatgtaaaatgatataacttcttcagaaagcggtttgtcaatttcttaaacagttaatcatccacctaccataagacccagccatttcactcctaggcctttactcaagagaagtgcaaatgtatgtccattacaaacgcttgtacacaaatcttgatggcatctttatttgtaatagcctcaaactggaaacaacttatgtgcatcaacaagcaaatggataaacaaactaatacattcatatggtggaataccacatggcagtaaagaggaatgagctcctgctgcatgtaacagcatgcgtgaatctcaatttatattgagtgaaagaaaccagataaagtacataaaccagataaagtacatactccagattccatttatataaactagaaaagacaagctaatctgtgatgacagaaagcagatcagtggttgcctggggagaggaagaggaagcggggagggattgcaaaaggcatgaggacatggggaatctctggggcagtggatttgatcattgtcttgattgtggtgatttcacaggtgtatagaaatgtcacaacacggggctgggcacggtggttcacgcctgtattcccagcactttgggaggccgaggcgggcagatcatgaggtcaggagttcaagaccagcctgaccaacatggtgaaactcttgtctctactaaaaatacaaaaattagccaggcctggtggcacgtgcctgtaatcccagctactcaggagactgaggcaggagaatcgcttgaacccaggaggcagaggttgtagtgagctgagatcacgccactgcactccagcctgggtgacaaagaagactcttgtctcaaaaaaaaaaaaaaaaaagaaaagaaaagaaatgtcacaacatactgatacagaagcagggaagagaagtgctgggtagaggagggcatggtccctggctagggctctataccagggacctaggtgaggacaggcacttctgcctttgcacccaaatattgcattttccaaaaccaccccagcctgccttgctcccatcctgggcctataaaaacctgagaccctagcaaggcagagacagaagctgctggacggcgagaggaacacatcagcggaagaagatacaagcagctggatggcgagaggatgccaggagcacaccgacagacgccaccacactggcaggccatcagccggcagaacgaggcagagtttggctggggcagtcggaggagagcctgtatgctcccctagaggtttgagcaggggggcactgaagaagcgagccacactcccattgcacaccctgtgagagggacaagggaacttttcccatcataataccaaattgcactctttaaataggtacagcttattatatgctacttatatctcattaaagctgttttataagaagattgcttgggctacaatttggagaatgggctaaaggggcagtaagtctaattgcagaggaaaaatgcccatcccttcctctcttctcctaaaagtgtatcccttattcctctcacttcccttctggtttttgagcttggttgttacagtaacatgtgatgatattttttctttcctctgttgggcatttctttaaaatcctgtggcatggggggccctggcaaagccaagggaggctaagagcctactctttttcttcttgttgagcctgagcctctcctcagcccagaccacttagtgaatgtacaggtgagattgggcagctcaccaccagtggtggcagggtctggtttctacaagggcatggccacagtgcagtcaccctgctccctatcccatagccagcgtctggagaggggctggctccaaatgagtgagagggaagtgtttgtggggggaacgattggtttcctgaagggcaatcagaaggcacgcacctgcagggcccctcacagaagggcaggaggagctgcgggttgccccccagggagaggccttgtgattgaggtcccagtcagaaagatggtcgtgtgtgcaagggacaaggtagaatgggaggtgggccagggtgggtagtaggagactgggggcagggctggtctggggtctgaatccctgatgaggtgatatgttatggggtgaggaaggagctcccctcatgatggggggggttggggggcatgtgtggcaggaatagccacagctgccaaccagatagtcataatgagacctttgagttggaactggggctcagattccctctttcaaacctacccactgtgcagacttcagtaagtgacaggacctttctggaacttgggttttagacaggagatggcagcagctccttcactggttgaaatccccaagtctggctaggtgcggtggctcacgcctgtaatcccagcactttgggaggccgaggcgggcggatcacctgaggtcaggagttccagaccagcctggccagcatggagaaaccccgtctctactaaaaatataaaaattagtcaggcatggtggtgcacaactgtaatcccagctactcgggaggctgaggcaggagaatagcttgaaaccaggaggcagaggttacaggtagccgagatcgcatgctgcactccagcctggatgacagagtgagactctgtctcaaataataataataataataaaaatccaaagaaaaaaatatctgtgagtccatactgatatactgcactccagcctggcgacagagtgagactctctcaaaaaaaaaacaaagaaagaaatctccaagtccagggtctggcccatagtagacacatgatttcctagaatgtgaaatgcagtttttttccctaccttttctgtgtaggaagtacttttagatccatttagccacaaggatgaaatcttttcctacctacttggcttcttatggggtcttcctcactctgtgacccatggtttcaaacacaggtggcttccttgttttgtatctgtgctaggtggtcactggtcacggtggagagaaaggatgtcagcagcccgaaggactcagctgcaggaacagaaagtgagggacagctgaaggcagagggtcacagccctcagagagaggaagccagaagagagtgtagctgagcagggtgtggagagaggggaggaagccctgccgttgagagataaagtggcaggaagtccagtggggcactggctgttgtcagagcatccacgtgaagacgctggccaccctgccagcatcttatgaacaggggtaggagagggtgctggatttcattccccaaacccaaataagatgcatttgcttctgccgtctgggccagcagcattgcactgacacgtgcaattcatttcacctttcctttttggtgagctgtcttgcaggacggtcctcttcatgtgctcatgctgtgggtggtggaaagggtgggcatgccatgctaagctgctgagtccctgtgcccctctgctgtttgtagccagcattttacaggaggttaaacaaagaggccacagcatttgggagtggttttacaccacgtttgtgagcagaattatattcacaaatgcactgctttaacattacatgtagcctgcttcgagtgtgcttagttgatgcctgacaaactagcttttgttgctcattgtaaaggcttagagtcaggtccaccaggggacttacgatgggtaatctggaagtggacttcggcattaccaaacaataacctaactcatatcttgacattttgccatggcctgatatttggcatttttcggaaagatttctcccccattgtcacatttgaattatgtcatcgccagttcccaatagatgtccatagaacccatttctctgtgtttaggtctgctgaggggatactaagtgcactctgtctgtggctgggggtgttcagagatgaataagaccctgggccttggaatgaagtgcttgtgggggaacagacatgtgtgcccaagatacaaggaagcaggtgccaggtaaggaagaaagaggaaaggactgtgcagggaactatgtggaatgtgattcaactcacacttgtttccttgagcacttgcggaggccacagttaagacatggcccttattctgaaggcacttgcaattcactaggagaggcaaatgcccaggtaactagcaactcaccacagcatggtaggtgctgtgcccagtggcagatgcaccaccaccatcacttccacatttgccccgtcccaaatactagaggccccacttggctcggcctggtccagtggtcactgtgcatgggcccctagcagcagccgcgacaccactgctttccagggtgacgagaccgcttaaaggagccttaaagatgagtggtgatgcctcaaccctgttgggtttatgctttgctgctaggtgggccccacagctccatgtgtgccagcaaaagaaatgcagtttgcccggaactgtattttctaccttgagagcataaggtacctaagttgtatataaaaatcattagacagaaagaaatgctgatgcctctgaattacttgatgctttcagtttcatactggtgggggctccctgttgactttgctgcttgcaaggaacagaaatgccagctgtccagtaatctcatccgcccgccaccctcccctccacaggcacatatacatgcacacacatgcatttcatggccattaaagagaagatggaagggagaaggcaggcaggaactttttgggggtgttggaaatattctatatcttgatttgggtttgctttacatagatcatttgtcaaaactcattgaatggtagacttacactttttgtgtctgtttgtgaattttacccggaaaaaaataagcctaagcaaataaatgatgaactctagttaatgatggggaggctgaagtgtttggggtgaagttgctgcctgcaactttgaaatgcatcaagaatgggatggattgttggattgattgaggaatggttagcaaaacatcaattatagaattgggatggtgagtatgtgggtaccctctgtataattccttcaacttttctgcgtgtttgaaaatgttgaaacagaagaagaactgcagataaccaatacttgtgccctcttgagctttctataaatgaatttctccaatggtcaatgtcttgtctgtttcctacagactgcttcaccctgcttcctggtgttggcagaggggctttctccttaaacctgttggtgtgggggaatttcatgaaggatgtgttagcttggacttcctttgatggtgatgcagtttatcaacttaaaatgatatgaactctgaaacacagggctttctaccctgtgggcagaaggctggggatttgcagcctgagaatagccctggcagattggagccagagttagaaaaggatgcctgagctcctcctgaccaaaggatgccagctggctaccttgctgggtgctaggggagcaattgatatttataaaatctgtgaagttgatttttcaaaaattttaacattatataatgtatttgaacatattcaaacacttttttgagacgaccttttaaaatctgtaaagtaatgaatgcctgctgtcttataaaaaactacagaaaatgtaaagaaataaggccagctacagttttacaacataaagaaaccactgtttatattttaatatattcctccgtgaatcttttttcatcttgtgcattgtttacataattgtgctgtctttcatttgactgtaatgggggagttctttgggagggagactccaaggcctccttgatgtggatgggcccggagcctgggctgctactgtaggggttctgggctggcctagcctgagagacctccagcctgttcacagagcccatgtgagatcccgagaggcccagaacttcttagacagctctttttaagctgaaggcactttttgcaggaggcagtaacatgattgtcatccttataatttgcctgttaattgagcatttcccaagtatggggccctgcactaagtactttgcacatattctcttaacagtaaccctacgagggggccactgttgtccccattttctagcccaacatcggagtttaattagtctgcgcttgtcacatagctagtaaattgtggagctgttttagaccaggtgtcccaataagcactttgtagttgaggcatgttaactctttagaactttttggttttcaaagcaactcttaattgctgctcctgggaatatgcagggcagatggaaggaacctctatttcctaattaagaaacggacacccagagagctgatcaccattaatccaaactacaggagtcacgggtaggtgggaggctcaaggttagaacctggctcttcaaatttgttttttcaggccaggcgcggtggctcatgcctgtcatcccggcactttgggaggctgaggcaggcggatcacctgaggtcagtagtttgagaccagcctggccaacatggtgaaaccccatctctactgaaaatacaaaaatcagctgggcttgattgtgcattcctgtagtcccagctacttggaaggctgaggcaggagaatcacttgaacccgggaggcggaggttgcagtgagccgagattgcaccactgcactccagcccaggtgacagagtgagactctgtctcaaaaaaaagttctctctctctctctcgatggatgatctccctatgttgcccaggctggtgttgaactcctggcctcaaacagtctgaggaaggaatcgtggggcaggctgagatgaaagcctcaggacttgagtgaacagaagggcaggagtagaatgtactaggtaggggcccatcagcaaaggctgggctaagaccctgtgggacttgttagggggtgaggagctgctggtagaagggcagggaagagcacttgcttgcagtctgacaaacccagggcttggggtgtgatatactttttgtaaaaattgaggttactaaatcctagttggtggttcccactgaaaattaaaggaaataatttagttggaattgtctggccaggcatggtggctcacacctgtaatcctagcactttaggaggccgaggcgggaggattgcttgagcctaggagttcaagaccagtctgggcaacatatcaagatccccgtctcaaaaaaaaaaaaaaaaaaaaaaaaaaaagggaggaaaaaagaaatttcccaacctgcatgcttggcatattatagtgatggtgcaatctttctgaactgtcttacaaacagtgggaaccttcgaaagctttgggtggggtgagggagggagttgaccaagcccaggaattctggacattagcataacagtggggcagggaaagtgggacctaaagtccagcctggtagctgttttctgcagttgaaagagtgacagagggagagggagagaaagacacttcaaatgagtcatccactggatttggtggtgggctggccatggggagggatggtattatgctttgttcattggcttttttatgactcagtttacactggttccctcctgactcactgatgtttctcttgtcctgcaaggagcctgtgtgaaatgcagcaaaggggtgtttggggctggccaggcctgtcaggccatggggaacctctaccatgacacatgcttcacctgtgcagcttgcagtaagtgtgggtgtgggtgtcgggtgtgtgggggatgcgtaaggaacatgggaaccgagaaagggaggagagagatcatctttctggagacggttggtccatggccctcctcagccccacagaaaagccagacagtgtcttttacagcagggtttcttaccaccaacagaagcccatcagggcacggtgacttaacacaataccaaagattgcctgtgattctggtgataagttgaatgagttcagagtgatccctaatcacatcaggtttgaaatatgtaagaagaggtttcagaagatttgggaggaagtgctgggattcaccatgtctaccctgtttgtcagttctctcccccactgtggggaccagccaaccaaaagtgattagtcagtcagctaccccagtgtgaggtggaggtgggggtcctttattactctgtaaccacctccctaacctaatctttgatttggaggctgctgtatgagcatgaggtgtgtgtgcatgccacccatgtgctggtgcctacctagcacacacctgtgggcatctttgtactccagtacatgcattataattcaagcagcccatcaggagtctggattgaatggatggcaaccgctccccgtggaagattctaacacattgcatgcttgccaagtctgaccaagttatggattttgcttgttttctgtctctatcaaagattaattttgaggagtatttttggaaaatgtcctacttatattctcaatcctatactgaggctaacagctctcaactaaaagggaatgttacagcagagtcacagggtgtcaggaacaaaggggtctttctaaccatctggccccgtggtttgcaatcctggctgctcattagaatcacctgtggagactttaaaaccctgctaatcagaatcagagctaaatcctaatctgataggattagctaggaacctcaatctgattctgctaatcaagggtggggccagggcatcacccttggaatttctagagtgaggcaagtgtattaattttttttttttttttgagacggagtctcgctttgtcacccaggctggagtgcagtggtgctatctcagctcactgcaacctccgcctcctgggttcaagcgattcttttgctacagcctcccgagtagctgggactacagatgtgcaccagcacgcccagctaatttttgtatttttagtagagacggggtttcaccatgttggccaggattgtctcgatctcttgaccttgtgatccacccacctcggcctcccaaagtgctgggattacaggcgtgagccactgcgcccgcccaagtggggcaagtgtattttttcacagcttctcagatacttccagggtgtgatcagggctgactaccattggtttggggatcctcattttgaatccttctggagaagggaaggggaagaacttgctcacagccagagatcctaattcccagtataaagttaaccagtgcattgtggttaaccagtggcctcctaacctgctgagccttgatggtccaggcctgagttctgaacctcatgcttcagtcctcactgcaatttgccttagaacacatgcctgagagtttatggtttacacattgatcagtgttcacctgtgtagggaaagactatgagaatgtccgcagtggaaatctaggagtggtctggttatcgaattctctgggtctctgtgcctttccttgtctttgagctatgttgcactctgtaagttgtagaatattgatggtacaacacattcttgtctatagcaatgcagactgtctggtgaggtgcagttgatgattgttaccctgtggagattgaccagttttgcaatctatttagcaaattgatttcaacattcctgatggcctatggttctttgaattctccccattaaacccattaattggttcctttattaattgatgagttaaataaagtctttggcacatgtttgtgttttatccatatgggagttgtgtttaggcccccctttatttatttatttagttagttaaattttaattttagttttagattcaagacgtgcaggtttgttacaaaggtatattgtgtgaatctgaagtttgagcttctattggtcctgtcacccacacagtgaacatagtacccagtagaaagtttttcagctatttggttttctgtttcttgtgtttctatgttgctgcaaaggacatgatgtcacttttttatggctgtgtagtattccatggtgtatatgtaccacattttctttattcagttactgctgatgggcacctaggttgattccatgtctttgctattgtgaatagtgtggtgataaacatacgagtgcaggtatctttggtagaagatgtacttttctttgcatatatatccagtaatgggattactgggtcaaatggtagctctatttttagttctttgagaaatctcctaactgttttccacagtggctgaactaatttacactcccaccaactgtgtataagcattgccttttctctatagccttgccaacatctactttttgactttttaataatggccattttgtggttttgatttgcatttctttgatgataatgatgtggaggtttgttttgttttgagatggggtctcactgtgtcatccaggctggagtgccatgatgtaattgtagctcactgcagccttgaactcaagcaacccttctgccttagcttctgagtagctgggactgcgggcatgtgccaccatgcccagctaatggtttaaaatttttgtagagacagaggtctcgctgtgttgcctaggctggtcttgagctcctgacttctggtgaccctcccacctcagcctcccacagggctgggattactggcataagccaccacacctgacccttgagcatttttttcatgtttgttggctgcttgtatcagatctttgtttacaatttatctttgacctttgactcctacaacagtttctcaatacttgctctatttttcaggaaaaagaaaataaatattaaggagaggctgttttccacctcaagcagttaccatttgaattagggaagctgttggtgagggaaaaccaattgatgagcgtcttagtctgtttggactgttataacaaagtaccatacactggttggcttataaacaatagaaatgtatttctcacagttctagatgctggaaagtccaagatcaaggtgctggcagatgaggtgtctgttgagggcccacttcccgggcactcatatggtagaaggggagctctctgggatctcctttataagggcactaatcccattcctgagcgttccacctcatgagaatcacctcccaaaggccctaccccctaatcccgtcaccttggaggttaggattttttttctttttttgagatggagttttgctcttattgcccaggctggagtgcagtggcgcagtctcggcttaccgcaacctccgcctcctgggttcaagcgattctcctgcctcagcctcccaagtagctgggattacagccatgcgccaccaaacctggctaatttttgtatttttagtagagacagggtttcttcatgttggtcaggctggtctcgaagtcctgacctcaggtgatctacccgcctcagcttcccaaaatgctgggattacaggcgtgagccaccatgcccggccagaggttaggattttaacataggaattttagggggacatagacattcagcccattgcagatgagtctgtgggttccacccaaggctgctagagtggctgtctatttcttaatggattgagtttctctttcttcaaattgtgacaagcacagacacttaaggaagacagacctggtttgggtttttgattggtctagcattgaaggcctttgtggtcttgtccctgtcttatcacttcctgtttcctattccagtcaaactgaatttctctttttcacttccatgcctctgatcacattgttatctagaatagcctctccccattcacttaatacatttctctgtccagtcttatgactcagctcaaatgcctcctcttccaggaagccttccctgtttccttagcaggaagagacttctcctgaatttggtgcactctgctttcttgttgttttttgttgttgttgttgttttgttttgtttttaagacggatctcactctgttgcccaggctggagtgcagtggcatgatctcagcccactgcaacctctgcctcccgggttcaagcgattctcctgcctctcagcctcctaagtagctggaactacaggcatgtaccaccaggcccggctaatttttgtatttttcgtagagacagggtttcaccatgttggccaggctggtcttgaactcctgacctcaggtgatctgcctgccttggccttccaaagtgctgaaattacaagcgtgagccaccactcccaacccttgttggtgttattacatagatggtgaacctcattctctgtggatctattgccagcaaaccaggccctagaacagagttgctgaaggaatgaggattcggattttgtcaaaaagtgagtgcaggggcattgctgtttgccctggggctgcacaccctcctgctctgtgaatgtcccacttcctgtccagttccaaagagcagttggaatgttggagactgggcttgtgtctcagcggcttctcttagacactggaggtgacttgtcttttttcagttaccagattgctgccctttacctcagttttcagcagaaggaggcacccgggagctctgtgtctcagctctgcaggtcctgagtgtgtctctgtgagcctcaacaccatggagacggcacagctgggggtctgggtgcatctagggcatcccctccttcttagaagagaaaatgggggcagacaggggaagaatttctcaaggtcaaaaacctggctatggagctggcatggaatccagacctcttgaatctatgctcacctgtacttccttgtttttctggttctccctcctctgatttatttccacctagtcaagcaaaaataagtgtgttttctctgttctttatcttatcttggttattgatagagtctggtgagtgtgtgtatttctgaacatacttgtatatgtatcttttctattttcccatttcaattatgaaaatctagtttaaaacactatatatagtatgtaaagccagattttatatataattatatatattttattttatttatattttttatatatatatagcatatggcatatggaggtatctgttggtatatacacatacttcctgaggtccattgatactgcattaaaccatggtatttggatactgttaagctcacacacatttacagggcaagtccagggcctgactagtttggtaaagatacaacaagccactgttactttaggcagtttattacttacataggcaggcaacacaaagaatgtgtcaaaggtaccatcttcctgggtccttgtcccatacactgaagaggatgacactgaagcaaaaggggctgatgactgccacataagtgggattttgagaagcaattttagactgcagctaagtggtctcagagcccacagctctgttctgagaggcaggcagaaattcccatacctcattagagatgagacactgtctggtgacaggctcctgggggaatagggaggtgaatgagagacagccgtgcatctttttatgttctggaagcctacaaggtgttccaccaagattcaggcaaacctttgcatacatggctatgtgcagttctcccaggcaccatggcaggttcccttacacggatatgaacatttccccatctgctgatgagaagcagcaatggggaaagctgtgagaaaattgtatcttttttttttttttctttttgagactgggtcttgctctgtcgtacaagctggagtgcaatggtgggatcacagctcactgcagccttgaactcctgggctcaggcgatcctcctgcctcagcctcctgagtagctgggattacagacatgcaccaccatgttcagctattttttattattttttgtagagacagggtcttgctatgttgcccaggctggtctcaaactcctgggctcaagcagtctgtctgccttggcgtcccaaagtgctaggattataggcatgagccaccacatctggctgctgcaaagacaattttaaagacagaaacctgttatgttagcattgtagctcagctactgtcacttttatgttttccctgccaggttttccccaagtttatacacattttttagagttgcgatcatagtatataaacaatgttgtatccttttcaatttaacatcatgtcatagttcataataataattttaagttacatggtgatggatgagttgtgccacagttaatggctggtttgcaggttgttacacacagccccagccagcatcttcgtgcagcatctttctttccttctgtgggattgtttccttggtgctcgttccagcagtaagcatcaggttgtggtgtgggcgtttgtgtggtttgttcaagttcccttcttctttgctgtgctccttgggctgggaatgtttggttgccgtggagatgagtgctgtgggtctccctcctctcccctcaggctctgcccaccccaggcggccatgcccccccactggcactggacactctcaggaagctgttggcacaccctggagtgggagggaggtctgtggagaggacaggagtggcctttgttgacagctgtgtctacttacatgtcaagtggcctgtctgagggaggctggctcccacctgtgcctcagaagcagcagcatgagaggaggaaaaacacgctgacttgtggggttgagtgaacttctcggcaccttcaagaatagtctgggaggccaggcgtggtggctcaatctgtaatcccagcactttgggaggttgaggcgggtagatcacttgaggtcacgagtttgagaccagcctgggcaatgtggcaaaaccccatctctactaaaaatacaaaaattaaccgcatgtggtggcacatgcctataatactagctatttggggggctgaggcaggagaatcacttgaacccaggaggcggagttttcagtgagccaagattgcgccactgtactccatcctgggcgacagggtgagactctgtctcaaaaaaaaaaaaaagaatggtctgtgagggagaagtaggcaaggtcctgtgtgctcactccaggcagattgaggtttaaaaactaagacgttcatttcacagactaaacaaattccatcctacttgccatgttagtgtcatgattcctattagtttttcggtgatatgagacggaaaatgatggactaggtaaatatactctccccgccagaagcccatggagcaggggggtgcccaccttggggatggaagctgggaagcagccagtcccacagttgacagaaattacgcctagtgcaggtccgagctcagtggaaggctgcagagggccagacggggtccacttgggatggtgctggaatgtgtaagtcaaggccagaatgaattgcagtggtgtaacctactgtttgtattgctcggtgtaagatgcactgtgacctgccagccatgccttagtggggagaaaaaagcaaaactaagattatataccattgctcatttcaccttccaaaaaccgaatgtccatggctgttgaagactgcgaatgggatttatagtaaaatctcacttgttgagacccagttggaagaaagcctttcttagtaataaaaagcctgcatctagaacactcacaaaatgccattttgttacttgagataaataaaacaattaggaccaagcctagtgttgtggaacagaggttcttagcgaatgaataagtccttggtgattgactcaccagttagttcgcctctgaaggactggagggttcttgccagctattttgtttttcttacaaagtctaaatactgcatctgaaatcctttcccttttttgttgactttgtaaatgacctcgtcaacccagcccctgaaaatgcttacacattttgaatgagttaagcctgaactagggaggtcttcctttaattcatgcaggtctgcttctgtaaaacagtcactgcgatatttatagataattttgggtaagctttctagcttaccgtgggcctgacaccgcataaccctcctccacccatggcggcgcactaaatcctgtaacaattcagggagttcaacgttcattattattattactctcaacttaagatgtacagattgaggcttggagagtttagtttgtggttggtttcgtcactgttaagtggtgtggtcagcacttgaacccaagacctgtggatccacagctcttgctgttagccactgtattaaattacctttgcttagagagagtatttgccaaagacaggagccgggctgtagccatggggccttgccttgacttttcaggttcagccgctgccttggggttgtgtgacaacagagactggatttttggccaccctcgagttgtgagtgcaggagagtggcctggggctgggaataggggaggtagaattcaatcatgggatgcacccatagtagagaaatggactaagggctttaatccctgagtttctgagctgtcgaattgtccgaatatttctcatcatattcagcagttctgtatgagctgaatgagtcagcaggacctaaggaaaaagctgaagatcaagaatgtgagaaaggaagagtgggcagatgctaaaggaaatcagtgggcacaggaaagatcaggaagcaaccaaaataggctggagctggccagagggctgcagggatcggaagagagtggaggggccacttactttggttatcaaagggtctcttgtgtccgtctcctgcaagcctagttctgctagtgcactggagttggggccaaacctggtttcccaggtcagactctgctggttcagtcagaggccaggaagtccctgacagggaagaccatcagattcctttgttcctatcgtctgaacacagtctgagaggtttcgcagtatattgtagaggctaactttggtgtaacctataccttatgtggccatgtctgcatcctaagctcctgatattgcacatgtctggtttttgttggaagtctgtacctttcctccgtggtagtcccagaccaagggtgatacttggcggtgcccagggtgtcacctgtcttctcaagtggaagaggagaatgaagagcactccagtacgccaggagcatcacaccgtaattagcaggaagatgttgcaccgcagtgcctcatctcagagccagagtcctgggttagggagtaaactcttttacctaggcctgactgtattctggcattgtaggcactcctcaggtttctgtggccctctcatctcactgagggtatcccttcttcatgtgtctctcagctcttctcttagatttctgcccctggctctggccccttcagattccttctccttctctttcccttccctcctctctcctcctttcaccaacagttttgtttgcacccatagttgcccatcagtggatccatgcctgtaagccagtgtaatacaagctgctgtctgtggagcatttattgcatttattgcagtgagccgtgatcgtgccactgcactccagcctgagtgacagagcgagactctgtctcaaaaaaaaaaaaaaaaaagatttaggaaccagaggctttatatgcagtccagtacagtagccacaagctgcacgtggctgtcttcttatgtcccttgcttgccttccagccacactcatcttacacaagaggtcatggggtctcagagcggttgcccagctggtgagtgggcaagtgtgttcgtgcccaggggcaggtggccactgtgtatacacttgccaccatatccatggccttcacccctcactgtgcgtcagtcgccatcacaaggggcctgttgcagtgccgacctctgcctctgcctgcagagatcctgatttctgagatctgtgtgtgcagggggagcatcctgggggattgtgatgaagttagctgggaacttggctgtggccctgcagtgggcctcaccaccagcccacttgaccttcatgtggacttcagtcctctggcctctctctgacctgtagacctgcaccatctaacacagcagctactggccacctggggctcttgagcacttgaaatgtggctagtgtgactatggaactgcattttccattttatttcattttaattaattaaagtttaaatttattttagtagccatgtacagcttgtggctactgtattggactgcatgtaaagcctcttgttcctaaatcttttttttttttttttgagacagtctcactctgccattcaggctggagtgcagtgctgcattatggctcactgcaacctctgcctcatgggctaaagtgatcctcccacctcagtccctttagtcccctggctaatttttttgaaattaatttttgtagagttggagtcccactatgttgcccagattggtctcaaactcctgggttcaagtgatcctcccgccttggcctcccaaagtgctggaattacaagtgcaagccacaatgcccggcctctaaatcttagccagagttcacttattagtaggaaattattcatgaagtttcttgtttttgatattttatacatcaccaagtcaatgtagtcacattgtcaaaaaatgtatatgggagaagaaaatcacctataattcaataccaaaaagaacccccaaaaatgtatgctgtgcctacatagacgtttttgcctggttgtcatcacagtgtatgtttgcttttatgccctgctttttccacttagaaatatatcatatgccttttccctcattgcttcatagtcttcataaccatctgctgcgtaagatcctgttgatttgatgactcaaagccaacataaccttcttgccagttaaagtttaaaggggaagtgaactcttaccatgggagctcccagactcttcccaggagtactgaggctggctgagtgtggatcctgtggccaggttttcaaggaccagatgcatagcagggcacgggtcagcctgggggtccggcaaatccaatgcctggccagaggatgcaggcccttccctgtgttcaggggcagggtgacagctgcctctccacatccgcagcagccctgcaatggtcaccattggtggcatttggatgccagcagggtcccatatgccctgttttgggcagagcgtctctgtctcttgcatggatcactgctgtcacctccagtctggtctctgggcacagcagcgaggaggccactccacagctcagagaccttcagctactttttgccttaacattgtagtccagttcttttgcctggtgtttaagacatttccttaaattagttctaacttccttcctgtcttctttctttctaactatccccctcctccgctgccccacagcctcccgaagtgctgaagtccctggccacactgcacatcacctgtccttttctacccctgtaccttgtcacccttagcctccatcaccacccaggtgaatatcactctcccttcagtgtcttccattgccatctccattgctactctcctgatcttgggtcccatgtgcacccttcatttgcctgtcctatggtgttttcaattatgattagattgaaactgtttgcaggaatctctatctccccctaggtgatcagttttgggaaaaatagggacagggtttaactgatcatgattttactccttataacccttcagcacctttagtataattctgaacacagaataaatgttggaataaataaaggtgacacttccccattacctggtactcatcacttcacctccttactcaccttccctcatccctaagcaaccactgatcttcctatccctatagatttgcctattctggatatttcatatgaatgaaatcatacaatatatgatcttctgtgtctggcttttttcacttagcgtgcattccaggttcatccacgttgtagtatgaatcagtatctcatttctttttatggctgaatagtattcccttgtatagatgtaccatattttgtttatccattcagcagttgatagacacttgtttttatttttggctattataaataatgttgctatgaacattcctaggcaggtgtttatgtgaatgtatcatttctgttctcttgggtaaatattaggagtgaaattgctgggtcatatggtaactgtgtttaaccttttgaggacctgttttttaaagaagctctaccatgttacattcccaccagccatgtatgagagttccagtatttccacatccttgccaacgcttaggcttatctagtttttttattctaactatcctatttggtgtgaagttggatctcattgtgggttttgatttgcattttcctgatgattaatgatgttgagcatcttttcatacatttattggccattggtatgtcttatttggaaaaatgtcttctcaattccctgctcatttttacttggattgtctttttattattgagtcttaatcgttctttgtataggatttgggaatattttctttcattctgtggactgtcatttcatttcttgatggtattgtttacagcacaaaggctttaaattttgatgcagtagaatttatctactttttttctttttttgccagtgttttggtgctttttgtaggaaaacattggctgacccaaggtcacaaagattcatgtccatgttttcttctaaatgttttaaagagatttaactaataagaaaaaagtctcacttgtcctcgcatttgccatttctgctccttctcatccctttgtttagattcaggttttcatctggtaccatttttccttctgcttgaaggacttctcttaacattttttctttttcgtatgctgatttggtgatgaattctttaaacttttgtattctgaatttatctttctttcatttttttattttaaaatatatttttttggctgggcgcggtggctcacgcctgtaatcccagcactttgggaggccgaggcgggccaatcatgaggtcagaagatcgagaccatcctgactaacatggtgaaaccccgtctctactaaaaatacaaaaaattagccgggcatggtggcgggtgcctgtagtcccagctactggcgaggctgaggcagcagaatggcgtgaacgcaggaggcagagcttgcagtgagccgagattgcaccactgcactccagcctgggcaacagagtgagactctgtctcaaaaaaaaaaaaattatatatatgtatacatatatatatataaaattatatagatatatttatatataattatatattttatatatataattatatatataaaatatatatattgctggatatagaattctagcttgatacttttttgagttccttgaagtttttttgttttttttttttttactattttctccctttttttttttaatgagaaatctgatatctctattctctgtatgtgacatgtttttcccccattctggctgcttttaagatttcatcattgattttgagaaatttgattatgatatccttggtgtgcttttcatgtttcttgtgcttaggggtttgttgagcttcttggatctgtgtgtttgtagtcagtcttcatcaaatctatttcttcacattcctccccatccactagggactccaattactccaatcttaggcatcttgaagttgtcccagagctcacttatgcccatttcgttatttaaaaagttcttttcctctcatttcattttggacattttctattgctgtacctttaaattcactaatgttttctcttgcatggtgtaatctgctattaatcccatccagtgtattctcttttctaaaatttttaaaaagctttttgttatttatttatgtatctttttttaaattatactttaagttctggggtacatgtgcacaatgtgcagttttgttacataggtatacatgtgccatgttggcttactgtacccataaactcatcatttacattaggtatttctcctaatgctatccctcccccagccccccaccccccccaacaggccccagtgtgtgatgtcccctccctgtgtccacgtgttctgattgttcaactcccacttatgagtgagaacatgcggtatttggttttctgtccttgtgatagtttgctgagaatgatggtttccagcttcatccatgtccccaaaaaggacatgaactcatcctttttatggctgcatagtattccgtggtgtatatgttccacattttctttatccagcctattattgatggatatttgggttggttccaagtctttgctattttgaatagtgccgcaataaacataacgtgtgcgtgtgtctttatagcagcatgatttataatcctttgggtatatgcccagtaatgggatggctgggtcaaatggtatttctagttgtacatccttgaggaattgccacgctgtcttccacaatggttgaactaatttacactcccaccaacagtgtaaaagcgttcctgtttcccacatcctctccagcgtctgttgtttcctgactttttaataatcgccattctaactgacatgagatggtatctcattgtggttttgatttgcatttctctgatgaccagtgatgatgagcattttttcatatgtctgttggctgcataaatgtcttcttttgagaagtgtctgttcatatcctttgcacactttttgatggggttgttgttttcttgtaaatttgtttaagtcctttgtagattctggatattagccctttatcagatgggtagattgtagaaattttctcccattctgtaggttgcctgttcactctgatggtagtttcttttgctgtgcagaagctctttagtttaattagatcccatttgtctattttggcttttgttgccattgcttttggtgttttagttatgaagtccttgcctgtgcgtgtgtcctgaatggtactgcctagattttattctagggtttttatggtttttggtcttacatttaagtccttaatccatcttgagttaatttttgtgtaaggtggaaggaagggatccagtttcagctttctacatatggctagccagttttcccagcaccattaagtagggaatcctttctccattgcttgtttttgtcaagtttgtcaaagatcagatggttatttttttttttaagatggagtcttgcccccattgtgcaggctggagtgtagtggcatgatctcagctcagtgcaacctccacctcccgggttcaagcgattctccttcctcagccttccaagtagctgggattacaggcatgcaccacatgcctggctaatttttgtatttttagtagagacagggttttgccacgttggccaggctggtctcaaactcctgacctcaggtgatccacctgcctcggcctcccaaagtgctaggattataggcgtgagccaccgcacccggcctgttatttattttgagacagagtcttgctctgctgcccaggctggagtgcaatggtgtgatctcggctcactgcaacctccgcctcccaggttccagcgattctcacgggtcagcctcctaagtagctgggattacaggcatgagccaccatgcctggctaatttttgtatttttagtagaggtggagttttactatgttggccaggctgatctcaaactcctgtcctcaagtgatacgccttccttggcctccctaagtgctggcattacaggtgagagccaccatgcccggccagccaatgtattgtttatctcagacattttggttttcatctctagcagctcagtttgagccttttaaatattttccatgttgctacttaacatttccaacatattgaatatagaaacaatagcttttaatgtccttctctgctaattctaatatctgtgtctgatcggggttgatttccatagattgattattctcttccctgtgggttgtgctttcctgcctctttgcatgcctgggaatatttgattggctgccagacattgtaaactttacctttttgagtcttggatattttgtattctttcaatcttctgagcattgttctgggatgctgttaaattatttaggaacagtgattctttctagtcttgcttttatgatttattagatgaattcaaagcagagctcagtctagggctctattattcctcattctcagggctggtgggaataggcactgtttccagcttttgtgggtgccaggcactgttcttgcgaatcctgcagatgtttgtcctctgactttggttagtttcctcacaggcaagagctgatccatgctctgctgaacacttaacggagaccctctgcacatctctgggttgtctctgtgtgcagtattctcatctctgatccagacgataatagcctggaataggggaaatggaaaactaactataagacaaagactttggagtggcacgtgagaagagaattggagcgtgaggcagcagtgctcagaacatggtccttggccagcaccagcaaaggccgagaaagagatgagaacgtttagagaccttcctaagagtttgacagagtggctttgtgtcagttgaattggataataactacagttggggcttggattttatgtttcatttttctatattattgtattttacaagataataagtctgacagatggaaattaaaaacaaaagcctcccatacctagccctttgccacagataaactgagaaggaaggagtgatgtaggggatttggatgaggagggagagagggtggtggttatgattcttagctctggtgggtgtcatttgaggaaacggaaggtcaggtagggatgctggcaacagtcacaccagatgcctggtatgaggtgcactgggctgcgttccctactgtgatcccacttttatccttaccagggaacctgaagggtttgggtgacagccagggtctcatttcagggaaggggcaaaggcaaggttggaccccaagcctgagtgcttttccactttgcccctttctgctgtgctccttggcttactgaggcttggcaagcctgcaaaatcgaggctggatctctccttcacttgagccaaaccaaattgatttgtttttagcaatatcttttaagagttaacctattctggggctgggtgttgtggcctatgcctctaatcctagcactttgggaggctgaggtagccagatcacctgaggtcaggaattcaagaccaacctggccaacatggtgaaaccccatctctactaaaaatacaaaaattacctgggagtgatggtgcatgcctgtagtcccagctactcaggaggctgagccaggaggatggcttgaatccagaaggcggaggttgctgtgagccaagattgcaccactgcactccagcctgagtgacggagcaagactgtctcaaaaaaaaaaaaaaaaaaagaaaaagaaaaaaaaaaaagaacctattctagaaaagctatttgaagaagtagattggttagaattttgtgcgatgatgcagatattctaaagcttccctagtcacaagtggccatcaagtactcaagatatacttgttcaagccctggcgctaaatttttgatgttatcttaattgatttaaacttacataaataaccacatgtggctagtagccaccatggacagtacaggtagaagtcactaactgggacagtacaatcaaaacaatccaagtgactactgatttttactttcttttctcggaaactcttctcattgttgggaaacccttgcatttttacttctcagggagatattttggaactgaaatttgtggtggagtcttaccgccaaggaccagttatgtttccagaataggttatagcttatttctattttatagggaaggaagagtggtgagtattattgcacgttttagttttgtcagattaaatggctgacctctctttgtgatgtccttaactcttgtttcctttgttaaactacaccggctttatcagatgcatttttctcttttaaactgaggatggcttgaaggcaaatataaaatactcattcacggcctgcaggtggctcacacctgtaatcccagcactgtgggaggctgaggcaggtgaatagcttgaaccccggagtttgagaccagcctgggcaacatggtgaaaccccgtctctactaaaaatacacacaaaaaattagccagtcatggtggcatccacgtgtgttcccagctactcaaggctgaggtgggaggattgctctagcccaggaggagattgcaccactgcactccagcctgggtgacagagtaagaccctgtctcaaaaaaaaaaaaaaaaaaaaaagaaaaaagaaaaaattcattcactacatctacaggaagtgtctttttggagtggattctctgtgagtctgcacatttatcagtcaatttttttttttttttttaagacatagtctcactctgtcacccaggctggagtacaatggtgcaatctcagctcactgcaacctctgccacccgggttcaagtgattctcctgcctcagcctcctgagtagctgggattacaggctcacgccaccaggcctggctaatttttgtatttttagtagagatggggtttcaccctgttggccaagctggtgtcgaactcctgacctcaagtgatctgcctacctcagcctcccaaagtgctgggattataggcatgagacaccacactcggcctatcagtcaatattttataaacggctgatgtaaataaagaaaataaagaggattttgactactgtcttctaaactgtaaaaatggtctattgagtatatatttagtgtgacgatcatcagctatttcctagtggagggaattcctttactggaagcaggacgattctgaaactagaattataaagatgtaacactgacactcccacccccagtttatgtttgatgctgattattcagggatggtttaggtcttagcatttttgaccaagatgaacagcatcaaatggaagtgccagttcagagacaagcctgaggcatagtctgacttggtggttctcaaagtgtggtccctggactagcaccatcagcatcactagggaacttaactagaaatgcagagtctcgggccccttcccacacttactaagtcagcagtctgtgtttcaacaaactcacctggtggttctgaagcatgctaaggtttgagaaccacctaagtttttggtgtttatccctcggctattccattttgtcctctgtccttattagctctgccaaagccgcagcagctccctagtgttacgtctctacgtatgagccgccataacaagtcagtgaggacagtgaaatttgcctcttcaagggagcagaaggaagtttaattgggaatgccaggaaatccatctacttccctggaaggactgaacgtttataccgccccctcacaaatccttatgttgaatctctaatcccaacatgatggtatttggaggtggagtctttgggaggtgattaagttatgagagtggatacttcctgaatgggattagtgtccttataagaagagctcagagatgtagttagttccctttccaccatgtgagaaaacagcaggaagacagccatctgtaaatcaggaactggatcctcaccaagaacctgaccctactagcaccctgatgttggacttccaacctccagagctgtgagaaataaatgtctattgtttaagctactcactttatggtattttgttctaacagcctaaaatgactaagacattccccttagtctgagagatattccttttggaacagaaaacaagagagacagtatagtgtggtggaaagagtgttgactttgcacaagagagacctgggttcgaatctcaacttttctatttaacttttagctacataggtgaatttaacctctttagcttttgtttctccatcagaaaaaaaaaaaaaagcatcagtaactcaaccgtaatatagtaagtgagtttcctttttctttttctttctttttttttttgagacggagtctcactctgtcgccaggctggagtgcagtggtgcaatctcggctcactgcaacctcggcctcccgggttcaagcgattctcctgcctcagcttcctgagtagctgggattacaggcacgcaccaccacacccagctggtttttgtatttttagtagggacggggtttcaccatgttggccaggatggtcttggtctcctgacctcatgatccgcccaccttggcctcccaaagtgctgagattacaggcgtgagccaccacgcccagccgacaagtgagtttcaactgcccaaacgtcagggcacattattgcaagattaatgaaatgactcaagcaggcctccagggctggctggcttggggtaaattgtgctgcttcaacctgtccttgtcctggctgtggtttggcaccacctagtggcggttgggtgctctagcttaaatgtcaataaggaggattctggatcctgctcttgattggaactttcaggacagtggcagtgattccaggaattttcaggttagttggcgtctgtttcattggccaaatctggggtgattcagcctggagaataccttttctgcctccctgcttctcagcaccaggttgcttgctgtttcctacctggcctcagcctcctctcagcaaccccctttctccaaagatacaaactttagcctgtctccaagtggaaggttacctatcaagttacatctaaatgcctgtcatcacaaggagtttttacggagctgttcatgacacttaagtgagacatgaggcaagtaaaaggcccagtacctagaaagtgtttgaatgaaaattcccttttccggccagatatggtaactcacacctgtaatctcaacgctttgggaggccaaggcgggaggattgctgagaccaggagttcgaggctgcagtgagctatgattgtaccactgcactccagcctgggcaacagagcaagacgctgtctcaaaaaaaaaaaaaaaaaaaaggaaaaagaaagaaaggcctgtcccatttcctggcagaagagagaaactggattctgcatataggtgtgcatccaacaagcattaaatactgctgcatggcctcatggtgcagtggaacaagcacagtcttcacagtcagacaaatctgggttcccatcctgcccacttactacctgggtaagcctcaatttccttacttatgaaatgaaaacgataatgtgtaattcataagtatcatatttttactccagaaagttaggagtaatccttgggtgtgatttcaagtgattcccaaaaataatcaattcctgtatccttgtactgctccatgacattgacatgtgatgtgttttatttctgcccgactctttactgaaccctttctacgctcactgaaacctggagtaggtgatggctttgagtaggaaatgactttgtgagtttcttccgtaaaaggcatgtgacagtacagggtcagaaggtggagtgatgcagtaacctgtgtggcaaagttttcaagcatttaaaaatatatgtgaaagccctaaacatagtacttagaccacagaagacaatcagtagatgttaggcttttctcccactcagaatacaaacaaatatattttgatacactatccagtttctaacctcaggtggtctttcaaaaccgaagtgaaaaatgaagtgtgagttcttcagagcaaactaagccccaccctcttaggtcagtgggggagtctcagttttttaaaatttggaataaaggaaaatcagacgtagtcccccaaccccctgtactggcctcctgtgtccggacatgggaattctcagctgtgggaactggcagcaagaggacttatctagccagctgggcaattttttaaatgatcagagcaatacctgctcattggtaaatctttgggaaagtgtaggaaagtatatagaagcaaccaactaggaaataaaccatcccctccaccatgcagattcttttttttttttttttttttttttttttttttgagactgagttttgctcatgttgctcattgcaggctggagtgcaatggtgtgatctcagctcaccacaatctccactccttgggttcaagtgattctcctgcctcagcctcctgagtagctgggactacaggcatgcaccaccatgcctggctaattttgtatttttagtagagagggggcttttccatgttggtcagactggtcttgaactcccgacttcaggcgatctgcccgccttggcctctcaaagtgctaggattacaggcatgagccaccgtgcctggcctcaccatgcagattctaaatatgtccactcagaggcgttgccactcatgggcagatttcctttccagtctttttttctttgaatttctttatatagttgagatgcacaatttttaaatcttgctttttacttttcacattataacataagggttttcttttaagattaaaagtattttttcatattatacatatttctagaaaaatttaatatagaaatatgtgaagtaaagtgaaatttctctctaataccatctgtcactgtacctaatactagaaagaaaatttaaaatattaaagtatataaagtagaaagtgatgtttcactgttatacttctaccagtgttacccactgtttgtttttttcccttttgcatatcagtggtatctgcaaattactgaaatggaattgtactataaatacacttgtcaagtttgcttttttcacttgttaatatattttcagtctgggtgcagtagttcacacctgtaatcctgagatgggctgatcacttgagcccaggagttgttgactagccttagacaacatggcgaaacactgtctctacaaaaaaatacaaaaattaggcagttgtggtggtgcacacctgtagccctatctactcaggaggccgaggtgggaggattccttgagcctgggaggctgaggctgcagattgcaccactgcactccagcctgggtgacagagtcaggctccatctcaaaaaaaccccaaacatatatatatgctatccccaaacatatatatatgctatatataagcattttccaatatgactaaaacactatttaaatgacattttaaatagctatgtaacatttcatcatttatatgtactctggtttatataaccattcctctaaggctgccagtttggatctaagtaaatatttattcactttttaaaattctttcccaaagctaagtctcagataacctcactgagtcagagataaacattttaaagtttcccttccagggagagtttatcatcttacactctcagcagtagcttatgaaaatatacagtgacaacaatcacaaacacttaaaaaatctttgttgatctcctggatgaaaaagctttcgtttaatttgtttcttaacactagagggttcagtgcttctgcatgttcaatgatcttcctctgtgatttttggaatagaggtgatcttcgccctattacacaaaacgttgatttccagctcagattccttagaacttgctaaccccattcctggaaccaaagtgctgtttgctgtgttctccatacattggatcagaagcctaagctctggaagtcctgcgccgtttcctggtggcctcctagctccctctaggggccccatccgcaactgcagccccaccttctttcctctcttgaggaatgagtttaccctgcgggaattccgagaaggaagaggcgaaagtggggagctccacaagtaaagatttggactttgtgatcagacagtgtgtgaatagttttgcttactggttgagcaagcttctcttaggtgggctgtctttttttttttttttttttttttttcccgagacggagtctctctctgtcataaaggctagagtgcaatggcgcgatcttagcttcctgcagcctccgcctcccaggttcaagcgattctcctaccgcggcctcccaagtagctaggattataggcgcgtgccaccatgccaagctaatttttgtatttttagtggagatgaggtttcgccatgttggccaggctggtctcgaactcgtgatctcaagtggtccaacagcctcagcctcccagagtgctgggatcacaggcgtgagccaccgcgcccggccaggtgggctgtttgtgttcctcgtcaccttgttcctggggagggacagagggcagcagatcagctgtcacccaggtaggtgtccgacgtgggaaaagtatgggaaagatactctagttagttctcattttcttttctaaaacttcgagttctctggagtccctttatagagagaaagtttaagtaactgaaattaatttccatggctgtcaagggggttctgatgatgatccctgagatcacccagctgtaggtagacattcttggtaccttagtttagcagagtcagaaaatactgcgaacgttcaaggatggggaccttctagaagagagggcaacagtaactttgaggggaggacaagagagcagctttggagacctaaagagttgtggccttctatgtaagtcctattatcccttccatgcacccccacccacattcccctactccattaaactttgtttcaggttataaaaataatgcataattattgcaggaaaaaatggtaattgaaaatcacctatttcttacactcaaagataatgacttaaaatttggtgtacatcttatgtgtatgagtgtacacataattttgtcatcatatatgtgagtgtgttcataactgtaacccacatacttatatacttcctttaaaatattttaagtatttttccctgtcaataaatatttttttgaaaacacaatctttttatggctgcataatattccaacatgtatatgggttatcatttaataggaattggacatttgatgctcatttttagcaagctattataaatctgagatgacgatttctggaactaggataaattcctgaaatagaatttttggggagaaaatatctgaactttgtaaattctactgacatttaatacaaatttctctcctaagagcttgttttagcttctgctatcccttgcagagtgtgaacaagtatctgtttgtctgtgtcattactaacactggggttatcattctttttaagctttgctagtctgataggtaaagcatagggttttttgttgttgtttgtttttggagagacagagtctcactctattgcccaggctggcgtgcacagacgtgatctcagctcactgcagtctcaacctctaggcacaagtgatcctcctagctcagcctcctaagtagctgggactacaggcgtgccccactacacctagctaacttttttattatttgtagagatgggatcttgctgtgttgcctaggctggtcttgagctcctgggttcaagtgatcctcccaccttggcctcccaaagtgttggaattacaggtgtgagccactgtgcctggcagcaatattttttaaatcatgaggaaagctaaagattttattttatagttattgatcattcatacttattttgtggtttgtctgcctattctttacccattttttatataggactgttacttgagttattttcatattagagttacatccttttctgtcatacagtatagatgtttgctctagtttgttattgccttttcgtttacggtgtttcacctaagtgtgtgtgtgtgtgtgtgtgtgtgcgcgtgtaaaacctactggaaggtactatgggaaataatccttatttacctgtcacccagaatgcacagacatttttacattatagttttggtttgatattttttataaaggaaattaaatatataaaaattgtgtgtgtattttaaaacctactggaaagtactataggaaataatccttatttacctatcacccagaatgcacagacatttttacattgtagctttgattctgtatttttataaaggaaataaaatattatataaaaattggaatcatcttgattccttttcccatcctctcccttccttccctagggcagctgccattatgaattgaaattttcctactgttaccatatatactattgtcaataaaaaacatacagtactagtttacagtactagtttgtggccgggcatggtggctcacacctgtaatcccagcactttgggaggccgaggtgggtggatcacctgaggtcaggagttcgagaccagcctggccaccatctctactaaaaatacaaaaattagccgggtatggtggtgagtgcctgtaatcccagttgcttgggaggctgaggcaggagaatcacttgaacctgggaggcagaggctgcagtgaaccaagatcgtgccactgcactccagcctgggcgacacagcgagactccgtctcaaaaaaaaaaaacaaaacagtactagtttgtgtatgtgtgtgtgcgcactctcaaacttacacatatacgatcattggtatatcttcaggcattttgccttatttgcactggtgttcagttcaattaataatgatatgcatagatctagccctttcattttgactgctgtctggtattacatccagtaaatacagctccagtttcttcgtctatttatcaattctcatatctagtgaacactgaagacgcttctagtttttccataacaacgttgccgtgaacatccatacatgtctgtcctcatgcatgtttgggtaatcttctcaaggggcaaccttagaagtgtgttgtggattatgtgtattttcagatctattggcccttgacaaattgttcccaagtagtcatcccagttgatgatactcccaccagtgtgaaagggctcctcttgtcccacaccttccaagacatgctattagatttagtaatttttgccaatctatgaaagtgagatagaatctcattgtggttttagtttgcattatcctgattgttgataggatagaacatctttttattatagatattggggttatgattaataatcctggttattcctaaggtataacaggttttctattctatgcactttctcttcctgccctttgctcatttccccattggattatttatctttttcttattaattggtgttctttgtgtcttaggtactaatactattttaatttattttatttatttatttttgagacagagtcttgctctgttgcccagtcttgactcactgcaatctccacctcctgggttcaagtgattcttctgcctcagactcccaagtagtgcgtggcaccatgcctggctaattttttttttttttttttttgagacagagtctccctctgtcacccaggctggagtgcagtggcatgatctcggctcactgcaacctccgcctcctaggtgcaggcgattctcctgcctcagtctcccaagtagctggggttacaggtgcatgccaccatgcccagctcttttttgtatttttagtagagatggggtttcaccatattggccaggctgatctcgaactcctgacctcaggtgatccacctgcctcagcctcccaaagtgctggcactacaggcttgagccactgtgcccggccaatttttgtaccttttgtagagacaaagtttcaccatgttggccaggctggtcccaaactcctgacctcaagtgatcctcccgtgtcagcctcccaaaatgctgggactacagacgtgaacaactgtgcccggccagatactaatagcattttatatgtgctttggccatcttctgatccatggcttactcttccttttttctttaactcaacatgtactgcactctgttagagtattgccaaagcttcccctccaagtatgaagctgacttagctatatcttcaaggaatgtagcatatactcagagtattaaaaagtcctacaggaacctacaggagggctgggggaaacattcagacaacactagatctggtagcaacgaccaccacagcaaagaagatggatttgtagttaaagttacttccttttttatgccttttccgctgcgttgatgctttcagggtcctctctgaggtctgaggaatgttctttgacagtcttgtcgctatctgccttgcgctgctttgcctcctgtgggcgtcaccaggcgagggcagccagtgttcgtctggcgggtttctctgtatctcgggcactgtttgtgacaatgatgattttactttcattttgtgggctggccccaaagggcttggtttaactttttgcagagagttcattcagtttctgaaacccccacattgcctgttgagtatgtgttgagcctagcactggaaatgccctcagatctgtgaatactgccaagtaggggatcccgggacaccctctgctgaccttgagctcacagccccattgtgttttccataagagatgagagggactgataaaggatgtttacctgtgttagccttatggaagcaagagttccatccaaggaatcagggtgctttgaacttttcccactcccgcctactcgttttaggtcaagagaaacaaaaatatccttccaacaatgtgtgttttctacagtttaggtgagaaaaagataggaaaataatagttaaccaatgtataggactctcctgataggcggtcacaatggtcctggagcatatgtccaaggtgactgtcataaatgcctgtgggaaactgcatcttcacaagagactgttgcttggatgcccccttgtgttgcctctgctgtcctgccaccaaatgctttgctggcatctttccaagcagataggaggtgctggaaggtgagcgtaggatgacttccaagtcagcccttgagtctttttgccaaatagcacctgccagggcacccttcctcccggcctcagcctgcctgcctctcgccgagggccacggcatcttttaggaactggaaagtgtcattgacagttggcggtttttacgtgtttatttctgcctaaagattttgcttttcacttttcactttttccactgcatattaaaatttttctttttttaccctgtgtttgtgattttttccttaggccggaagctgagaggaaaagccttttattttgtcaacggcaaagtgttttgtgaagaagacttcctggtgagtgtgtcaccgaagcctccccttgcatgtcctggccagagtcagagggcaggggcctggggggacctgggccagcgtgtagggaagctgcactgctggagagaggggccctgcctttccttctgtagatacttgggggtggccatgttcctgaggccaatggcaaaccacacagctttgtactttgaaggaactgtggggtcacttggctatcctcttgctgctttctgcagttctgcctcttccaccaccctggactcctcctcttagaccactggactgggacctgggctctcttcttctcatcccactctctctggggatctagcttctcccatggactggaagtccatccatgtgccagtggctcccagacctgagctctagccctgccgcacctctgaggccagctgctggcatcccactggcccctgggctgtgtcccaacccctcacgtaccagcccctcaccatatttctgtgaagcagaaaaatcttaccttgccttgggtcctgatctgtgagaattgcctcctaggtttgtcctcaaccccacctccttgaacgcagccaggcgttgaactctgtgctgccatgtcttccacaattctgcctccgttcatacctccggcatggctcagccaggctagcttaacggcctccgcacacccgcatcaagaggccttatagggcataaacctggcctgcttggtcccagcatgtgcagggtacaaagcacactcagaagctctccgaggtctggaatccccagctgcccacacctatgcaacctcatgccttcgtgcctttgcttgggccatttcccctgcttgcaatgtcttgcccctttattttcccagatccccccaacagccttcctgtccctcctgcacccacaatggaggagctcttctgtgctgccaccatgcccagggcctgccctggcagggctgtgggctgttagccctgagcagtatgtctgcttacaagtctctcctccattgactgaaagcttccaggatagaaagaacatgcgtcttcaccttcacacctgcagattctaacaagatgccatgcagactgggtgcttggtagttggtggttgaaatgactctgtcatctcagggatgaggaatgtgagatgcagagatgggctcagggccagcttctccctgccttcccttgagaaaagctctatttggttttcactgaaaagttgattcattatgattcctgttggccagaaacagactagcaaacccaaacgggcttaagtaaaaaggaaattattccagcagtgcctcaggagtcattttctccacagtttttggccgtgtatctcagtgttagcttcagtctcaggtcctatgtgatggccagatgttgggaggaccccagagtttacattctctcagtttcacatccgatgggcaagagtgccagtccctccttcggaatcctccacagacgtctgatggagtctcattggctcttactgggccacatgcccacgcctggaaaaagtaacagtgctggaggaatgcaaggctctgatgggccagatctgtcaatgccctgcctgggccctggcatggagccagcccacatggtgatgggagccacgtggtgtggagctgggggctggatctcaaatgaaaatagagagctattacccccagaatggggcgtaggtgccagacaacagaaacctccaccacatggtgtagagttgcagaaagtttcccttttttgtttttcccagcttcctttcataaggtttcccccagttaagttgtgtttgtaatacccaaacttctagtctagcgtgtagcatctagtatgttttttgaagagagcacctcatgtctttcaagactgtgtgtgtgtatgtgtttaggtaagataaggtaaggtaaagtagatatttattaagtttctttgaagctaactataaaaggcattagctttttaaccagaaccggagttgaatttgatttctgtccttaccctttgttggctgtgtgaccttgaaaagttcacttaacctctctgagctgccctctgcttctatttgaggattctgggtaataatgtagaccttgcagaattgttgtaagcattagagtgatggtttcagaatcccctgaaaggcttgtgaaaacacagattgccagaacccaccccctgagtttccaaatcagtaggtctggagtggagcccaaggatttgcattttttacaagctttcaagtgatgccagggaactgctctttgagaaccactgagatgggattaaagcatctctatatacagtcccttacatagagcctggcatgctgtgggtgcccagacacagtcattgttagagtgagtggtactagtatttgtgatggctttcgtggcagagaatattctatgactcagcccacagctgtgttgtacttggggatgacagaattctgcacagagtgacacatctttctgagaaattccttataatcctcttggctgttggggaagtggctgattcatcttaccagtctgggtttaactttcttttctttttcttctgcagtactctggtttccagcagtcggctgacaggtgttttctttgtggacatctgatcatggacatggtgagtaggtcagccaaagaagagaacagcatctcaggtggaggaggaggtgttcagagaaaaaagaaattaataattgaggacagtgtttcttatcttgatttgtggttacagctgggcgcagtggctcatgcctgtaatcccagcactttgggaggccgaggcgggcggatcacgaggtcaggagtttgagaccaaccagcctggccaatatggtgaaaccttgtctctactaaaaatacaaaaattttccgggcgtggtggtgcatgcctgtagtcccagctacttgagaggccaaggcaggagaattgtttgaaccctggaggcggagtttgcagtgagccaagatcacgccactgcactccagcctgggcaacagagtgagactccacctcaaaaaaaaaaaaaaagtccctgtaaagtacagcttgcttgttctaatagaacccacattgttggcttttattggaattaacatctttaaccatctagagcacacgctatcatgtttccgataatgctttctcctcctctgggctgtttgaatcgcactggcctccctctggcttctctgtgatccttgtggcatcccaggtgagatgctaaatacagtctgtttttactgcagaaatctcagctaccttggagtcaaatgcagaaagccagaggagcaaagttgtttttctccctgtgttatgcccagctcacaccattacgaagatgagtttttagggcctgtcatttagttctgagacagcagagcaaggaccaggttttatacattccattctttgctcagtcactggctctctgaggttattttgggcttcaggtcttcagtggggacaatttttccctagagggttaggttatgaggttaatgaatacaacatcaaattgttcaccattggaaaccagcctttaagaagttctttaatatactgatcagaggaaatgattatataacatactttaagttggaaacagttaagtccctctctaagctgactcattaatttcattctagagaagataatttctaattattagtatttttaattttacctttttattgagaaataactcatagagtaaaagatactaatcttaagtgtacatctgaacgagttttcacatgtgcatatacccctgtaaccaccacccagatcaagatatagaacacttcccaaactccagaaagttccttcttgtctattcccactcaagaccccactcccacaaaggcaaccattattccaacttctattgccagaaattcattttgctggttttggaacttcatataaatagaaacatatagtatagactctttcaggtcttattacatatgtttttgagcttcatccatgctgttacctgtattggtagtttattgatttgtattgctaagtggaattccattgtatggatatagcacaatttatttctccatctcatgttgatggggatttggtggtttctagttttttgctatttatgcatgaagctgctgtgaatactcttgaacatgtctttgatggacataaacactcatttctgctggttatatgctaatatttataaaacatcagtgacccacagccctccccattcgtgatgaatatctgctatctcccaggctttgacagacctcagcagaggtcttagccctattagagccatgtcctcattagtagccaagacctccctgggaaacgtggcccttcccccatgctcgcagtgggaggtaggcagaagctacatatgcttacctctccttcccaggtatcttctagactctgtagggctctatttctttagcagaatttgcctttgtttttagtgtccttctgacaaacctacttcatatgaagtcaacatgctctgaatttatgagtatgattataccctattcttagttctagtaatcctaagacttctttggataacctcagggtatgtcatttatctattgctgcatgacaaaccaccctaaaactttgtagtttaaaacaatagtgatttcttatttatcatcatgcttcatgctgtgggtcaggatttaggtcagggtttagcaggccaattcttctgctctgtgtggcattggctggggtctcctacttaactttgttcagctggtagcacagttgaactggaacatccaagatgacctctcaccctccaggcccctctccctgtagcctctaatcattcagtagtctagttcagacttccttacagcaagagataggaagtggaagctaccagtcttcttaagcctttgactcagaaatctcagaacattgtttcttctgctttctgttaattaaagaaagtcacaaagccagttctgattcaaggggagggggaaatagtccccatctcttgatgtgagatctctaccatatgggatagtatgaagttgaagcttcagtctttcaggtcttccctaggacttgaaaacttttagtgaatgtctagacagaaccccagctgtctaactctttgtgtaaattgtctctctatatacccttttgttaatagaggggtacattctgggcttgcaggttagaaccaggcatagtctcacataaaaaaagtattacagctagtcacaatgcagcaaaatggcatctttttctaatcttactttaggcacaatgtggattaaattaatttaaggatctctttctgccaagacagcattcatcttggggaaaatgcattccaaggtccaaattgccaaatgggttttggaagcccagccagttgttcttcctgttttgccttactgcagattgagagggccctcaaaggttagggaaacccaagagggaatgaggaagcttgaaagctgagcattcagaggaaagctggaatagcacaacgccctcctcttgccttcttggctggagcttgtgcagtgtggagttatccgcctgaggcttccaggggaaggagctgtaacacagcatatctttacccctgggtctcacagtgtactgacaaggcttccccaaatccaaaatcccctttcttcagcctgtttgaaggctttctgtgtgggctcccactgctggatgctgatgaccgttctgtacattctttgcagatgcatgttttggtgtgaccttgctcatgttgattctgtagttcagttgtttttgctaagtttcatgatgcaggtaattgcagaaatgaatctcctattaagtcagtgaagatgctttcaactgcaaattatagaaaaaacccagactcagttcgagttaaaccaatgatcctccaactttaatatatatcagaatcaccctattaaaataccaactgctgggccttacccccagagtttctgattcaagaaatctgggatggggtccaagaatgtgcattattaacaagtttgcaggtgatgctaatgctgaaggtctggggccacacacatttcgaggaccactgacttcataggaatgatattttatctcacctaaaaagaggcttggaggtatgtggttccatgatgagttaattcagttacttacggacctcaccaaggatgttctttccatctcttctctttcctgctgtccatgtcttgggtctgtcctggtttcaggttggctctggcagttccaggtatcccatccagatccagattaaatgacactgagaggaagaagtttgtggggctttccctctattgcgtttaaaaacaacaacagagaaactttacttattacacttggatttgaggtcattgggttgagtcagaacttctagattatcatgctccagagtcaaagctgcatagaaggggcatccaagaggcagaagtgaaggggttccttttgagctctgccatttccacatggaatttcttttcatttttccgagtacttgctgcttcccaaatctgggaaggatgtatccttctgtggccctgctttgcatcgtttcccacttcttcgtggtggattttggccctgggattggcccatcccttccttaccatctctttctcttaaagaactatgcaagagtttcctgttctgggtgagggttggaaaggagccctctttccctgccagctcagagaccctgtgagaggctgcaggagaaggattcctgtgtggtctcttctgtgtattcatctaaacagatttgcctttcccaccccatcacctcttgctcttctcctaggtgaaactcgggggtaagtgtactctgtgtgtgactgctcatgtaatccttaggcctgatgtgttcctctccccttccaccatctcatccttccctataatccccactgagtcttggtctctgctccagatcctgcaagccctggggaagtcctaccaccccggctgtttccgctgtgtcatctgtaatgagtgtttggatggggtgcccttcaccgtggactcagagaacaagatctactgtgtccgagattaccacaagtaagaagggatgggagcagacaggacccattcgtgtaggccaagctgatctcagcagagtgagtggtggaaaccgacaaaactgtgtttgccagccgcccttagatcacagtccagcaaaggcttaatggttttgaggggtacagcagggaccttgggaggttggtcgatgccagtgttgacaggaatgggttaaagaatcatgtttagtgaaaaaaaaaaaacaacagagcacagaaaaactaataatcatatttgtagctaggcctcgggaggaatccaccaagccctgtggcttcagcgttacctaacttcacaaggcccctatgcagtgctggttcctaccactcttggtttgcctgggcctgtgctaggcaccatgagaggtgtaaacaaatcagttagtgctgtccccagaagagtgagaggcagccagtgtcctcattgcagctggggagcaaatactaaggcatattccacaaagtgagccaggtaccagtcattctatgagggaggagagcaaggggcaggaggcggcatggaggaaggctccatgtggattccaagtgcaagtctgactctggaatttgctcccagaagcaacatttattgctgctttgtttctccccacagggtgctggcccccaagtgtgcagcctgtgggcttcccatccttccacctgaggtaagatgcccttccagacatgctcccaggggcttctaagacatgaatatctccctgggctcatttacaagatccatgtcctgtccttacagcttttaaggtatccttttaaaaatctcaactctggcctggtgcagtggctcacgcctgtaatcccaccccttttaggaggcccaggcaggaaaattgcttgaggcctggagtttaagaacagcctgggcaacatagcaagacctcatctctacaaaaaattgttaaaaattggccaagtgtggtggcatgtgcctgtagtcctagctgcttgagcccaagagtttgaggctgcagcgagctatgatggtgctactgcattccagcaggtgacagcaagaccttgtctccaaaaaaaaaaaaccaaaaaaaaccccacttcacctttgagataagtcgtgtcttcacccttccttgttgactggcttccccaacccagtacccttcttgtgctgatttgtccccataaccaggtcaaactcccttacttgatactaattcttagattagcagatgaggagaaaggcttgtcttttcttcattttttaaaataagtgtccatgtaggtctttctttcagtgttaactctgacattctagaaggaaggactcctatccctcctacttcccctctcatcagcttaaatgtattcttcttccagtaagtactcctgatttaccttctcctcccaaggccacctacttgttacccccaaaaccctcttccctccccaccccacggtacatcaagcccgacagcccccctaacaggcctctcctatgtgttcttgcttttctctggtcccagggctcagatgagaccatccgtgtcgtgtccatggacagagactaccacgtggagtgttaccactgcgaggtagacccctccccacccagcccccaaagcccattgtagacatccaagagaaaagcatcctgcgttgactggggcaagaggcagtcaacaagattctggcaagggtcagccctctagagcttctgtaggaaatggaatgaaggctggttcttgggggaggtaggagaagatggaaatgctcaaggtataaaggtctttcttctgcatattcagaactatcaagtcctgcaactgttggagctgctctccctgaagctgcagagctaggagggtcgtggagagcatgggtttcaggtcctatctgcgggccacattgtcaggcaggtgtgcgatttggggaagggactccctcccctccagcttgcaggctgttctatctgcctgaagctcctttctcagctgagccctggaaatcatgaagcccctcttggaaacaggcatgtcagctggtggtgtgaaggcgggtggggtccgcctgccccttcctgccctttgtcccaacccaagatgaaggagcactagtacctgatgactgtcaggaaagctagaggttgcccctcaccaacccttgtgaagggtgaccatggaatttcagccacaattaagtgaattcacccatggaaggagattagattcatttggtgaccctgtgggtagagaatgggggtgtccctcatatagacttgtcccactgccaacactgaagaaatgggtgggaatcattgctgctgggaccccaggtgccccaggtcactgcaggagaaaaaggtgaggacatttgctcaacaggcctctccacattttctagaccagtgctatccaaaagaaatataaggggccgggcgcgatagctcacgcctgtaatctcagcactttgggaggccaaggccggcagattacttgaggtcaggagttcgagaccagcctggccaacatggcaaaaacccatctctactaaaaatacaaagattagtgggcgtggtggcacacgcctgtagtcccagctactcgggaagctgagacaggagaattgcttgaacctgggaagtggaggttgcagtgacctgagatcatgctactgcactccagcctgggcaacagagcaagactccgtctcaaaaaaagaaagaactatgagagccacaaattaaagtcatgtatcattttaagttttctggtagtcacaattaaaacgttaaagaattatgagagccacaaattaaagtcatgtatcattttaagttttctggtagtcacaattaaaacgttaaaagaaaccggtgagattaattattttattcggttcaaaatatccagccaggcatgggcccatgcctgtaatcttagcactttggaaggccgaggcagggggatcacatgagcccaggagtttgagaacagcatggacaacacagtgagaccctgtctctactaaaaatacaaaaattagccaggcatgctgtgcctatagtctcagctacttaggaagctaggatcgtgtcactgcactctactctgggtgacacagcaagaccctgtcttaaaaaagtaaaaaatcctgctgggcgtggtggctcatgcctgtaatcccagcactttgggagggcagatcacttgaggtcaggagttcaagaccagcctggccaacatggtgaaaccctgtctctactaaaaatacaaaaattagccagatgtgttggcgcgtgcataatcccagctacttgggaggctgagacaggagaattccttgaacgggggaggtggatgttgcagtgagctgagatcgcaccactgcactccagcctagaaaacagagggagactgtctcaaaaaagaaaaaaaaatccaaatgttatcttttgaacatgtaatcaatataaaaaagttacccatgagattttttttgtaactccacaatttattttatttcttctaaaaaaaaaaaagggatacgtgtgaagatttattacatagatatatgttgtacgtgtgccagggtggtttgctgcacctattgtcccatcctctaagttccctcccctcacccccacctcccaacaggccctggtgtgtgttgttcccctccctgtgtccatgtgttctcattgttcaactcccacttatgagtgagaacatgtggtgtttagttttctgttcctttgttagtttgctgagaatgatggcttccagcttcatccatgtccctgcaaaggacatgatctcattcctttttcccatgagatatttttacatcctctttttgtcctaagtcttcggaatctgcatttacactgacagcacattttaagtggttcacagcaagtgccttgtggcagtgtctcctgtgttggacaggcctccacggggcaggagctgtgtttctgcactggcatttcctgcctatacagaaacacacagcaccctctgctgattttggggactgtggccttcaggtcagtcttgcagtctgttttgttttgcttcccctggacatgtctgcctccccacaggactgtggtctggagctcaatgatgaagatggccaccgctgttatccgctggaggaccacctgttctgtcactcctgccacgtgaagaggctggagaagagaccctcatctacagcccttcaccagcaccacttctagccagagccacttgcagacatcacggcaggggatgaggagccggggttgctgctgctgcttccggtggcccctggggtggaagtggggtaggggaagaggaggggcaggagggagagttcctgtgagcatgtggggggtgcctttcctttaaccagggaggtgaacactacctgcctcctgcgtgtattttccaagtgcttttctctgttgccacattttcctcaggttactcaggaaaatgctccagcatgtgcgagcacatgacctgaggttgcatcatagcaccaaaggaatcctcctgtcccctctgggaacatttcatgcttcagagggagaggtttttattgagcttgtttcacaatatccccttgaagggacagctcagctgccaatacattcaaccctttctcttccttcaggaaaatacctatacccaaatgttccctcccccgacatatatcatggcatgatttaaggcttcttttcacctgagagcttcagttcttctgcagaatggctgcaaatttaattgcattaaggcaagaaggaagctctaatgtgtgctttgtatcctaagataaatttgcttagaaaaccagagtcaagatttgaaataggtgaggcagggtttcctccttagacactgacagcattctctgtaccccttcaaatccttactctcctaaaggcagctgagtccgcgacagaaatttgccctatgtgagtaaaacatactttgggagaagaacttggtgcaggcaccaggatttttttttttgcccacgtgtttgcgctgtttttctctggagttctcaagagttggtgacttggaaggccgcttctgcaaggcaagtctcaggaacccatgcaggtacatcgcttgcacctgtttttagcttatttaatgacgggcttttgggaagagctgcccgcatactgagagacagcttcttataaacaaggagagtttttgtgtgtgcgagatctctaagccagcgtgggagggagcgcctcaggataagttattatattcatttcgttggtttctctcctgcccaattcttggcacaggcattatgtttgaagaaaccaggataaggtacactgcttttgtctgtttaatttttttagttgtttcccttcactttcagtcttccacacacaaaaaatacctcacagagcttcaccaaatcacagattcaggaggaatttggctttcacactggactcagataccttcttcagtgtgttggaaatcactggcttcacacaggcccaactccagctggtcagggcagagtgatcgtaactaaaggtcagtggggaatagatccgattcagtgcttttgccttatgcatttcagcatcctggctccccagggtggcaggagctgagggagggccacacactggcaagatttcaagaccactctctgcactgaagaggtaaaatttgcactgcaagtcacatccctgaggccagaggtcagtaccctttggtatttcgattagaagaagctgcaaaagaaaggcagcccattttaccattgccagccaggccggggacacaggagccggtgtgtgcactctgcctcctcaccttgcacccagagcaagaggactgggtgctgggctgcagaggccggtcagtggagcccctagcacgtgtgaactcaggcttttcattgggcccggctccacttctaggccatgttttgactcatttggtaaccattgcctgtaagcagcacagaattggtgccatggattatcttttccatgttgatggaattcattctgttggaatcctttggccagatgtcacttcagccagggtgtgcatcatcattggttctttttcacaggctgagcctcctgaaaacccatgaacgctggggctggggaagtgaaccctgaggtggggaccctctcttcccatcaaatcatccagctcagtgtggggcgtggcaggggggtaaatgaagccagccaatgtgttaacctgtctctgtcaacctaagaatgttggccttactgacacacctttgctccatgttcaagaccagaagtagctgggatttgtttgcaaattgggtaattagtttaaaaatctgtgattacatttttaaatgaaattttcaaagtggcctagattgaggtgattcagataggtttgcgaatataccattttatattgttgagaaagaacaaaaagggaatttccagatgtcctagaaatcctagcaacagatttctctggttgtcagtttccctggagaaggcgccagataggaatctccaatcagttgtttttctcttcgcttcaggcccttacacaaaagccatgaagagatgttcacctacccggtattttaaatgttctgtaaattattagccaaatagaactgtaatggggttgtatttatgggcgcctagaaagaaaacacaaggacttggtaggccaggaagaaaagattttaaaatttagaatgaatagcccttctgggttttctttttgacaattcttggacttgaggtaaaacaaggaggattgtggccggatttcagatcccaaagccagcctccatcttaggcctttgcctcattgtgccttttaggttttcttacccaccgtctcctgttttgtcttttttttcttttctcctacccctatcttgggacattcagaaactgcctgggtggtttgagaagagacaacccagtttgatctgcaatacaaggatccattcgtaatctctctctcactgatgttattcccccatctgccgtcttggttcatctcaccacagaagggcatttagtcctacccagccatcggctgcgtatgacagcaggatggcacttcccatttctctgtggttagtgctcgagtgaaaacctctttcagctgagtcctctgaggttctgctgttgagtcctgggtggctgatggaatgattgaggaggtctggtcaccctcaagcgccgtcatcgccttgtttccatgggcttctgtcacacaaaatgaagaacagaaatgttaggacttaagagaatgtttggaattcacacctctttgcagtcctttcaaggctgctgctctgtgctgtgtcccatgcatgtgaaagtagagctgtgatggctgctgggacgcttgcaaagatcatgtgtgagaattgagcacaagaccacaaattattactgcttgatgcgcttgttaaaactctatctgccaggaaaccaaattttcttttcttttctttttttttttgagacagggcctcactctgttgcccaggctggagtgcagtggcgcgatctcagctcactgcagcctccacctactgggctcaagtgatcctcccacctcagcctcccgagtagccgggaccacaggcgtgtatgactggctacgcctggctaatttttgtatttttaatagagacgagtttcaccatgttgcccaggatggtctggaactcctgggctcaagtgatctgcccacttccgcctcccaaagtgttgggattatggccattagccactgtacctggcacaatttttttttgtaccctcctttatgccaagaatcagtcctaatttctttactatgtgaagtaacttttaaaggtaatagaaaaggccaggcacagtggctcatgcctgtaatcccaggcgccgtggctcacgcctgtaatcccagcactttgagaggctgaggcgggtggatcacttaaggtcaggagttagagaccagcctgaccaacatggtgaaacactgtctctactaaaaatacaaaattagctgggtttggtggcgcacgcctgtaatcccagctacctgagaggttgaggcaggagaatcgcttgaacctgggaggcagaggttgcagtgagccgagatggtgccattgcactccgacctgggcaacagagcgaaacactgtctcaaaaaaaaaaaaaaaagtaacagaaaaaagagtgaaatatattagctatcttttattctgagccaaaacttgacagatgtgggaaatcttcatatagtgtatgaaaatttcattgtacagggaaattattttcctctgtgtcttttcttttactataaagtgattcagaattttactgttactataaaattatgcaaagtattgtgacaaaactgcatcaatttgttgactattaaagtgctccttgaacattatatttcctgggtcttttctgtgtgtggagtcagcaaactgttttttgctacctggactttgtcttcttttacagctctggattcttaaaagtaccacataggtagcaaacctgtgaagggtatgagattttaccctacttgcaggctaataaagtgagcacaccacatgggttcatggatcctggcagaagttatgagactcataggtcagagacaaaggacagtttattatagcaatagcagtggccagattatcagcatttacactggttccctgagccccaggccccaagaagagggccaggtgagacctgcacacgcagtgggctgcattacaagaggaacccccatgcttaggggaccctggtatttgataatgggcagtaagcctgcctgacttttgctccagagacagacactatctctgtcatccaagactgttcactagataaacatccttgaaaatataagtctggaacctggcaattggtgtctattcttaccagatgtataaaaatgtgagaggccttggagaatcatatcccaagaatcagcagtttcttttactggacctttaagattgagacttgtaaggtcctgatgcagtgacttgtaaggtcactttgtctctcttgtgaatgttactgttttttctcttctgaggttatgaccaaagaatcctcaaggcgagtgatccttcaggtttgagacagccacatgcaggaagacaggacttgtagagtgttggggccaagtgtgtggttagaatccttggggtggggaaagagtttgttctagactccagtgtagtccttgtggctaccaggtctgacgtgccaaggacacgggaaagctgggagtgaggatactcatagtcatagcaccttacaccagaataaaagttttttttttctttttaagtgatgagagaatggctagtctgattttgccaacatgggctgctatttgcttaagaccttgatggtataaggagtgaagatgcaatcagggtaaaaggcggtctggagttgtggtgtgctggcaaaccagccctctggggcaaaaaattaaaaagccttgatatggagtgtttgctgatacctatgatgtaaatattcccgccatggccactttccagctaccagcaaggcatcctggcaccagggattgggaggagatggcatagtcctaagagtcagccttgggcattgggccatgtgggactgggcagtggggtatctggtctggttctaagtgctgtgatgaagcagtagcagctgtaatagctggcatttcccgtgtgctcatcacatagcagatgttattccaaggactgtatgttctttatcatccctcatttgatagacaagacaactgagacacaaaagggtgaaataaacagtaagtactccatcccaggccatctcatccagagggtgctgtcttgaccactctactactctggttgatgggaggcagtaaattgtccatcagtatacttcttcatcaaagctacatagtcaaaaagccacaggaggctgtgaggagaagctcactgctgctctgttgaagtctgtattggtttcctatggccactcttaacaaattaccacaacctcagtggcttaaaacaacacaaatatatcattctgtcatcctggacacgagccaaaggttgtcggcagaagcgaattgcttccagaggtgctatagggtgctgcccattccttgccccttttccgcttctagaggctgcccattttccttggcttgtggctgcatcattctggctgcttctattgtcacacctcctctctgaccctccctgcctccttgtaaggacacttgggattacgcccatccagataatctagaataatctcccattttgtgattcttaataacatctgcaaagcctcttttaccttgcagaataagatattcacaggttctggtgaggaggacagggacatctctgaaggggagggaagcaggagatagggtctggaggcatggaattggcttcctaaggccaattcaggctgacttcctagaactaagtcaaaaggaaaaccccaactttccacgctcaagtaacaaaaggaccagaggctactccctttgcaacctccccacccccagccccttttctgcatggcaggtgaaaaattgaaagtatcgctaattgatcccctcccacaaccaatcagactggtcttaggccaagtcttcatttgcctaggagtataactttgtaacttcagcctctgattgggcgttttacacaaccagtcagatgtttgtatagggtggtgtaactttgtaactttgcttcagcctctgattggtcccctcccacaaccaatcaaactgatcatggacctctgcttcatttacatagggtgtacaccaagtaaccaatgggaaacctctagagggtatttaaatcccagaaaattctgtaaccgggttcttgagctgcttgggctgctcccaccctgtggagcgtactttcgtttttcaataaatctcttttgttgcttcattctttacttgctttgtgcgttttgtccatttctttatcaagacgccaagaacctggacaccctccaccggtaacaggaggagcattagtcagcctaccacagactccaacgaacgttttttgagaggaaatgaaagaatattcctaagttattgggtgccttttcttcaggaatccctgaaagtgggggtttgcaattttccctggattgaaaacagaaatgcttcctacacaaacatgattgagaccttgtactctaggtgtaaaaaaacagagtaggtcatactctgtgggttatggtcagagagatctggttagaagttcccaggtaggcgacagccctagatgtgtgacacttctaggagaatctctggctatgtggatacgtccaggtgtgtaaggcagcctcagggactgccaccacttggtcacatacatgtccctccaactaatcctagctctcaaggacaggtggttctgggccctgtgttgcccatgagacttggtccacggcaagcctgtgacggagtgaaagtgaggggacacccaatttgaaaactcggcaggaagccagactccatgacatacaaatagatcaaagtgaatcggctccgttgtttggggaaatacctgaggtttgttgtttcgtgccaagaagattaacaacacggacacacgtgggtgggttaaggagcagaaagtttaacaggcagaaaaaagagaacagctcccccatgcagagggaggaggactccgaatggatctccccattcctggcgggaagcagactgatatatagaggagggggtttgaagaggtggtatttgatttacatagagcccaagggattggtttgaccaggtgtgccatttacatagccctcgaagaaactggccattccaccttgatcttttattatgcagatagggttttttacttggccagagccttgacacctgcacacatggcaacaaacagaagggaggcgaaatcttccatattggatgcacctgtcttccaggtgcagctgccggcatttatctgtgcaagcttctagcttgcttatttatgcttgcagcttgacttttcaggctgctttctgttggaaaagaaatggttttgggggctgctttttattaaaagaaaagccttaccaaggactcctgtaccctatctgcctaaattttttttaactactatattaaaaggtctgtaagtgggagctggccctaaaagtaggttgtagagattatttggatgtgccaacaagcttcatctgcagcttggactgtctccattggaaggcctctggcagattttgtaaaaagttatataacaattttactataggaaaaacttggctacagatatgaatttatattacccatcattggctggttccttatcctgaacattggtttccttggaatctgattttggcttgtttggcctttaaaaaccccagaagaatggggtttctgccagattattttctggttttcagtctcactgaatgtcacaaaggccttggtttatggttcccaactggtaaagaaacgtcaaactttgcctctcttagttccttctacatgacaatgggtggcagttgctcatatggaagcatttcttttccccctaaagcctatgagacaggctgcaacttaaacccctattttattaaaggagaggaaatgtccaagagcccagagatagtgggtaaaagcatcataaggactagaaatggggtcttcttgttgctaattagtaggggtgaggggtaagtggcagatgtgactgccgtccatgcccagacagggaattgtccttgaacctactcatgcggtgtcttctggggtacagtgagtccacagggcaggacggccttggagtcaagagcccagactcacattctatctcaggcttcataactcaattgctccatgaccttaagccaatttagttccctcatctgtaaaaatggggataacaactgaatttacctcatgggattgtgtaatgcccaaccttgtttttactaaccctgtttttagactctccctcttcctttaatcacctagccttgtttccacctgaattgactctcccttagctaagacagccagacagactccatcttggctctttcactggcaccccttcctcaaggacttaacttgtgcaagctgactcccagcacatccaagaatgcaattaactgataagatactgtggcaagctatatccgcaattcccaggaattcgtctgattgataacgcccaaagccccgggtctatcaccttgtaatagtcttaaagcccctgcacctggaactgtttactttcctgtaaccatttatccttttaactttttgcctactttatttctgtaaaattgttttaactagacccccccctcccctttctaaaccaaagtataaaagaaaatctagccctttcctcagggctgagaaaattttgagtgttagccgtctctcggtcgctggctaataaaggactcttaattcgtcttaaagtgtggcgtttttctaactcgctcaggtacaacaattgttgtaaggaatgattgaattcatccaagtaagggaattagagcagtttctggcatgaagtaattgctcaataaagtgtgtcaggttttaagattaattgatctttacatcatgataaatggcaacaaaataaatgacaaatggattaaagtaaatggtaaaaacaacataagaacaaaacattaaaaaatcatataatagaagaaaccaaatattagtaagtgtgaatatataaagtgaaaattactacaagttcaaatatatatatatatatatatatatatattttttttttttttttttttttgagacagagtttcactgtgtcacccaggctggagtgcagtgacgtgatctcagccaactgcagcctccacctcccaggttcaagcaattctcctgcctcagcctcctgagtggctgggactacaggcacacaccaccatgccttgctaatttttgtatttttaaatagagagagggtttcaccatgttggccaggcgggtctcgaactcctgacctcaagagatccacctgccttggcctcccaaagcactgggattacaggcatgagccaccgtgcccagccgttaaaaaaattttgaaaaggtaaatcataagctggaaaaaagattgcaacgtatttaagagttaatacccttaatatattaaaaaatcaaatttgtaagaaaaaattcaatacatcaagagaaaatatataaagtacatgtaaaaggaagttccatattccaattatgaaaattgcaaatcacggttaaatttataatagccagtgttggttagcatgcacgaaaacagagaaacaggtgctgttgatggaagtgtgttttggtttaattttttggagggcagtcagaaagtaacaaaagtcttaaaaatgtccataaaatggaccttacagatgtccacctggtcgttccacctctagaaatttgtaagacaaataattcggccgggcacagtggctcacatctaaccccagcactttgggaggctgaggtgggcggatcacgagatcagtagatcaagaccatccttgctaacacggtgaaaccccgtctctactaaaaaatacaaaaaattagtcgggcgtggtggcacacacctgtagtcccagttacttgggaggctgaagcaggagaattgcttgaacccgggaggcagagactgcagtaagccgagatcacgccactgcactccagcctgggtgacagagcgagactccgtctcaaaataataataattcaacacagggtctcattctgttgctcaggctggagtgcagtggcatggtaacagctcactgcagcctcaacctcctgggctgaggtgatcctcccacctcagcctcctgagtagctaggactataggtgcacaccaccacacctggctaattaaaatttatttatttatttagtaaatagagatgaggtcttgctatgttgcccaggctggtctcgaactcctaagcagcatcattttttctaggtgttaaactgacaaccacccaaattcccagcataaggattctgcttaaaatatctagctctctgatgaaatatcttcaaagaatatttaatgaccttaaatctcagacaaaaaggtaaggagacaaaatgaggaacccatttccgtacaaccccaatttggaaaaacacatgtgcaagtatgcccatgttaaaaaatatagaagaaaaaaaggctttaaggaaaaaaaaaataatagtaatgatttagggtgggaatcgcgttaatattcccaataattttatatattttaaaaatctataattttatcaggggaaaacgttatgttgcggaaattaattgatcgattgagtgattggttaacggacagtgtccgatgactcatataatcccccggttcgagtccctttaggccgcagacgtttcgcgccttctcgggtgtccaagtcgcgcatccatacaatgaggggtaatatactagattacctgaggtcttcttacggtaaaaacaccggtgtcttaaggtttcccagtggaatttgggggccgggttgacttcggagctggagctcgcaaaggccggggctgctgcagattctgacgctttgtggacccctactaccgagcgcagccgcaccgcaggttttcttcgctgctggttagatccaaagcccatcccatcctagtaaactgggacagcgccgcttctcacatcactatgggggcttctgctccgtggcggggaaaggccagaactgctgccttaaatacgcttttgcatcatccggttgctaacctccggccacagcattccccactccaaaatgccacttttccaggtgtgtttgcctaaatttaccccatttacagacttctcaggtgcatcattgggaacagggcgctttgcagtttgcaaaccacctcagacaactccaggtttaaaggataaaggatgacattgtgagcaaagcggcatcaaaatttcagatatttaactttcacattctaaccatacacctttccaaggtcttgtaatactttcacattgtgaatatacatctttacaagacccagtagtacatgggtcaagtgtggcaaaacagacatcgcgagccagccaggagtcgaacctagaatcttctgatccgtagtcagacgcgttatccattgcgccactggccccgacttgctaaagccttctccgtgatagctgatcacccttatacagtttgaacgggcttccgggtaccaacgatccattttgcccttgcgccgcgctcccgctgctctgcctttccccaaaacgcgccccaccaatccgcagcggcttcgtcacggcgctcttcgtcgcactccaacccgccgcgtcggcggcatctctcgcgtgctcttgcttgcgcactaatttgtcctccaccgcctcccgttcaggccggctctcctgcggggcggggaaaggggtgggaagaggctgggagctgcggccgctgtgccagggtgaccggtagagttgtagccgaggtggcggcgcggggcggggcgggcggagagagaaggaaggaggtggttgtgcaggatggcgacggcggcctacgagcagctgaagctgtgagtcccacgggccagaggcctgaggcgcggcgggcggggcggcaggtgcgggccctggcctcggggagggcttctgagtcccggattgcagatagggtgtgggagctcctcgcatttaccggttttcctcagccggcgcggcctctcctaggcctcgcccgagtagccataggccgggaaccagcggctcgccggcctttctccaccgtgctcggccccagcgcccacggctgaagagagaagctgccgactggcccccaccgagccggggtcggcgttatgatgcggcccttcagggcacgcttgtccccactttctatgcagagctaccgactaaatttatctgtatgacttaacagagaaaaagagttttctcttacttaacggacctacagcagcaatttagagtctacgcacaaatcaacaaatctttgttttgcttacagcctatctgggtaccgaagcctgcctgccccctcttcagtgtgcagaaaaaatttaaagtacagtcagtagtcttaaggtcctgaaggagtttactttggtttaaattttaaacagctccagcctaaa

SEQ ID NO: 519 - DNA, 113918 bp, Homo sapiens
catctgacagcctggagcagcacccacacccccagttgagtatctgacatcctggagctgcacccatacccccaggtgagatctgacagcctggggcagcacccacacccccaggtgagcatctggcaacctggaacagcatctacagccccaggtgaccatctgacagcctgaagcagcacccacacccccaggtgagcatgtgaccacatgcaatgtcatcctcacctccaggtgagcatcggacagcctggaacagaattctcaagccccaggtgaggatctgacaacctggaacagaaccccactcttccaggtgagaatctgacagcataaaacagcaccctgcacccccaggtgagcatctgacagcctgaaacagcaccctccaccttcaggtgagaatatgacagcctgaaacagcaccccgcacccaggcaaaaatctgacagcatggaacaagactactgcccccaggtgagcatttgacagcctgggaaagcaccctctacccacacgtgagcatctgacagcctggaaacccccccactgcttccaggtgaacatctgatagcctggaacagaaccccaggcctcccagtaagcatctgaaagcaaggaacagcactctcacccccaggggagcatctgacaacctagaacagcaccctcaccccgaggtgggcatctggcagcataaaacagcacccctactggcagatgagcatatgacagcctggaacagcacccacacccgctggcgagaatctgacagcctggagcaacacccacacccccaggtgagcatctgacagcctggagcagcgcccacacccccaggtgagcatcttacagcctggagcagcgcccacacccccaggtgagcatctgacagcctggagcagcacccacactcccaggtgagtatctgacagcctggagtagcacccacacccccaggtgagcatctgacagcctggaacagcatccactcccccaggtgagcatctgaccacattgaatggcatcctcacctccaggtgagcatctgacagcctggaaccgcacccacacccccaggcgagcatctgacagcctggagcagcacccacacccccaggtgagcatctgacagcctggagcagcacccacacccccaggggagcatctgaccgcatggaatgtcatcctcacttccaggtgagcatccgacagcctggagcagcacccacacccccaggtgagcatctgaccgcatggaatggcatcctcacctccaggtgagcatccgacagcctggaacataattctccaaccccaggtgaggatctgacaacctggaacagaaccccactcttccaggtgagaatctgacaccataaaacagcactctgcacccccaggtgagcatctgacagcctggaacagcatccacacccccaggtgagcatctgaccgcatggaatggcatcctcacctccaggtgagcatccgacagcctggaacagaattctccaaccacaggtgaggatctgacagcctggaacagaaccccactcttccaggtgagaatctgacgcataaaacagcaccctgcaaccccaggtgagcatctgacagtctggaacagcatccacacccccaggcgagcatctgactgtatggaatgacatcctcacatccaggtgagcatccgacagcctggaacagaattctccagccccaggtgaggatctgactacctggaacagaaccccgctcttccaggtgagaatatgacagaataaagcagcaccctgcacccccagttgagcatctgacagcctggaacagcacccacactcccaggtgagcatctgacagcctggagcagtacccacacccccaggtgtgcatctgacagcctgaaacagcaccctccaccaccagatgagcatctgacaaccagaacctgcaccacacaccccaaggtgggcatccgatggcatgggacagcacccccactcacaggtgatgtgactgcgtggaacagcacatcccctcaggtgagcatctgacaggataaaacagcaccccacaaccccaggtgatcatttgccagccaggaacggcaacccacatccccaggtaagtgtctgacagcctagagcggcacctgcacacttaggtaagaatctgaaagcctggatcaacactcgaatcttcaggtgagcatctgacagcctggagcagcagtgcccacccctgggtgaggatgctcacctgaggttgggagtgccagtccaggctgccagatcctcacctggggatggaaggtgccattgtaggtttttggatgttcgcatgggggtgaagggtggtgttccgggttatcagatgctcacctggggacgcgtggaaaaccatgcccaccacaaggtgagcatatgacagcccggaacaacaccctccacccccaggtgagcatctgacagcctggaacagaaccccacaacttcaaataagaatttgataagtgggaaaaagctccccgccctcaggtgagtgtctgacagcctggaacagcaccccacaactgcaggtgagcatctgatagcctggataggcactccacacagccaggtgagcagctgaaagcctggaatggtaccccacatgcaggtgagcatccgacagcctggaacagcagctcacatccccaggtaagattccaacagcatggaacaagaccactgcccccaggtgagcatctggcagcctggtaaaacaacccccttcaggtgagcatccgacagcctggaacagcagctcacatccccaggtaagattccaacagcatggaacaagaccactgcccccaggtgagcatctggcagcctggaaaaacaacccccttcaggtgagcatctgacagcctggaacagcaccctccaccttcaggtgagaatatgacagcctgaaacagcaccccacaccccaggcaaaaatctgacagcatggaacaagaccactgcccccaggtgagcatttgacagcccgggaaagtaccctccatgcacaggtgagcatctgacagcctggaaacccccccactgcttccaggtgaacatctgatagcctggaacagaaccccagttctccaagtaaggatctgaaagcacggaacagcactctcacccccaggggagcatctgacaacctagaacagcaccctcaccccgaggtgggcatctggcagcataaaacagcacccctactggcagatgagcatatgacagcgtggaacagcacccacgcacccaggtgagcatctgacagcctggaacagcaccccacacccccaggtgagcatctgacagcctggaacagcacccacacccccaggtgagcatctgacagcctggagcagcaccctacacccccaggggagcatctgacagtctggagcagcacccacacccccaggtgagcatctgacatcctggaacagcaccccacgcccccaggtgagcacctgacagcctggaacagcaccccacacccccaggtgagcatctgacagcctggaacagcacccacacccccaggtgagcatctgacagcctggagcagcaccccacacctccaggggagcatctgacatcctggaacagcaccccacacccccagtgagcatctgacaacctggagcagcaccccacacctccaggggagcatctgacatcctggaacagcaccccacacctccagggggagcatctgacagcctggagcaacaccccacacctccaggggagcatctgacagcctggaacagcaccccacacctccaggggagcatctgacagcatggacaagtcctgccccccggttagtgtctgaattcctggaatatgtgctgtccttttccaccaggtgagcatatgaccgcctggaagaagcacccctgcatgttacctgtggtgaaaccaaggctgagagacaggacagggttgttggccaggaggaggggcctgctgctgagccccagcgctgagtcagagctcacagccttgagcctgtgccatgcctcctctcagggtgaagaggcagagggcatggggggggggggcgcagcatcagcccatatcctggatgcacaaattcacaggcatgacggggcgagggcctgctgctcctaccgtcactcccacatgctagccctccaacgtcctggctgactttccctgcctctggtcctgcggccctggacacagcgggaggaggggacaggatcctgtggtaccccttggaggaggttccggcacctgtaggcagtttccaaggatcccttgtggccacatccagctgttaaatgggcgtgtccctggcagccacagatgtctgtccagtgcaggaaagtctgtccagtgcaggaaagggcaggcagagagctggctcccagccccaaatgcatgtctccctccctggggcccaggctggcacagaagtcaggcctgccagtgggaaacttgggggaaacttggtgccctggtccagcagcctgccctgcagcagcaagcatggcctctggaggctgtcgtcctcctggcctccaggattgcttttcctttcttcctagaactccagcccttaagaaaatcagaagccctggcaggcacattgcctctgtgctgtgcttttacccagcgaagcatcagggcagacagccaatttcaacactgctcttggctgggaagtgccctcatctctggcagcccccacagagaaagtgcagggccccggggctgtggctgcctcagggcaggtctcccttgtgacagcctcttgtcatgggcctgggagtggacccctcccatccctgccgtgcatcctgttgagtagacagctcaggctagtacccaagagggtggccagcagatcacaggggatgtcccttttgtcttagctgtttatgggctggaggaaccactgttcagccacatctcctctcctgcccctcctgcattcacccgaggttgatgggagctctgtggggggagacaggcaggggaggggccaggcaacacctgggcatatccccagggtgcctcctctgatccccaggaggggcagcacccaccctcttctttttccaatttgtttttattgtggttaaatatacataacgtaaaatttaccatcttaattatctttatgtgtacggtgtggtggcattaaatacattcatcatgttgtgtggccgtcaccaccatccctttccagaactagctcatcttcccaaactgaaactctgtccccgttaaatactaactctccgttccccaggcactctctgcccccaaccccaggcacccaccattctgctttctgtctctgtgattcgatgactctagggacttcatataagggaaatcacacagtgtttgtccttttgtggtggctgcttattttgctgagcacaatgtccttgaggttcatccatgttgtagtgtgtaccaggaatcccttcctttttaatgttgaataattccccattgtatggatggatcatgtttggcttatccacccatccatcggtggacacctgggtgccttccacctccaagctcttgtgaacaatgatgctatctatgaatatggtgtacaaatgtctctaaaagaccctacttccatttattttggatgtagacccagatgtggaattgcttgatcatatggtagttctattttttttttcttttttttggagctggagtctcgctctgtcgcccaggctggagtgcagtggcaggatctcagctcactgcaactcccacctcccgggttcaagcgattctcctgcctcagcctcccgagtagctgggattacaggcgcgtgccaccacgcctggctaactttttgtatttttagtagagaccagatttcaccgtgttagccaggatggtcttgatctcctgacctcgtgatccaccctccttggcctctcaaagtgctgggattacaggcgtgagccaccacacccagctggtagttctatttttagctttttgggaaatggccatcctgttttccttagctgctgcaccattttaccttcccaccaatagtgcagaaggttccagtttcttcacatcctcaccagtgcttgttattttctttttaaaaacttcatagtagccatcctgacaggtgtgaggcatatctcgttgttttgatttgtgcttccctgatgattggtgatgtccagcatcttttcatgtgcttattgtccatttgtatatctttttttgagaaatgtctgtttaagtcctttgctcattttttttgaatgacacagtgaaacctcgtctctataaaaatacaaaaaattagccaggcgtggggtcgcccacctgtaatcccagctactcgggaggctgaggcaggagaatcgcttgaaccccggaagcggaagttgcagtgagctgagatcccgccactgcactccagcctgggtgacagagcgagacttcagctccaaaaattgaattgggtttttggctttgttgttgttgagttttaggacttctctgtgtattctgggtaataattccttatcagatatgtgacttgcaaatattgtggttttcttccatcctgtcagttgcctttttactctattataatagtgtcctttggtgcacaaaaaatttaattttcatgaaatccaactttattttttcttttgctgcctgtgcctttgttgttgtagcccagaagtcattgtcaaatccagtgtcgtgaagcttctcccctgtgcttacttctaagaattttatagttttaggtctttgatccattttgaattaatttttgtatgtagtgttaggaaagagtccaacttcattcttttgcatagttttccctgcaacatttgttgaaaagactgtcccttccccattgaatggtcttggtcaaatcatttgaccatctatgggagggttcatttctggactctctattctgtttcattggtctctgtgtctgtttttgtgccataccacactattttgatcactgtagctttgtagtaagttttgaaatcaggaagtgtgagtcctccagcttgctggttctttttcagggttgttttggctgtttggggtcccctgagattccacaggaatttcagaatttagcttttctacttctgtaaaaaacattattgagattttgacagagattgcattgaatctgtagatcactttgggtaatactgacgtcttaccaacatgaagtcttctaatacatgaacatggaatgtgtttccatttgtttatgtcttatttaatttatttcagcaatgttttatagttttcattgtacaaatctttcacctctttggttaattcctaagtattttattctttttaattctattgtagatggaattacagttgactcttgaacacaggttaaaattatgtgggtccccttatatgtgaatttttttcaataaatacagccagcctttcatattggtgggttccgaatccacagccaaatgcagatcagttcttgggatgtgcaacccgcgtacacagagggccaacttttcatatctaggggttgggggttccacagggctgactgtaggacttcagtatgtggggatttcagtatctgagggttgtcctggaaccaatcccatgtgtataccaaggggtgactgtattttcttaattccctttttagattgttcattattaatgtataaaaatgcaactgatttttgtgttgccttcgtatcctgctactttgctgaattcatttattagttctaacaatttttttttgtgtgtggaatctttagggatttctacatataagatctgtgaacagagataattttacttctttcaaatttggatgcttggtaatttttttcttgcctagttattctggctataacttccagtgcaatgttgagtagaagtgcaaaagcaatcatccttgccttgttcctgatcttagaggaaaaacttttctttttcatcattgagtatgatgtttgctgtgggtttttcatatatggattttatattgaggcagtttccttctattcctagtttgttgagtattcttatcataaaagggtgctgaattttgtcaaatgcttttctgcatcagttgagatgatcattttttccctttcattctgttaatgtggtacatcacataaattgacatttgtatgttgaaccatccttgcattctagcaataaatctcacttggtcacgtgtgtcatcattttaacaaattgctgaatttgttttgttagtattttgttgaggatttttgcctcaatattcatacgggataatggtctgtagttttcttgtagtgtctttggctatggtatcagggtaatgctggcctcatagaatgagtctgaggaagtgttccttcctctttgattttttggaaaagtttgaggattcgtgttagttctttaaatatttggtagaattcaccagtgaagccatcaggtcctggccttttctttgttgggagatttttgattactgactcaatctttttactagttataggtctattcagatcttctatttcttcatgatttagtcttggtaggttttgtgtttctagggatttgtccatttcacctagattaactgatttgttggtttacaattgttcctattactatcttataattatttttatttctgtagaattggtaataacctgattttcatttctgattgtcatgatttgaattttctctttcttagtccacctggcaaaaggtttgtcaaattttgtcttttcaaggacaaacttttgttttcattgattttctctatttcttctctatcctatgttttattgatctctgctgtaatctttttctctctctctctttctttctctttctgttcatgtgttctttttctagtttcttaagttgtaaagttagattgttgatttgagatctttcttgttttttaatggaagcatttacagctatacatttccccctcaggattgctttccctgtgtctcataatttggggtgtgttgttttcattttcacttgtctctaagcattgtctaacttctcgaagtgtgatttcttctgtgatccattggttgtttagctccctcctccttttacagaggaggaaactgaggcctggggaggtgaagtgattcggctgcggttgcttagctggacccaactcttctgggctccagggacagtgctcagggcagcaggcctgggctgagcacacaggtccagtgtgagtccctcagagtcagaccacatagaatgcagtgcagttgcaagcaaggaatgctcataaacaaacagaacagaaaccatcttccagcacacaggcctcccccagctgattgggatctgtcttcttgccattgcccctctcccaacttttattttaaattggagcagttcctgcagaagaaagtcttaaatgcatagataacgaacttaaagagcaggtaaatgaagctcagatcagggtccgggggctgcatccctgcacctgtctgtggcagacatggctggccgaggccagcacttactccctctgtgcatgtcctctaaacccctctcaacaccgggggccaggcagcctcaccaatgcagctgagggaacatctcctggccaacaaccccagagggacccctgcatgcactgagcattatctaagctggggaggacccctagtacctctgaaggctcgcacatctatccacacagactgaggctgggaggatgaaagggcaggactcccagaaactgggtttgtggggacccggctcccatgagccgctgtacaggtggggatgggaacatgggttttgatgggcatctcactgctcaggatggcctacccggctccctctctccttggggtggaggaaggcagctccctgggtcccccacccctgcttgcccaggcccaggtcaggagtggggcggcacctgcagctggtctagggccaggtgcaccaacgcccgtccacacagtgcctgcacgttccccggctcagcccgcagcactgtgttgaagtcgaacatggccgtcttcttctggcccaggaacccatagcagcgggctcgggcaaggagggactcacttgcctggcttcctgcaggaagacggcatggggtcaggatgagcctatgctgggtcccttccccagcatctatcctgcccagcccggggagggcagagggtgcatgagcttcagggcctaccttggggagctcacaggccactgggcaccaagacagacagagacagggtggacttgggggcattggctgcagggcaagaggagctcagccaggactggggacagctggggggctgccgtgaggagggggcactgcagctgcctctgaggccaggcgagggcagggggatcagggtagcactaccatcaagacgcggagaccggtagtggccccgaacggctgagcgcactgatatttactgcatacaagacgaggggggcagggtaaggagggtgaatcttctaagtgattgacaaggtgaagcaagtcacgtgatcaaaggacagtgggcccttccctcttgggcagctgaagcagagatagaaggtggcatacgtcagcgttttcttctatgaacttataagatcaaagcctttaagactttcactattccttctaccgctatctactacaaacttcaaagaggaaccaggagtatgggaggaacatgaaagtggacaaggaacgtgaccattgaagcaccacagggaggggtttagacctctggatgactgtgggcaggcctggatgatatccagccttccataagaagctggtggagcagagtgttccctgactcctccaagtaaaggagactccctttcccggtctgctcagtaatgggtgccttcccagacactggtgttaccacttgaccaaggggccctcaagcagcccttatgcgggtgtgacagagggctcacctcttgccttctattcacttctcacaatgtcccttcagcacctgaccctacacccactggttattactagattatgttagtaatgcaacaaaaagtaatattaaaagctaatgattaataatgattaataattgttcattatctctatatctaatttgtatcatgactattcttattctattttctttattatactgaaacagtttgtgccttcagtctcttgcctcggcacctaggtaatcttttgcccacaaaccctcgccaaagaggctgtcattactgtgccccttctgggtgttgttctgtgacggacatgggacaacatgccaggctgctctgggccactctgggccactctgggccgctctgggctgctctgggccgctctgggccgctctgggccgctctgggctgcatgccttcctgccgacgtgtgcagggcatgctctctgtgccaggtactgtcccaaaatgagccctctgaatccccacttccacccgacatgggcaacgctgccatccccctttgggagaggagggtgaggggtgctcactaagtgcatggccaggttccacgtggcagcctgatctaggtccaggcttgggagaggaggatgaggggtgcttactaagtgcatggccgcgttccacgtggcagcctgatctaggtccaggctctcacactccctgtaccccaggagatccctgcgagtcctgggaaacatcgccttccctccagacacctggccccccaaccccagaaacagcactgactccaggaagcaggcagcacccccgtgctgggtgtcccagggtggggaggccaggcgtgcataggaggagcctgtcactatttctaggaagggctgaggggagcagggacctcgcctccttgtcattagctaggaaaggggcccttctcccctcaggactgggggtgctgggacggcagctcaggcaccaggcagggcacagctcaggtcccagctcaggccccaggtctcagagcctggtctcaggccttggtgcacccaccttgaaggtgaaatgccctcagcgagtggcccttgccctgtccaacccgtgggtgttcctgaggcccctgcacctggggagcatgcgtgtccccaccaaccagcatggcagagactccccatgtcccctgtgcctggcacaagactgggccctgggggcaggtgggcagctcctacctgcggcaaagatggccagagacaggtaggcgatggcctccttggtgtgaaccctgccgtcggccccgcctggccgtgcccgcaggatggccagggccctggcgtggcagtggccttgaagcagctgccggtcctcgtggcagaagacgtccagggtgggctggaggcaggcggtgtcaccagactggaccagcttcttcaccaactgcaagggtgccacagtcactgcccatgcccttgggaccgatgccctggagcccaccctgtactgacgcccctggccatcccccaccccaccctcactgccccagggtccacctggtgccaacgctcccagtcccacccttgctgccccacggctcacccagttccaacgcccctggcaattcctcaccccaccctctctgtgccagggtccgccctgtgccatcaccccgatcctcccctactgcctcgctgcctccaccagcccctggctgtgtgtccatgagcctgggagcttctgcctgtctgagcactaggaggttggccgtgtgttgcgatgtggccatttgagcctttgggggcgttttgtctccccataggtgggggtcccacagcggccagggactgtgtgtccccaccttggtgcagaggagtaggtagggaggggagtcgtgagcccgctctgggctgcagtctgagccgcatctgtctgctgatggcattggtgggctgggactctcagggttcccgagcctaggacttctccatcccatggaggtggagactccgccccagtgggcccactggagcaaggtccaaatgagaagcagaggaaggggcttttaggtcatgaagggtcaacaggcgccagggagtccttcagacgacgcggagcaaaagcccagcacggccaagtaggaccaggtcgctgggcgaggggagacctccaccccacaacgtcccctctccgcgactccatccgaaggaggcccaatgctgccccctgctggctgctggtgggcacacgggttccccaagctgagcaagaggatgcaggttcagggcatccgaacctgggcagggcaaggagatcaggacccaaaccgggccccagggggaggaagacgcgagaaggccctcaccccaggccccaaggcctgaatcccaccagagtgtaacctttagaccccagttcaaacaggaacccgggatagcacctgaggcaggtaagggtctgcctttcctgggagcagggggtcttggaggcaggagggaaggtcccctctgctacccaccccaaggcagggttgcatccaagcctggtttatgtgagagacttggagagaagctcggcctgcagtcggttcctggcccttatgcttcgtaaccacagtggaagcaagtacgacaaagcagctacgcatgcagggaaactgccggccccggggacctgccccagccgatttccatgacaacccatgggaccaggacccagataaggagactgagggtcaggtaggtgagggcctgcagcaggtgcagagctggggctgaatgcagtcgcctggtccaaagcccagactgtggggtccagcgccagggccacgggaggcctgtgccctcttcccagctgggcccatttccacctgccctctgtcaccccccaggcctcctcacctggttggcgtcatagaagaagcccctcctcagctgcagcagggccagtcgtgccagcacaggggctgcctggggcctccgggatagggccaccagcagggccttgtgggtctcctccaggcggcccaggcggtacagggcatcagccgccaggaggcgagaggcctcgtcctctgaatccagctccatcagcagtgtggccagctggtgcacgccgcaggcgaccctgtgtggagatcagctcaggggggcatgccccttttgacaacccctccacctgcccaggtgattgggcagtggggaaatcccgtctccatgtacctggcctgggcagctccctccggagggaccctcacgccacaccatccccagaagccaaaggtgcccttcctagcatgcggccctcacgctctcccttgcccttcccctaccctgtgggaggtgggattgtggcggtatagacaggcagaggcagggctgaccctgtgtggaccctgcctcagtttccttttctgcaaaaacacagacgaacaatttggccttgctgggctcaggggtgtgcctataggcagaacaagaaaacacatggctgcacctggcatgttcctgtgcccatgtgggaatgttactgagtgctcactgggaaatggggccagatcctcaaatttgacaatttccagagaacaaatataaatgccatcacataatgaaagtttcttaccagcagcaaatcaaagccacgcaaattaaacacccagaaggcagaggaactctgtgtgttttgtgtgcgttatgtacatgttgtgtgttgtgtgtgtgttatgtacatgttgtgtgttgtatgtgtgttatgtacatgtgtgttgtgtgtggtgtgtgtgttgtatgtgtggtgtgtatggtgtgtgtctggtgtgttgtgtgtgtgttatgtatgtgttgtgcgtgtgtgtgttgtgtgtgtgccttggggtggacgctgacatcaatgatgcccctccaagaaccgcccccaccccccggactcagtgcttttaactttgctgaaaccccttcctgccacctcccagcaattacacgagggaagtcaaagcagctagggattcacccactgggctttgggctggcaaataatttgcaaaatgagcatcaagggtgagtgggggatgggcggtggccagattgtggtgggaggagggcagctcctgaagtcaaggatcctacaagtggcggcgcttcctgacccgggaactgcatgcctgtctccgtctcatggagagaacatcctggagacaggacattacccacgagggattacagctaagaacaaaggccaggcgcggtggctcacctggaatcccagcactttgggaggcccgggtgggaggatcacttgaggtcaggagttcgagaccagcctggccaccatggtgaaaccccatgccactaaaaatataaagattagctgggcgtggtgatcccagctacttgggacgctgaggcagaagaatggcctgaacccaggaggcggaggttgcagcaagccaagattgcgccattgcactccagcctgggcggcagagtaagactccatctcaaagaacaaaaaacaaaacaaaacaaaacaaaccaaccccaggactgctggaaggagtagtggcaggggcgcaggtcggggcggtgctgccggaaacacatttagccacaaagggaatcgtcatgacctattgagtaagaaaattagcatatgaacagcatgtccagcacagactcggtttggtgagctattttacatgcaccaaacgaaaggcctggaaggaaatgtgagccgcggatttccatttccggactgcggcccggtcgatggaagcagcggagctagacctgcctcgggtgctttgggaagtcaccagccactgcctccgttcattcctttgtaaaataggaggaaacacatccgtcgctacctcgaaggagacccgcaggaagcagcggccccagcgtgcccgggcgggtcctcacccctcctgcgtggtggggccgcccgtctctgcggcctccctccggccctgcgctctggacggcccggcgcgtggagatcgctgcagcatcccacgggcctcctcccgcagcaccaccagcagcagcccccgctggttccagggcacgtaggccttggcggccagcagcgcctcctcgggccgcagcctgcaggcggtgacatagtccagcgtgcccaggaacgcgctgcccgccagcacccgcagcagtccccggccgcacagcgcgcgcacacagccccccgggtgcggcgccccctgctccactaccgtctggaagtcctccatggcgcgccgcgagtccccggcgtgcagcgcgcagaagccgcgcagagccaggagaggtgcgcggtcccctgcacggtcccccgcagggtcctcagggcgtgcgggccgcagcaggcgctcgcacatggcccgggcgcccgccgcgtcccctgccagcagcaggcactcggcgaggcgggctcccagcgcgggtcgcgccccggcaggcgccaggcgaagcaggacgcggagcgcgcgggttaccggggccagcagctcgcggcccgcatcctcgcggagctcagggtggttccgcacggcttcctggaagcgggcgaagcccacgtccgcggcctcctgcgcctgagcccggacgcgctcctggtcctggacagagaacacggcctggaactgcctccgcgccccagaggggctctcgcggaaggcctcctgcaggttccaaaacacgtcctgggcccggccgtccaggaagaaggccgaggccgcgcgggtgaccagcagggcggctcggcgctcacctgcggagagaaacagaggcgtgggttctgcctggggggccgactccccgggggtgccacctgcaagtccccaccaggtccagggcttggactcaggagactgtgagtcctcctgcccgaggcatctccctccagtctccaggtggccctgggtatggcaccgccaggacaccagctggcaggaggcccgacgcccatgagcgacggggcaggttgagaaccgtgctgggcaagcggcgagggggcagccgcccggcctgccagcgacactgtgctctcagggtgggttcagagtcactcccaccgctcagtgcaaaccaaattcagttacaacgcctttcccttgcctgacatttaaataatgggttttaggattgagtttcctcctctgggaatcagtgcccctccactcccagggcagagctgaagctccaactctatgacctttgcagtggccatttattcctgggcgcctttgtttcttgccttctttgggccaagtggggacccagcccttccctctctgaagcagagctcttctctcaggtctaggactggaggggcatgccctgctgcttactgagggtggacctgggcatttacggagtctcctgcgtctgttccctggtctgcactataatgggttataatgatccacgctcgcagggggtgaggattaaacggatctacctacatccagtgcctggaaggggcctggtgcatcgtgtgagtcagtgaggtcaggggcagcatccccacccccactcccccagcaccctccccgcgcacctgccccccaccccagtgtgtctgagcaaacgtgaatggggctttctgactggtaagggaagtgtagctgccccatcccaaaaagggccccaggcagggtgcacaggccactgggagaggcggggatactccgtgctgggcgggcttcaggtcatggcccttattttcacaggttacgaaggtgctgcaggggagggacgttctgagggtccatcccagacctctgaacctctgcttcagtgctttttgcactgactccttcagaattttcaaacagcttttccttataaccccattcaatagcaacaacagcaacaatctgctgcattcaaacaggattctggagagggcaaaataccacgcagggcacagaagcaaagccgctgcggtcactgccctgctgctgttgcggtaagcgccgagtccagcacagaaggtgtctcgtgccctgagactagccatgcaagcagccacaaggtcactctgtctagttctggtggccaaagtaaaagacactttgagcctttcctgccagctactgacccttgaacacaacattacccctgatttttgcagtggctcatggatccgagggagctgcagccaggggagaacccttgggacctgagggtgatggggcgctgttatttatgttcccacgtgaaagggtgatctctcctctctttccgagattccagttacacacacgagactttgatattgtccccaggtcacccagcctctgttcatttttcttctgttcttcgtatcgagtaatttctattctgtcttcaagttcaccgacccttctactgtcgctaatattttcatttcaattattgcactgttcaactctagacttgccatatgctttttttttttttttttttttttttttaaagacagggtcttgctccatcacccaggctggagtgcagtggtgtaaatacggctcactgtaaccttgacctcctgggctcagcctcctgtgtagttgggactacaggcatgcaccaccatacccagctcacttttggatgttttttggagttggagtctcactttgtcacccagggtggtcttgaacttctgggcccaggtgatcctcccgcctcagcctcccaaagtactggtactcctttttataaggaaccatgcctagcctggttcctttatatgatttccatttatctatgaagattccacatcagttcaatcgttaggtccacattttcctgaagtcagtttttagggatttctttttctccttactgtagctcatattttattttcctgtctctttgcatgaatagtagtttcttcccacacaccaggcatgatggacactttgtggagactctgggttcagttacattcctctgaagagagctgagttttgttttagtagcagtgaaattggctgggtttaaactccaaattctattgctttttggtggacagagctgaagtctccatttagcttttgcagcttccagtgcctgttctttcagcccagctagtctttacctctgtatgtgcagttctgtaggctggagatttaagtagatttaatacacagatttggtgctgcaccccctctgtggctccctccttttcaagattcttcatctaactttccatccatttttctcagccctgaactgtcctgtgctacctcaagccaggagaacgccagcatctgctgaacaatgactcatagattgaggagccccctcaggtgaagagctgcggggtgcacatctcacctcacacaacaccattgttcaagggtcagctactagtttctgcctgcatgtggttacgaatccatgccttcaaatagtcactttttatattttgtccagcttttataatcgttatctgtgggacatgtaggcaagctattccacagtgacttgaagccaacttgaagccagatcttctattgttagatagacaatttttgactggctgagaggaatgtaaatgctatcacattattgttttaatttctattttcctgatgactagtgaggtttacttattaatttttttccccaatctggtgggtggaaaatggtctctcattgttttaattttgcatttgtctcattactatgatgctgaatattgttcacatgttttattagccatctgtgtttcctcttttggggaatgcttttgccaagtcttgtattgaattttttttcttattgatatgtaggagttcttcaaatactctgcatactaatttatctgctcattgtatattttgcaagcatttttctccttttgtggatcgtctttattttctatagttatgggcaaaatagaagttttaaattttagtttaatcagatgtattaaatttttctttattgattccctgttttgtatcttaagaagcccacctgtacatagaaatcttaatgacattctcagatattttcttttagaaactgtaaaatgcagcaatttccacctgggattcgcttttttgcaaggtgagaggtaggaaatcagtaccctccattgaataatgctccttttctttctctatagatttgcaacactcatctgtcacctgttaagttttagatcgacgtgggtccacttctgagctctctaattcattttattggtctttctatctattcctgaagtcaataaacttccgtattgattagtatagcttcatattaactggtagagcaaatccttctactgccacctcttccttctccatcttctgcttctccttctcctcttctcccccatcccacctccccactcccctacctctcccttcccctcctcgccctccttcttcttctgtggacagtgaatatctctccatttatatagatattctttcttttctgatacaatgtttgctgttgcccaggctggcatgcagtggtgtgattacagctcactgcagccttcatctcccaagcttaagagatcctcccatgtcagtctggtaagtagctgggatcacaggtatgcaccacgtgcctggataagtttttttgtattttaaaaattttttgtagagaccagttcccactatgttgcccaggctggtgtcagacttctgagctcaagggttcctcctgtttcagcctccaaaagtgctgggattacaggcatgagccactgaggcatggctataggtattctttattatctttcaataaagttttatactttttccataaagtcatgtgactcttagaacttaatcattttctgtccctgtggtaaatgggacacagggcatctatttgttgctggtatttataaatataaataatgttttgcatattttgttaaattttgctacaatgtctaatacctttttgttgcttcttttggaatttctatatacatagctaatcatattgcctggaataattataactttgtgacttcctttctggtcttacatgttctgtcttgttttcttaccttattgcattggctaggatctctagcacaatgatgagtaactgggagagtgcacagcctcctcgtaattgattttaaatggaaggcttctgaattgtcaccattgagtatgatatttatggtgggtttgggatagatattatctttttcaattaagtaagttttcttctgtttcttgattgttaaaattctgggaatgtgaaatattataaaacagtttttctgaatctactgcaatgataatatgttctttattccattaattattaatgtagtgaattatataattctggaaacataaaattttaagttctatattataatatttgacgaaatgttggctaaaatgcatcaaaactgatgttttgacctggtcagcagttatttcagctaactattcctgcataaccatccactgtaaaacttagtggcttaaaacaacaatcaagcctgggcaacgtggtgagaccccatctctacaaaaaaaaaaaaaaattagccagttgtgatggtgtgtacctatagtcccagctacttgggaggctgaggcaggaggactgcttgagcctgggagattgagtgcagtgagccatgatcacacaactgcactccagcctgggagacagagcaagaccctgtctcaaaaaggaaaatccaaccatttatatttgcccataattattcctcagtttgggctggcctaagctggacagttcttctgttggtcttaccaggggtcactcaggtggctgcagccatccagtggctttaccggacaagagactctaaggtggcctcactcatgtgtccggggccttggtgatggctgtcagctgagcctctgtctgtgtgttctctcactggtcatgattccagcttccttacatggccctgggagaattccaaggtgaaggtggaagccgtggggcctctgaggcttgggctcctgaagcacaagccatcacttctaccatattctactggtcccagcaaggcacaaggccatgccagattctgtacggagaacagaccctgcatcttgctgggaggaaagcaggaatcacagctatgctttgtcacctttcctagcgctcttaatgaagaaccttaaacaaattggaagtggtcatcccagtcctttggtaagacaaacacgtagggagccatggtacctggatgcttacttagcagctaccttgagggaaagtggtatttattctgtatcttgtcctcatacatcgtgtatcgctgcatgtctacttactaaagagggcaaagaaagttcccagattatagaagggttttgctacagtttgaatgtttgttccctccaaaactcatgctgaaacttaactgccattgtaatggtattgacaggtcagatctttgaagatgattaggccatgagggctctgctcttgtgggtgggattaatgcaagttcagcccctttcgcctctttgctcttctgtcttgtgccaagtgaggatgcagcattcaaggcgccatcttggaatccgaatccccaagcctgttggggccttggttttgggcttccagcgtccagaactggagctcattcatttctactcattatggatcacccagcccgtggcattctgtcacagcagcacaaatggagcgactggtttgtgcaatgtttccaaggactttggaaagtaacctccagatggaaggtcatttgttgcaggaaactgcatctgtaaaaagtctgttataggaaaattcatttcttctcttctcatcgtaagccatgcttgtgctggtgctggcgatgtggggagtcccttgaccgaagtgacttgggtctaatggatgcacaattcttagggcaggtgttccctgtacacaccagagccacggcagacacagacgagcttccggtggccttcctggaggagctgggtcttccctcacattccccaagcctgcaacacttggggggttctggatttctgcagagagctttagtgtgacccccacccacacccttaagtcatgccctgcccctgcgtgatcattaaagtggaaggccccctccctcctggagcccccttgctgtgggcatggtcctcaccagcccctgagtgcctgtgctctgggcacccggggtcccctccttcctcagaagctcacgattcggtgtgactttgttgatcattttctggtaatgctcaacatatttgagcatatttccagaaacaaattttcctgctcactttgcagctctctctaactggttcctgccccaccctctcgttggggtcaccaagaacctcggcaccacacgcccaacgcacactccttgtcctctccttacggacattgtggccactctcagggctgcctacctgtctttatcttgcaaacccccttctcttctggccctgatccgtcaccccacgggctccgaattttcttccttcttcctgtcctcctgggctgctcctccccagaagcacagtatggagggcggttaggagcaccccaggggccaggtcctagctgcctgcactccgtatgcccttggcagccccgtgtctcatggggatggtggctgctctgcagattccatgattatgcacatcaaacccatcaaatggggcccacccactagctgttcagtaaacggcagctaatactgccatcctcacctccagatgtctgctggcctgggatgggggctggggcacgaggaaagggcagggagccgcagtgccttgcaggacactcacgccagggaggtcctgtctgctccaggatgcctcgtggccccacttcctgcctctgtcgggagccttgactttcaacctctcatttgcactgaccctaaacccccctttttcaaactgagctcctctcacctcagggctcacctgtctggctgcctaatgacatgaggcttgatgggctcaaaggactgtgtgtaaagcactcagtaggtgacattattctaagggtttgctgtgcatgtttactgaatccacacagcagcctttggggtggagacgcagcctcgtctcaggcactcagggatccgagggtggcagagtgctggcagtaggctgggctgtggccctgggtgctcctccagaaggaagaggcagtgaagggaccgggcaggagcagtgtctcaaactgggggcgtctaaacctctgacaccccttttcccatccgcgcttccctccacagttcagttgctcatcatgaactcagaaaacgttcctgaccctccttctctgtgcctgtctctccaccattaaatctacccacaatctcgtcacttctaactctcagacatgtggtttctctgcaaccctttctccctgatctgaattccatcaactctctcctgaaccattgtcccagcctcccagtctctcagctgcccagcatccaagcctcccagtctctcagcctcccagcctcccagcctctcagcctcttagcccctcagctccccagcctccaagcctctgagcccctcagctccccagccccccagcctcccagcctctcagcctcttagcccctcagctccccagtacccccagcctcccagcctctcagcccctcagctccccagccccccagcctcccagcctcccagcctctcagcccctcagctccccggccccccagcctcccagcctcctagcctctcagcccctcagctccccagccccccagcctcccagcctctcagcctcttagccccttagctccccagccccccagcctcccagcctcccagcctctcagcccctcagctccccagcctcctagcctcccagcctctcagcctctcatcccctcagctccccagccccccagcctcccagcctctcagcctcttagccccttagctccccagcctctcagcctccaaacctcccaacctctcagcctcttagcccctcagctccccagcctcccagcctcccagcccctcagctccccagccccccagcctcccagcctctcagcctcttagcccctcagctccccagccacccagcctcccaggctcccagcctcccagcctctcagcccctcagctccccagccccccagcgtcccagcctctcagcctctcagcccctcagccccccagcctcccagcctcccagcctctcagcctccaagcctcccagccccccagcctcccagcctctcagccttcaagcctcccagcccaccagcctcccagcctctcagcctccaagcctcccagcctctcagcctccaagcctcccagccccccagcctcccagcctctcagcctccaagcctcgcagccccccagcctcccagcctctcagcctccaagcctgccagcctcccagcctctcagcctccaagcctcccagcctcccagcctctcagcctccaagcctcccagccccctagcctcccagcctcccagcctctcagcctccaagcctcccagccccctagcctcccagacttccagcctctcagcctcccggcctcccggcctcccagcctcccagcctcctagcctcccggccccccagcctcccagcctcccagcaggtcttgtccttactctggttcctctggcacattttgcacatggcagccagaggaaagtttaaaaatgcagatcaggcgccgggcgcggtggttcactcctgtaatcccagcactttgggaggctgaggcaggtggatcacttgaggttaggaatttgagaccagcctggccaacatgatgaaactccatctctactaaaaatacaaaaattagccaggcatgatggtgggtgcctgtaatcccagttactcgggaggctgaagcaagagaatctcttgaacccagtgggtggaggttgcggtgagccgagatcgccccattgcactccagcctgggcaacaagaatgaaactccatctcaaaaaaaaaaatgcagctcagagtacctcactccacagctcagcctcacagactgagggtaacatccaagggccttgggaggccaggaggatctagccccacagctgccatcttcagtctcccattcgttttccccttccctccgacagtcgccctggccccctcagtggcagggggagcccaagctcttgctcccctaaggacttggcacatttgcttctgctgcctggaaccctcactctcagcctaaatgattcctctcctgagaagctttccctgatcaccggctggagcagtaccttgcccatcccatttcttaaagcatgcattttgtttgtgtctttgggtgctccaaaggggcagggcctgactttcttgtcactgaggcaccccagccccagcacagcctcaccccatcatggcaggacataaccatgtggggagggagtggcgggggcagctttcaccctggctctgcaggggccatgccgtcctcctaccttggggttcgctgccggtgggatgggcctcgagggcccggctgcatgctgccaggcagtcctcaaacctgccgctgtggagcagagcttcaggtgacagggtgtcactccgggtgcccctggggtccagagccgccaggagtcgctggccaccggtctcctgctggccggcactgtgcccagcctccgggtgccccgagaggtagtcctggagggcactgagcagcgcggggaggtggggccgctggtgggtgcgaatgaaagctaccgtccggtcggcgctggaggcgaaggcctggagataggcggccacaccatccgctgcctgcaccccggacaggacccaggcgagggcgcgggtcagccgcagctccaggacttgctgtgcatgagagtccagcagggcgctgcagcgttgcaccacttcttcgtgacgcccgcgggccagcagacctgccagcaggtgcaggatggcggcggggtggtccgggcagagggcgccgaggaaggcagaggccagcgaccctgtcagggagaccactgccatgccgtcccagtggatggcggggatctggctgtccccgcggcaccaggactccagggtggccaccaccgccgccccccgagcctgggccagggcagtgcgcacactctgcagggctgagggggcgtggcagctgaatgcagccaggtagaaggcggtggccaggggcagctcccccagcgccagatgctgctccccctcccggcagaggcaggccacgagctcctgggctgacatcatgtctgggaccccgacgggcccatgtctggtcctcagagtacctgggggtgggggagcatggtgagtccacagagggcggccagttctcctgccctgtggccacccgtgcccagcctcaagccacctccaccccttcccattgaccccacggtcagtgcagaccccactgggtgaaaactggggggatcctgggctggtggggtggggcctaccaggtgtcccaggccaacttccagcccactgttcacctctggggcctcagtttcgtgccttgcagaatgggacagtggcctcccccagctcagttccctctaagaacatctgacccctgagtgtccatgtcgggagggttacggtggcccgaggtgtcagggcccagcaataggaaccccggacccaccctctgcccctcccaaccctgagcccctcaggaaggcacaccccccgtcagtccaggcagccctctcagtgggacgcaggaccacacccctgcccaccctctcacacctgggccattcgaggggggcgccgagagcacctgccaggcccttgggtcgggggagccaccccagcccatgggtgggggggttcagttttgaggttgaggttccagggacagcccctggtactcccctattccctgtccccaagctacttgacctgacgaactagctccgcacagccctttcttccctcatcaaacaggcagcccccagcatccgctctcagacacacacagacacactcacactcgtctgcagcttggaggctgagccggctgtgccctggggacccagattccctcgtgggtggtgggggacagagggatgtggctggctggagggcccaggcctgggtggggctcctatgaccgccccgtgtgggttggggaaggcacagcctgcggtttcccgggagagtgtcaacacccttgggtctcctggctgtcctgcagcgccccgctgtggccagaggctaccaggccgaggtcccacccacactgccccagccaggctccaatgggctgcctcagagcagagaaccctgagttcatgggggtgttgggggagaaggggcctgtggggtacagccccccatagccggggccagcctccaccctgcctgctctgccagggtgcccccagcctcctctccacatagatgaggagggcgcttcctggaggcaggtgggggccgcctgcccacccagtgcactcaggctctgggtttgtcccccagaactccgcctgggctgctatgcgggcccctcaccgcccagcctcactcctcttctggcagggccctgtcacccggtcctggggcacctccccacaggctgttccctgtgccggcagctgggactggaccttccgtgcacagccagcccatttcccttggccgtcctccctctgagaggcttaggcagccctgtcctgcctgcaccagctgagccagctgtgccctggggagggcagggcacattagccgagggcacacccctcccccatcacagggttgaggcccagaggcagctctgggagccatgacctgagcctactgcccagggaccctgattgttgctgaggaaggggtggcagcatagggactattttaggaaacatcaccttcagcccgtggccaccgtcagcccatgccgcaggagcagaaagactgagtggggtggctggaggcaggctcaggtccctgaagctgagaccccaccaccggcagctgccctggagggcaggcatgagtggggggaatgggggtggtgcgtccctgagagaggtccctcccaattcaggatgccaaggtgcccggacaccaggccaatgctggctcctctgtggggctcagggaagcagggttgggggtgccctttgggggaggagatcttgggagtggggggtggcatccctgatcccctcgatgtctgggtctcctgagacatgccccgcaggccctttggggagggtgtggagcccctgcagcgtgggcagagcagtcagggtcagtctgagggtgcagggcaggggggtcagcagggctggggctgcctggcccagttcttcagctccatgacattcaccagggcccaaggcctgtgcgggtaatgcagtgggggcagtttattaagagattgcccattactcggtgttgattactttcattttaattgccctaattaggcgagagctgtaatggagtggggctgtcaccagggctgtagaagagcccggggcacagaggtggcaggtctgcgcgacagttgccatcacagcagtgccgatgggccccctgcgtctctgccctgtgcacagtgccctgcccggggcccacaggcactggccagatgagcctggaagtctcggagggtcccgagctatgatcacagcccctgcctgagagcagcacacctggatgcaggtaatcccagggccgcctccacgccacctcccaatccgcactctcgtctctgattctgccacagacaaaagtgggcggctgagccggacagggaggccgaggccggtgcctggtagtctcagggtctcgtgttcgggtttgtgctgctttagtttatgagtcaaaaggatttccaacatttccaacttgaggctagcggggggcgggggatactgctcatttgccctctgcacactttcccattcaagaccattagcgcactgacagcgtagggagctggctcatctgacgcttcagggggaaacagggtttgagggtgatggaagcattcagccctgactggacccacaacaactacttgtccttacagacccctgcgaagagcccaggagctgcttccgacgccctgggagccgctcctcctgctctgagcctgcttggctgcccccgtttatgtggtcggacctggctgggtggagggaggggcaggactccgagtcagcacccagcaacgaccccctcactccttgcactcagacttgcagaaatgaaagggcctggttcccacgccggggccgagcaggagcacatggtccccaccagagatgcccttaggagagtccgcagctggcaggacccgtcccagtcacaccgaaggcctgggataaagacgccaccctctgggaagagctctgagccctgtcaccagaatgttcttgaagccagcagtgaaaacagttgacttggtgggagccggggatggccttgaggctgacctcatgtgctcatggctcacagggccgtgcatgggctgctggggcaggcatggctgcaggcggggctcactctgccctttctgcaggtggcacagagcagcgaggcgcccgccccaggaccaggctctccagcctgtttggagctccttttctgctccccaagagtggacacgggtgtgcctattgggcaagggaatcttttggaacctttcccagggcctcttcagaggctcctcgagagggacgggcaggaggaatccagcacacgtgttgtctttatacaaacaggtgcgcttcattcaccctagtcagtggaaccccctgccctccagacacctgagtgccctcaaaggtcaggcatgcaactgggaggcggggtctggccgtgaactgctgctgccaagcacctgcctgcaggctccgccgaggccccaccagcaccagcagccccgaggctgttcctccccagctggaagggaggtctgcaccctcctgccactgggggctgccagcgtggcaacaatttggggcccttggtgaccttgggggtggcgggcacgtgtccttgtcccctaccatcacagcacaaagggagggatccccacagcctaggcctggggcccaggcctgcactgcctttggcagtgatgttgcctccgtgcagcttccccagggccacagcctccccacctgcctgcccctcttccccccgcaggcgctcacctggggaagcagattactttgggctaagccagccccagttagagaggggaagccttagcaacagctcgaggctgcgccccaaaccccaaaaagggtagccctgggctatctcgggggtgcttccccgccctcctgacccgggaacaggtgcagctctggccacttctctggcctcggtgtccaccccacccaaggggcgcctccatcccatgtgccccagagtgccctcccagggtatgtgagcccctcagagccccagctgccaaagcttaggacactcccccaagacttagagcccctcagctcaggggagccccttgggccccggggtttacctggggtatcatccaggagacctgggcagcttcacaggaccagggtggggccagggggcccggccatcaccagatgaaattttcgcctcttgaccctgagccacacaggcaggacctgcaggtggacagccaggcagagaagcgcacagccctccctagtggagcctggggtcgggaggcctctccactccacgccctccctccccgagctaaacttctcgcaggcctggcagcctgcaggcagggcagggcccacccccgcccccgagctcctcttgttccccgggctcctgttccatccttgatcaataatgcagtggggggaggagcccccacccctcccggcccccacccgccagctgctcccgctgtgttgcgatctcagttgcaggggtggtttcggagggcccctttgcattctgggggctactgtgggtgaggctgagggtcagatgcctgtttagggaggagcagattttccatattcgtgttctggcaccacggaggctccgcggttcccttggacccacagttcagccgtggacttctcattgcctttgggggacgctgggggaggaggctcttgggggctagcattccaggtggggaggagctttgccgagccccgtgtggccggtttctgaggcctgcaggggatactcaaccccgaagcgtcctgcctggcctgcagggaatctgaccacccagccccaggggacgggccagggcaaggaaggggccacaagccagcggcccctccaagacctcgtctgtcctcacacccacacctggcccatctgcaggtccccagctttcccgccgaggcatatcctgggcgtgatggcttcttatctcccactgctgcgaggctgcccaccgcggtcccgtccgctcccaccctcgggatctgcaccctcatctcccagtgcctggccactcagcccagccacgccggccccttcctgggctggaccccaccctgttccccacagtctgttcttgccccagggcctttgcactgcccgctgttgcccccatagccggcaggtctgggctcaatccttcttccttcaacagaccttggccgacttccccatctcacgcagccccactgctgctcctccctgcccacaccccttcgccacccaacactgacacgcacttttgtctgcattggtggcgtttctgccttggcgtgtaggtgagcagggcagggtaagcctgccaccccctcaacaggacctggcaggtagaagagaagcaaaggaaggtgtgaaggaaggaaagagggagggaggacgtgcggagatgtcttctccgacctctgtgctacactgggcaagggagagcccagcttcccccggaggaggtcagccatgagccacaggtctccccggacttagctgggcagggcagggttctgctcctgtcaaaccgagaatttggagaagctcctcggcccggtgctgctccacctccccctttgtcttttcctttccccgaaacttcccaaccaacaggcactggggagagaatgatgaacgtggtgcgggagctgggcgccgggttgtgtacacagcctgtatcggtttgaactaacgaagtttattaaccaggcaacccagaatcattaatcacgcagaaaaataacacagcgaaatgacttttcaaaatgccattggtataattatcgtcttgcccattacactaaatgccgccatttatatctgtgatacttaagtatgcaaacagtaattaacgtggtaatgaaccgggggccccagagcctcccctccctgagctaatttgcatgttaattatcattagcgaccagggaaacaagttataaacagcctaattagcagccagatcatttttacaagagatcgcgtgcactttgacacgtgaaccagtgtgagattaatgaagtcaggcgaggccgcccctcctgcggggtgggggtggggtggcctcagtgcagtggcctcggtggtctctgggtgctgttagcaggtgatggctggtggcctcaggctgcccctgaatggtggggcttgggcttccctctccacgcggcttgggctggatgagaccaggaaagtgggggccctggtaaagggaaattatcctgacccttggtaaggaagacttcattcaagactgttgcgtaagagagagagacagggttcgaccccggatgccaggacaagtgggggttcacagcccaggagcagggtaggggcttggtggatgggagatcacaaagcggggacaccagggcagagagattcttgcaaacccacttcattgattcttgctcaaggtggagtgatcccatatccagggcggggattggctccaaactgccttagccggattcttgccacagatggaccccgcaggctgaagcagggcccaggtgaggctgagctgagaacagcgctcagcagcccacccggactttcccatcccaaagtccaggtcctctgcttttgtgcctggcccctctcctgcaccctgagcctctcggccaaccccgggctttgctccttccaagagacaccatttaaccaaccagacatgtgtgccccaccctcccccacctgcagaacagccctgtgggggtgagaaccatcaccctgtttcagcaagcaggaagcccaggcacagagagatgggaacctgccccaggcctgcagtcccagcagctggtgagtcccgggccctgacgccgcagcctcgctgctgcccctggacacgccgggcaggtcctgctccagggccttttcatcacaaagagccctgtgcacgctggcgtccaccctgactgcgccattcagcctccatcccgtcctcctttcccatggtatttttgctcaggctcttgcctagtgtcggcgtgttcctgtctgtctccctggcaagagtgccggcttgcgggggcaggacatgtcccgttgatcccccgctccccagtgcctagatcagcccgacgtgcagcaggcttcccagcactgtggaggggggcacgtctggccatgaatcgctccagagtgggggctgaaaatgttttttggaaagggttccaatcgcaaagtttacattccactcaaccgtggcagcacaaaagcagccgtggacagcatgcagacacacaggccagccctgcgcccgcaccgtccgatgttggcatcctcaaaccagatacctggccggctacctgccgcctcacacacccaccacgctccatttcagaccctctgggccttgctggccttctctttgtttgatgtgggctctgagtgattttggacaggcaccacccaacacagcagggctgactcttgcctcctgcccgggttcctgaggacgcagccacagggccatgcccagagcctgcagggcagtcaacacccgggggcctggaggagtggggagtgtgagcgcctctccttttctgctgcacaagagaggccccgggcgcaggttgctgcatggggtcccccgggccaggtgcgggggacacctggggacttgtcttcctcggggccacctcctatggcttccctgtcccatcagtaccactgctcgggggactgttcttcctgttaggataacggccccaaggccccccccacccccattaggctgtgctttctggggagcccaggtcaaggtggtctcggaaagcagacccttagggtgggattttggagctgggtcactcactggcctgagggccacagggccctggtgctggtgggaaggggggcggtgaggaccctgccaggcagcctcatggtgccctggcctcactgggccacggagacaggaggagctcggtggggacgcacggtggaaggtctggggctgtggaggagctggggctgccggcctcgcaggtgtggttggggtgggtggggctgccgtgggcctggctccatggctctgtgcaggtggcagccggcgccgcgtgtcgccacccacacaggaaaggcgagattggtggcagaggccgtgtccgcgtcatcatgggagctgcagctcttcccttagttccctgcacccacttattgaggggggctggtcctcctgggaaaggacctggcagcatccccgggcgtgggacacatgcctcgcagcagagttgggggacacggggctgtgcccgccctccctgcactagaaccagcagcagcaaacagcccccagctcggccgctgaccatgtcctgctcgggtctcccgggctggccctggcccgcttagcctggactcaggtgcctgtggccggctgctcgtgccttcccatcctggggcaacccggggagtggcagtgcagcctcggctgagacggccgccatccctgccctcaggtctcctatggggaagcagaaacatgcccgatggctctgggggtgggcaagcaccagcaactggcacaggccactcctggcacagggggaggtggccttatcaagggtgaggacacaaacccagagaagggaggggacatggggcaaagccacctgccctgcgcctcaagggacctgtggccttggcctgggaagtgccacatgggaaggaggtgtgggcctgctgagcacggtcatgtgtgggcctggcccaaggctccgccagcaggtagggtggggtggttctcgccctcttgggcctagggcctcaccctgggatgcctcgagtgatgtatctgcccggccccatggcaggcgagtccgattccttggatccggcctggatctgcctgagcgagagcctcctgggagtccagagcagcaagtggagaactcgctctgagaagcgcgtggactccctggcgaggccgtggccccagctgaacctatggcctgggttccaccaccctcacctcccactgctccttggtcacagtgggcccagcaggccacagcacggcattacgggacgtactgcctccttcctggcaccagcctctgcctggtcagtttccttttctagaaccttcttcctggttccctggactctgcttagacatttggccctcccaggaccccctgagccctcctgagccctggcccctgctccatgtgcccctcggtccggcagcctgcagcccccgccctcccctagccgtgcccatgcagtcccaggcctgagactggctgcgggggggggggggggtacacgtgctcctggactgaacgctgctaccgtaacttcatcagcaccctccaggcgaggaccacgtgtccagcccctgctgtgcacacgactgagggttgtcggttccccgagctcagctgaactccctcctgccagctagccgtccccatcgcccggactggggaacagtcctcctggggatgccgcactcctctccatcattctcggtgcccctgctagctcagccagccttcttgtggtgaggacagcggcgggactggggcccccaaaggcctctcagcctgggacgagctacaggcattgctaggtgtgaatgtcagagccaccctccccagcaccagggtcaccctctccctgtgcccctgtgcagggcctggggacctgccccttgttccctcacaccagggactgctggggactggatggggtctgcacaattcctggaggtgccattgtggtgggagaccctgggggagacagtggctgcacagcagtacgtttagcacagagcacatttgctgaccacttccttggtcttgggccctggactcagcaccgcacaggcccttcctgttcctcccagcaaccccgtggggctcgactggacataagggcctggctcacgctctgggaggaggcagagcaagcctctccctgtgaggaaatcacggggactcagggatgctgtccagacatctggaccctcagctccctctttcctcccactcatgggattccctggggcccgggtcaggataccaggctgccacctctgggcagccacctccaggcagccctcccggactgcccaggccctagctccgaatctgtagcacctcagtcttcttctctccgttgaacatttcaccctctcctactgcagggcagagtgacccctgtcctgtgaggatgtggccttgaatggcccaatgggccaggaattcctcggggacaagagctgcattctccctgcctccccagcacccagcccagtgggccctgcagggcacaatgacctggtttgttggttccaggcaggcagggtggcagtgggccccaggggtcacaggccagtggggaaacagccatgggggcagctctggctgagcgtcactggccctcctgggggattaaggtccttgtcacaggggcctccaggccagccccagcagctagcacatggccggctccagctctaaggcctgtgtctgagccagggaagagagaggaggagccccctgagagcggcacaggggatccccaggggctgaagccatagtggggtgtgaggtctgtagtggggtgtgaggtgtgtggggggccatccacagagggggctgtgtggtggcagtttcaggctcaggctgaaataggaactgagaggagacaggtttggctgtgtggctgctgaaggcagcccggccggcagcgccttggggacagggaggagctacggtctcctgcgattgtcttctgggcctgggggcttgactggctctgaggcactgaagaagctgtcatccatggggagggccggcccatttgctgtgcctgaatgaccttctgatctgaggcttgtgcaggcgcctgcctgggcagcttttattgttgatgaccacgttatcttcctaattattagatgtggggagacctccggggaagttcttcatggtagaagggaaaacccccttcttggctgtcaggagagaatcccacagtgtaaagttctaggaagtgaagtgagaaaaatactttaggtttcagttggaaaaaaaaaacaaaacaaaaatggcttttttgattatttaaaaatagtttaaagatatttaaaaataatggccaggcacagtggctcacacctgtaatctcagcactttgggaggccgaggcaggaggatagcttgaggaggccagcctgggcaacatagggagcctccatctctacaaagaaaagaaaacccacctgtcgcccccagccttggtgcccatgtgtgcccagggtgtgtggatagcaagtatctgccagctgctgctgctatgacaaacatctccacttctcagtggttcccagctgctcacagggcggctgctgcctgcggctctgctggctcagctccgtgcagctgatttggccccagtggcctttgcattccaggccccaggctgcaggagaatctgtctgggctgtgataatgttcgaacggaggtgtgggaggcagcatcatggctcctccaaaatgtccacacccttgtccctggaagctgtggacatgtgacctcctgtggctcaaggggctttgcagggtgagtagagatgttgagatggagagggccctggcacctgaatattcacaaggggtggcaggagggtcggagccaaagagcagcgtgacagtgaaggtggaggctagggtcagctgtgctgccaactgcgatggtggaggaaggggccatgagtcagggatgccacagcctctagaagctgagaaggtgtgaaatggattcttctgtggagcccctaggaggaaggcagccctgctcacaccttgattttagcccagtgggacccattggaggcatctgacctccagaacggtagtaaatttctgttgtttttgttgcagctttgataggaaactaacagaaaggggaaggagcaagaggggttcggccaacccctgcaagtgcattttccgtggatctgacagggccgcacctcacctgtgcccacgttctatgagtcaagatgtgtcacgtggccaggcacaaagccagtggcaccaggaacacaccctcctccagggaggtgacaggagaactggggatggtgagaggtgacagcatgctggcagtcctcgctcactcttggcgcctcctcggcctcggcggccactctggccatgcttgacgagcccttcagcctgctgctgcactgtgggagcccctctctgggctggccgaggccagagccggctccctcttgcagggaggtgtggagggagaggcacaggcaggaaccggggctgcacgtggtgctcacgcgccagcgtgagctccgggtgggtgcaggctcggtgggccccacacttggagtggccggccggcgctgccagccccgggcagtgaggggcttagcacctgggccagcagctgcggaggagggtacaccaggtaccccagcactgccggcccacctccgccatgcttgaattctcaccaggcctcagccgcctccccatggggcagggcttgggacctgcagcctgccatgcctgagcccccctcccactgtgggctcccgtggggcccagcctccctgacaggtgccgccctctgctccgaggcgcccagtcccatcgaccgcccaagggctgaggggtgtgggtgtggtgcaggactggtgggctgccctcccgggcccagagggggatccactaggtgaagccagctgggctcctgagtcgggtggggagttggagaacttttacatctagctagaggattgtaaatacaccaatcagcactctgtgtctagctaaatgtttgtaaatgcaccaaacagtgctctgtgtctagctaatctcgtggggacttggagaacttttatatctagctggaagattgtaaatgcaccaatcagcactctgtgtctagctcaaggtttgtaaatgcaccaatcagcaccctgtcaaaacggaccaatcagctctctgtaaaatggaccaatcagcaggatgtgggtggggtcagataagggaataaaagcaggctgcacgagctagcaggggcaacccgctggggtcgtcttccatgcggtagaagctttgttcttttgctgtttgcaataaatcttgttgctggtcactgtttgggtccgcactgcctttgtgagctgtaacgctcaccacgaaggtctgcgggttcactgctgaggccagtgagagcccgagcccaccaggaggaatgaacaactccggatgggagaaacgaacaactccagatccgccgacttaagagctgcaacactcaccgccaagctatgcagcttgactcctgaagccagcgagaccacgaacccatcagaagaaaaactgtgaacacacccgaggaataaactccggacacaccatctttaagaattgtaacactcaccacgagggtccacggcttcattcttgaggttagtgagaccaagaacctaccaattctggacataatggtgggaaagtgaaaccacctgccccagtagtgggtcacaaatgtctccttcactgatgcatgcaaaacatgcaacccccgaaagcctcagccggtcctggcttcgagcacggcacccagcatctggtgatgaccatcgtggctcacgtggctcctcttaacctggagccttgggcactaagacgagtgaccagccctgctgggccccacacagcaccgagccggggacaggcttgtctcggtaaatgcgcccaactagaaggggaatcaggggacccacagcagttaccggtccctggggactctaaaatgccccgggactggctgcagcgtcagcctgggctgcggtaggaatgccggttcttcgccctgggaggggccccagacactgggctgtccttcttttcctgcatcttcctgggccgcatctgcagagccttggggaacgcctctgaggggctcggctggctccctgcccatgggaagctggggccaagggctgcgtctcaccttgagtggtcgtcgtctgtgttaagctgggctggatgtcctctggtcggtatgattttctggaaatctttttagaattaagatattcggttccatccagctccatccaggatctaaaatgtttaaaggaatttagctattcccccattaaaaatgatttaatttaataattttttattttttgggatagggtcttaactctgtcgcccagggtgatgtgccaagtggtgcgatctcggctccctgcaatctgcctcctgtgctcaagtgatcctcccacctcagcctcccaagtagctgagaccacaggcacacaccaccacacctggctaattcttgtcttttttgtggagatggggtttcaccatgttgcccaggctgatctcaaactcctgggctcaagcaatccgcctgccttggcctcccaaagtgctgggatcacaggcgtgagccactgcacctagcctgcaaatgatgattgtaattttaaaactaaaaaaaagaatagtaagatttctgtttgcaactcaggagctcaggaagaactgggtttttaactttttaagacccctgtggggtggcagccggggcttgggggcagggagcaggagggccaggctgggcgaggaccccggcggaaggaggcaggcgtctccacctggggccaggttgcttcctggctccctggcctgaagggcgaggctggcctctccctggccctcccgtctggagctgcagcctgtacccagaggtcttctgggaacgcacctaatcacacaactccgtccctgtagtcctggccgcagcctcagcacagccagcaccccatgctgggcaggaggacgaggaccccagggtctggatcaggcagtgccgacctgggatttgttcgcattcttgagtgttgcccaggctttggcagcggtggctgtagagccgaacatggttctgttcttctgctgtttattctcatgatattgaaaaagcatattatttttaaagtatttgaatctcatttaaaaaatcaaactaaacatttactatgtttgagatgtaaaagttcttaagtgtattacaacatcaagcaaaatatatgtttataaaactatagacatcaaacgtttactattattttaaaagaaggttttagcagataaatgaattaaagcaaagtatgttataaaaaatcaaacatcatgtaataaaagaaaagctggagaggctggatgtggtggctcatacctgtaatcccagcactgtgggaggtcgaggcgggcagattgcttgagctcaggagttcaagaccagcctgggcaatatggagaaaccttgtctttacaaaaaatataaaaattatttgggagtggtggcaagcacttgtagtcccagctaatcagtaggctaatatggaggattgcttgagcccgagaggaggtcaaggctgcagtgagccatgataatgcccctgcccgccagccttggtggtagatatgggtcgttgatcactgcttaacaaatcaccccaacagtcagtggcttggaacaatccatatcaatcattgttcttgtgtttttggtcagcagaggatggggtagggtgatcctccaggtccaggctagcgttttccatggttgagggctgggcgggctgtgggctgaggcgcctcaagtctcctctgtgtggcctctcatcctccaacaactagcttgagcttgtcccgacggcagaagcaggtttttttgggggtggggaagagatggattgaggaagccccagggccactgtgaacttgtctgctgccacattcacgtatcccagtggtcggcccggattcaaagcaggtggggtcagtctgcatctcctgtgggaaaagtagccaccttaccttgccaacgatgccacgacgggaaggatggagagtcagccgctgcacggtgccgctgctccttggactctgagacattcttttaacccttttcccatttgccctgagaatactcaccagcagtgcccacggctgcggcatttactgagatagctttgccacaaaatatctcacttttattattattttcccatcgctctggaatatcgactttggaaacaaaagccatcattctattattttgtttttagtcatggtatttccatttacaaatatagtaactttcgatcgctgcaaaaaaccatgccattcctgtgcgtgatggtgacattgttctcaaacacttgttggccgaagattcgtttgatgaatccgatttttccgaaatagacgattctgataattcagacgattctgatgtcagttctgtttagaaataactccaagaacagtttttatattttatttccatgttgaaaatcagtcagatttgtttcagcctcaaagagcgtattgatgtaaaattaaatgaatgctgctagcaagctgcactttcttttttctgaacaggaaaattaaatcttctttaaggtcctgctcttttcctcttgacagcaagctaccactgtttagagagagtctcctgttgtcttcgtcctgaggcttcttccatctgcacggaggttccgaagcgtttatgacatatcaatccctctaccatcaggcacacatttcactgttttgggagaaggcctttggactgaagctggaatcactgctgctccgtgggtgcttgtcatggctcctgtggatgggaacccgctaggcttctaggctctgcatgggtttgtctttttgaataaattgagcaattgaattattgatcctggcctcatgatataaaggattggattttgatttcttaaaaattctgaagtcacggcagtataccagtaaacgctctaggaccttggttcttacaggtggcatggtatcgtgggacgccgggacacaggagtccttggaagtgggctgcggcctctgtttagtctgctggtcagcaggagcccctgttctgagggtgctgctcccctgccaagcccttcccatgcttccctatagcaccaggacaaggcccacagagcccatggaggcctcgccgtctggctggactatctggctggtcttgactttcccacggaggcctggccatctggctggtcttgaccttgactccatgatactggtgtgtgctgaatcatcttagtgtttttttttttttttctccagctcaaacacacgcacctctttgtccttccttggctggtgagaggttcattgtccatcttttctcggctccccatccccacagtgttgtagaagcctccaggccctccagggctcagggctggctgggggccccagggtgaggcccacactcttcctacccctgctctcactgggccaggagtgtcagctgggggccccactgcttcaggtcttggtgggcaccactcacaaccaaccactatgggaaccaggtgcaccccaggctctccctgctgcctgccctgcaggggctgcaggggcaagtagacactgccatgctggccctctcctccccctgggtcttgggccttccctgggctctggattcaagtactcccttcatgttctcctctccaggaagccccaagctttcttaaggcaccagaaacacaacagccctctctgcatgtgtgcatatgtgcatgtctgtgtgcctgtgtctgcatgtgagtgtgcctgcatgcatacatgtgtgtatatgccatgctcatgagtctgtgcgtgtgtgcctgcgcatagaggtgcatctgtgcatgtgcccaggtgtgagtgcagatacataggcgtgtatatggccatgtgaatgtgtgcaaaagtgcaatgcacacatgtacttatgaacatatgcgtgtgtgcctatacatgtgcatacgtgcctcaggtgcatgccatccatgtgagtgcgcatgtgtgcgcatgtgtgtaccccaggccattagtgaaacctgacacctggacagcgccattcctaggcaggtgctcccacagtcctatcctgccgtgtctctgatctcaaggcaccctccaagggtggctgtatttccccatttggacagatttattggaaagctaatttcagggtcctcatttgcatgggcctcttccaggcactgtgcgtaattttatatcctttctcttaaagtgggctcccaaattgaaaagcttcacgcctacaagacctcggtctgccctattctcattttaaaatggaggagacggaggcacagagaagtccaagaatttgtgcagggtcatgtgaccagtgcctatgttcagtgatccaatcattgcagcccctctccctacacacacctgaacacacacacctacatgcacacatcacactggcgcacacacacctgcatggacacatgcacacccacacacatctgcacaccctgtatgcacacacctggaagctacacacacttgtatgcacacatttgcacaccccacacaggtgcacacacttacctgcacaaacccacctgcatgcacatgaacacccaacacacctgcacacacacctgtatgcacccacatgcacacccccacacaactgcacacacgcctgcacacccacacacctgtgtgcacacacatgaatgcacacaccacacacctgcacacacatgaacagccacactgcacgcacatgtacacacacacctgcacacacacctgtatgcacacacatgcacacccccacgcacctgcacacacacacacacctatatgaacacacatgaacagccacacctgctggcacacacatgcacacacacatacgtctgcacacacacacctgcatgcacacccctacacctgccgtcatacacaccagcacacctggtgggcacccttgtctggctctgccacacagctgtcttttctggggatgccctgtgaaccccaggatagatgcggcctcttcctttctgttccagaaggagcagctctttccctcctcctgagtctgaccttgccatgtcctgaccttgggactcagctcccctgccccgcccaaccacatctcttccctgggtgcagcgcccaagcgtgtgcctatggggctctggagtcagcgcatctgcgtccacgactgactccactacttccccgtccctttgctgccccgtgaccgattctccatgtttgaaagtggaggcatcaagatctccctcccaggaggacgagagtgagtgagtgaagcgagaaaaccatctgcaactgctcagcccgaattgccgctcagcccgaattaccgctcaggccgaattaccgctcagcccgaattaccgctcaggccgaattaccgctcagcccgaattaccgctcaggccgaattgccgctcagccccaattactgctcagccccaattactgctcagccctcatgatccttgacctgcactggctccaggacctgccttcacttcaggggcctcggtttctccccatggcagtgaccccaagtcagcggagaggcccaaagagtcactcacagaggctgccctaggagtcctaggtgtgcagtgtgggcctggcccagcgccctccatgctcctaccactgtgcatgtgggtcccaggccagggggccaggggtccaggggtcgggggtccagggtcagggtcttggggtaccacgggctgaggggctggaggccaggggttcaggggaccagggggccagggggccagggggccagggtcagtgtcttgggggataagagactgaggggctggaggccagagagccagcagatggggggtccagggcattggggatctggaggcagggggccaaagtgctggaccaggaggactgtgcggtagtggccccgcattcttagcagccaggtctctggtgaggggtggaggtgagcacagccttgggtctgagtcctgcccgtgttctggccagcgtccagctgcatggatgttccaggagtgatggttcaggggacagaaatggcccagctgttgccgtcaggacagataaatagttgaccctgatgtttttcccaccaagaccaacaggcccctgtctctggagccaggagccgctcagctacatcggctggcaagttttgccggctgcctgctgaaccctggcatcttgaaggggctatggctgggggcggcaccagggtgggacacagaagtcagaacctccgagccaggcttggcattcagctctagagaacagcacagccaggtctcagggggccaaggagggtcccagggccagtgccaggcctctgtggcttctggggaacagtgggctgggaaaaagagtctgtgagcttgggggtggctgctggacactggtggagtcaggccttgcctgcagttccgcctgactctgcagagccctgcagccgcgtgtgctcagatgcagcacccagggaagggttcatgggtggatgggcctggggggaaccagtttctaggggatggcccagcaacgcgcaaaagggagacccctgaagccggccggcctgttccgggcacggctgcagccggtcctcgcactcacctcccttgcagacagacccactgaaatccccagcccacctgggagctgctttggggaagaggtcttatggggtctaagggcggtcccagccccaccagctgaggccctgctcagccctctacttcccctgcaccagacacccccttctgggcctccctccagagcgtccctgcctgaggcagcccccggatcactgccctgtgggaggatgagctcttgataggggccggccaggacatggggcctggggctccaggcctcagtttctccatctgggcaagggggtggggagggcactgatgctcatgtggctccctctgtccagggtgagatgtcccctctggagagaggtgctttcactcaaggtgggcacgtgggggccgagcagctccacctccagatggctgtctctcggctgtgcctcagttttctcctcaatgcaacgaggctagcgatgcctcggccgaggctgtggagggagggactggggatccctccagagttcacggcgactgctcctgagtcctggccctgcccctcttggcaggcgccctggagggcccagagtgtgcactggggcggggcgggtggctgctccacctcctcccgcggtcactgctcgtggacaccagcagagggcggccacgcaccacgcacagctgggctgtccacgccggagcccccctccaggtgcgagtcaaggggaggctggggaggggctcaggccgcaggaagaccactgcgcagggcaggggaggggcctcagacctggacctggggtgggaagggtgcagtggggaccctggccggtgcccttggagctgggcctgcactgagcatcctcacggcccacataccgggcttgggcttggggggtgctcgaaagcacggccacccagggcttctccagggcgtgaggaaacagggcaggtgggcaggaggtgcttgggcggcagggcctgcggccacaggggttgtggtctggagtccaagtgcagcccccatccagcttccaaccatggttgggccgcagagggcagaggggtcctgctgttactcctgcagaagtttccaccagctccttctgactggatcttcccctccacctgtcctcacaggggtctctgctccactggacaagcattgaaacatgtctgggggaggggctggcctcctgctcacgagacccacacaacatggtgggtgcagcccattctcctgtctggggtctagagtggacagaggctgggaggtggttgcaggacaggaagggggtgcgtggcagctgtgccgtgagcaggttgtgctctccagacaggagggcccttgcaagtggcgagttctcaggggttcggggaccttggtgccggacgaggaccactcctgaaagagagtttgtctcaggcctgggggaaatgagagcgcagccccatccccacgttaggccaggactgaggcaagctgtccttcaagctgacgaggtcaccctgaaagggtcgcaaatgagcactggcccccaacccccttcctcaccagtcccccgctgcagtggacagggtggggctagggctgggcttctggaaacccatagggcacctgccttaaaagcaatggaaaatgccgggggcctctgagaacaaagatgtccatcgcagtgttatttacgatgccggaactggaaacaaccaagtcttcaaaactggaggaacagccgagaaactattgcacagacatcaaatggaattttattctactaacaacatgaatgatgtgttttttcctttggctgctataaaaattgaaataaacttaaggcttagaaccacacattccttattgtagaattctggaagtcagagtcctacaatgaaagtgtggcagggcgggttcctcctgggggctcgaggcgagaatctcttccttgccttttcacttctagagatgcccatgctcattggcttgtggttcctcctccgttctcaaagctggcagcacagctccttccagtccctctctctgatctctgcttctacacccgcatgtcctcccgctctgaccctcctgcctccctcttaggagagcccagtgatcacactggccccacctggataatcctggataatttcctcatctcaagaacctcaatttaaccccctctgcacagtcccctttgccaggcgtgatggttacttttatgggttaacttgacggggctgtggggttcccagacacttggtcagtgtgactctggctgtgtctgtctgtgaggctgtttctgggtgagattgacatttgaacaggtagacagggtaaagaaggctgccctctgtcatgcgggtggcctcacgcaaccaggggaaggcttgcagagaactaaagaggtgcccctccccagataagaaggaattcactctgccttcagctttaaggaaaccaggggctcctgcggggtctcgaggctgcagatggcagatggtgggctccattggccttcctgatcccctttccccccgacacacagcctgctggttttgcttcctcagagagccctgacgaatgcgccaggtaaggttccggggactgagacgtgggcatctgtggggactgtcattcagctgaccacagatggggtggacagtcctgtcatgtccacctgagaacacggcagagcaacccagaagcatgtgctctgagagctcaccgggccgtctctgggtgttgggattgcagctgactgccttccttctttggatatttcggggttttcgtcttctgttctaatgaggaagttcaatgtaggtggcacatcccagccccaggggaagcaaatgcccaggagccgctgctgggcgaggcgtgtgcattaggctgttctcgtactgctgtagagaaatgcccatgtctgtgtaacttacaagaaaagctcacggttctggaggctgtgtgggaagcacggtggcatctgcgtctggggaggcctcagaaggcttccaatcacggtggaagacgacggggaagtaggtgccttatgtggtgggagcaggagcaagagagagaaggggagctgccacacacactttaaacaaccagatctgtcgctaagacagcaccaaacctggagggctctgcccccaggacccaagcacctcccgccggccccacctccagcactggggatttcatttccacacgagatttgggtggggacagctatcccattgataccaccttggtttggggctgccctggagctgatgcctggggggcgaatcctggctgcctctcctccctctgccccatgtccaggtgttctgaggtcacctggggcttattctgccaaaagagcatctcggtgagtgtgtgtgtgtgtgtgtgtgtgtgtgtgtgtgtgtgtgtgtgtgtgtgtttgggggggtggcactaaggggtcagccagtacagggggtccaggaaggaggtggggagaagactctgtccccaggacctgggaaagggtcacagcctgcccctctgggctgatgggtggggggactttgtccctctggtctgatggggaggggggactttgcccctctgggctgatggggggagactttgcctggctgatggagggtgctttgtctcccaccaggcagcttggtctctctgtctgcagctccccagggccagggccaggtgagggcatgcctggtggcaccttccctggggatggagagcctctggggtccatgggtgtctctgactgggggtcacctgtgtggtcccctgcttcaatttaggtcccctgttctgcaggcaggggcttaagctctgtgggggtgagggcttgctttccagggcagaatgggctgctggaggtgaggtcaaagtcaggctcctagagaaggctgggactagggtcaccattggtaagaaaaggtaaaatgtagtgtcttccctagatggagggagaaaggggccaacttacatggccgcgagggaacccagcctggcagcaggctccggtccacaccaactcgaggtaaatgctggagaagatccccagctgggctgcggtaggacccctccctgcagctggtgccaccctcgggggctctgcctcaggacgccctccacactcagcacaatagcccctgactgttgatctggagagggagcttgcaaacatttctgtttgtttcaagccagaaagcagcagtggagtggggtcggtttgcagggacttccacagcaaagcaccacagcctggacgcttacacagcactgttcccacggccctgcaggctgggagtccagggtcagggcgccgcagggcttgctcctccaggggcctctctgtggctggtagatgccgccttctctgtgtcctcacaggggcgtccctccatgcatctgtcctcacctcctcctgtaaggacacctggattagggcccacccttatgacgtcatttcacctaagtcaccttttcaacgcagggccagagttcagccctaatggggggggggttcagctttcagaggaaccccctcttctgtggctcccccactggtgggcagaagccgggcagggcatggggggatgtttgttgaggtgcagcaagaaaaacctgcagtttcccacactgccaggccgagagcagagacagcttggctgtggtcaggttttctaaaacgctgcttcttaggggccagttttcctcagtcaggtcaccccccgcagccctgggccccaggtggagaatgttctcatgcctgtgccaacaggggctgccaagtgtaggcagagaacggcgggcaggtctgcgccaccgagctgagtttgaggatttcacacaagacctggtggagtggagcgaggactccaccctgtgctggttccgagcccctcaggggcgtttgaggaaggcgcctgtggtcaggacgctggtggtggcattaactcaaccaggtgctggccaagctctggccatagagagtgttctggatcgcgcctgctgggagcagctgggacagggctctctggttcccatgcaccgtgtcctcacgtgggggtcctgctgtctccaggcctggccctcctgaggggcttgagggaagcccagctcccaggtcagtccggagatccctgtcccctgggccatctccctcgtccaggaggtgtgtggggtggaccagggtggggtccacgtccacctaagctgaggagccgacttccaacggtgagattctgctggaaaaaccagaaagcaagagggagacagtggctgtttcagaggccatagcctggcccaggtaggcactgccgtgccatcttgtctttgtgccagctcccatctggctgggattggctttgggacaacaaggtctgggtgtctggctgcagctcggccgagtcacgtgacctccctctgtggtacattcgtctgctggggacctgcacccaccaacccctgggccatgcacagtgccaggtgggagaggcccagggccaggcctgggtgaggacacgttggggctactggaaggccagccccagggctcccatcttgccgagttgagatcccccaagaaggaaaagcaccctgatctggagctcccacactcaccggctgggtaggatggtggcaggccctacctctgtgtgggagggtgaaggcgtcagctgcagtagaaaccatcggctctgggaggaaggggtgcaccgagtgcttctcagagcctctagagggcaaggggcatcgttgggggcctcccaggagaccaaggtctaccccagggatggccagatagagcaaacagagatacaggatgcccagtgacatttgaatgtcagatcagcaagtccttctgagtgtaagtatatcccatgcacgatttgggggcatacttgtactaagaaatgacctggtgttgatctgggattccagagcaagtggacagcctagtttctctggcaactctatctgcagggttccccgttcccaccccaagctcagctggctgggagctcttgttaggacaacctcacagatgtcctgtcccacgacacacagtctgggaaacctgcttgtggctcttctaggggttccttctttcctcacctcaaaggtcctcagagaacatgagtttctgcttgtaactgtgggctttttccactgacagggtcctgcagggtccagagagaaagaagaaaggaagaggaagaagggaggatgggagaagggaaagatggaaggagagaaggagagagaggggagaagagaaggaaggaaggaaggggcaggaagggagaggaagaagaagagaaagaaggcgtgacaggaagcgggagggaggagggaggtgtgaggggagctccaggctccggcctgaggcctccctgctcgtgggttgctgagaccagctcgatcgggggagaccctaacccagtggcactagaggaattaaagacacacacacagaaatacagaggtgtgaagtgggaaatcaggggtctcacagccttcagagctgacagccccaacagagatttacccacatatttattaacagccaaccaggcatagcattgtttctatagatataaaattaactaaaagtatcccttatgggaaacgaagggatgggccaaattgaaggaataggttgggctagtaaactgcagcaggaacatgtccttaaggcataaatcgctcatgctattgtttatggcttaagaatgcctttaagcggttttccgccccgggcaggccaggtgttccttgtcctcattcccgtcaacccacaaccttccagcttgggcattagggccattatgaacatgtcacagtgctgcagagattttgtttatggccagtcttgaggccagtttatggccagattttggggggcttgcttccaacagtgggtgatttattcagccagtgttcctggagtgcctgctgtggcctggtgtggggatccgctgccctggagctgaacgaagccatgccccaggacgttctctcttcagtctgagccaggatcccctggcatcccctaggcctggacttgggctccatcctgctgccacccaatgcccccaaacagtgggacctcacggggcctcagggctgtgaacaggcttcccagtggagtctgtgttttgacttctgggaagaccagggactggaggctcaatgctcacagaaaagggcacagggtggccccaagtacacagaatgggcctggagtccacgctgagtccatctatccccatggcagatacgtcgcaggtggcacgctcctgctggatggtcggaggaccctaagctcacggcagggccactggaggtcacacgaggggtcctcagggcctcactcccaaatcttagctttgtccctggagggtgggagagaggctcttttgtaaagcgagctcacctctctctgacacactctctgccactcccgagccctgggaagcagctgaggcctcagtgtgggggtcctgtcccgggtttgggagtgaggtgggcacggtcctgggctctgcttaacaaacagcacgtgtgtgtccagggctccagcttcctgcccatcatgcagagcccgggggactgatgctttgtggtgaaggaagaatttggcccccatcctccatctgcctgccgcgggggtccccccacccggcagcgagggtcttggcatctgagtttgcctgacacagccagggaggtgaggtggtggcccgttggtggtgtgcgattgagtttgggtcgaaatccaagggtgggaaggaccgtagggattgagagatgcctgagtgtagaaaccattgactaccaggtaacagatttgattaattttgtgcctggaggttttttttttcccccttcccttttctgttcccaaagaatcagagaaaacaaaatatttttctaattaaataaatctacggtgcacgctaatggagcccgtctgtgggtctgtgacagggcaggggagagtggaataatgattttattttttcattaaatagaattataggcagttactcaaagcaacgcggagcctaattgaaagaaacccatttcttcttaatttactttcacggttttggatgataaaagagtgtgttctttggaaaattaaataaaaaacacaacacaaggagaggactctgtttaggcgcattatttgctcctttaagctttaggtaacgggcaccaggctcaggggagacaaggggaggctccggtggtggggatccctcccggggtctctgagggtggaggaagtgacctcaagaccaccaggctctgcggtgctcctctctgcccaggcccaggctgcctggggtatcctcctccttcctggtgcccgggacctccctccagaaagagtttcctttcatcagagtcatggacaggatgatggcctgggatgtggccatcaggacagccgtgtgagtccatgtcctgggcctctgtgcactctggccagcgtcttcctggtccccctggagggctcccacctccaaggtccacgctgctatgtctggccaggtgcctccctccacggtcttccctgctcactcatcaagtaactgccctccccgctgcccgaggctctacttcttcctggaagccctccctgaccagccccaccccctcgaaactccactgagccaagctgagctctgggggtgccccaggcatgggggtgccaaagtccctcaccctcctccttccagttaatgcctcctccttccaggaagccaggggcagagtcagtgctatgaagacggccaagcactgagtctccgcctgaggatccatcctgtccttcgagtgttcgctgagctcccactgtgtgctctgcagagcccggggaaacggaggggttggctgtgggtgccggggccatcctcggagctgcctgtgtggagacgtcctatgtccatgggccacgtgagtctactgagcacttgagacgtagttagtgtgactcgggaatggaattttaaagcacttatcttaatttatttaaatttaaatgtccacctccggccacggtgcaggtaaccgggaaattctggttacttccttgtgcgttggatacaatcctctgacatagagagaagctcccagcacctcagtgacgcaaatgccctcccctctcactcagttctgggggcaaacagcatttctggggtggcagatatatgtggtcagacaagtgtgaggatattgatttgtaattgaatgattatttttaaagaacacaaaatacgaaattcagaatgcacaaagtctccctgagaagcgaggctccctgccccgcccccgcccccgccgcctgctgctgcttcatctcccggagccccggcgagggggaaggtgccagcgccgtgaggccaggtcccacctgtgctcccactaccaagctaccaagaccacagccatcatcatggcgccaaccaaagtctctcctgccaggcgctgcctcactgccatccatgggtgcctttctcggcgtggcagctcctgggcactgtgccctccagattcctcagagcctggtgccaggtgcacctccccagccctctcagcccctgagctctgccaccctgcccgggcttctgcccttgggtcctggcctctcagggtctcctcagctctgcaaggaggggctgggagcaggtcccaggctagcagtgggctggaggcctcctgtgtggtctctacctgtccatgccgaggggtcacctctgggtgaggtcgcacccacccccctcacggggctgctttgccagaaggtctgttcccctcatggcctctgctactctttacacttagttcttcccaggaagggcccggtggctgcagataatgtttcccatctgtggagccttcaagggctgggcccatgaggattctgctcccagcttgctcttcctctccagcctgcacccaccaggccccagaatcctgaggatggagctgctcctgtcccctgaggtggtctaaacctctggggaggcactggaggggcctcaggagcagccactcttccgtgttctccctggacctagaacccgaggggctgggaagagtggaatgcatgagtgtggcctttgaggtcttcctgaggccgtggggcctgcctcgcaggaagcatcagcttcaggaaggctctgcactcagggctgggcgtggccacccacaggcacgtagggagcacctgctgtgtacccagtgctgcactggactctgagacccaggggtgggtgcctgagtaccaccacgtgagagctgccagtcttgtttcctttctgaggggaaactgaggaactcccgcttgccctcccccccgcctcatcctctgtgtcccatgtaaaaggcaggcatctggctggactccctctgggacacccactttcaccaactggcatggctgcctggccagtgctggagagggtccagctgggtctgggctgagcagcagtgagtgtggcgattgattagtgatgtctgccacatgcagagggatgggagggtggatgcgagaggcaggaattccccatctgccgactgagtcctttcttagccagcccagctctcgccatctgctgtggtttgattgtgtcccctctaacatcaggtgttgaaactcaatggccaatgtggtggcattaagaggggcctttaagaggtgattgggccattagggctcctcctctcacgactgggagtccacagcatttggtgagctcgcccaccctggcatgagcatgtccccctctgaaggatgcagccctcaccagacaccaaacctcggtcttggacttcccagcctccagaatggttagaaagacatttcggttctttgtaaattacgcagcctgtggtattctgttacagccacactgaaggactagggctccatcatgagctgatgggtgtgggtgcagtccccccagggcctgacggcctgatcaccagttctttttgttaccaacggcaccttcccaaatgtgttcattgatttcatcgcccccataaacatgcatggatcagcacggggtgcagaagaaaggtgtatggggggaggcccaaagttcaggagaagccaggcccagtgcagccagtgggaggagtgagagcagccagcggaggcggacgtggcctgtgcatttgcatgtggggcggctggaggtatctatggtgtgaatgggggaggagcctaagggctgggtctgagccgctgctgggcctccagcctgggtctggggctcccaccccaactgccaggctcaggagttctaaggagtgcaaggcaggaacctgcagtgagccccgccccctttctggaggctccaccatggctcctcacccgccccaccctgctggtcccgggcttctgagcggagagggtggcccttgtccattgcaggcatgcaggggtgagaacggtccgaggggctcacaagggtgaactgggggccacggatgtacgctccaggctgggggctcaggcaaggccccagggggccccacagagctccctgcataaaatcaggggccagtgaagggggtcggcctctgtcccagccatatacccagaggtgcaggatgcagagtctgtagccccctctctggggtcttggtgcccctgcctcacctacacttcctctcctggtggccccagacccctggggtgggagctgacccggtgggagcaccagacggggtcgcgacactcaccccgtggccaccgccagcagcgtggagagctcaccaagggtgtgatggatgggggcgcccatcctgcaaagctgtgacaaatgtgcctcccgctcacagactctctttggaatccgctaatactccttgaaggtgaagtcccatttttcccctgcaatcacagtattaaactttaatatctgatattaataaaacatactctctctaatagagtcactcgaggccgggagggagcgcgtgcagaggatggtccctggtgactgtctgcaatgttttcccatcctggccaggtgctgggagtgctgcgatgcagagggtgggggcagagtcgaaggcgggaagctgccccactggggcttcctgtgccatcctccccaggcagcaccgaggctcccctgactcttcacagcggatgtcagacaagcaacacaggtgtctctcagatggcaggcagggtgctgctgcctccgggggaccaggtatggcccctctgcctccagtggggaaggaaacagggtccatgttttggctgaagccccttcagctaaagacccccccggaaagagggagagccctattcccctccaccgtgcaccccggcactgtgctgtagccatgcatgctgcccttttgcaggattgccagagaatcgtttgccgagactggggtgcttttgagagtgggggaagctgttcgttggctgggacagtgagtgcaaactagggccatcccgggcatcggggcttctcctcatcccatgcaactccaccccatgtctccctctgactgtgctcagggggctccctctgccaggtcttcctgcctcccagcccctcaccgcctcccctagccccgtgtccatgctacctattccctggaaccagcctcgggctctgcctcggtgtgcctgtcctgctcttcctgccctccctgtgtgtgccgcccgaaggggactgtgctgtggagtggtcagagggcgggtttgatggagaagcagtggctcctgccccaggatctgggaggtgctggggtgagcagcggtgccgtggggcccccaggagtctccgttcccactgcaggtgtgttgggttgtttcccggctctcggggcagggctgcgtcgtgtcgtatgtcgcattccaggtgtaagtcaccaatcaccctttcaaagcgtacaattcagtgatttgtttttagtacagttgatcctcattcacggattccacatttaccaatttgtctatgtgatgaaagctatgggtggtctccaaatacatactcccagtgccctgaggtcacccggacgtgtacccagtgccaagcaagcctctttctcgaggtcgatttagtacgtgtttcttgctttgtgcgtttcttgttgctgatttcgctgttgaagtggcctgagcgctgtcctgtgtggcccagggctctggggggctgaccgcactgctctgggctgcccctgagaatgcctccccggccccagggaaaatatcaggaaaaatgcctcaccccagtggcatctccgctgctccaccaaacagcctctgagggggacacctttcctccccgcttagagataaggacaccaggcatggaggggccgggccacttcccagccatcgcttcgagctaggaggacggttattgccatccttgcctcagcttttcctgggcaggccctgggccgggcctgtgcgtgcttcccccaaacgccagcgtgcccagaacagtgggtgcccaggggaagtttgtgggtacagagagtgggagggggaggtgggagccagagggagtcgggggtcggaggctgtgaggtgtttacagaacaggagtctgcagtaggggccctgccaggaagccgtggacaaagaggctttgccgggaggtgcggccacgcagggatccggagctggtacaggcagacctccttggagaacttggacatgtctccactgttccatggggtgggcagagaggagaaagggggctctgtgcactgccctcgccccgaaccagggccgacctcgccccggcagccagtgccgcctgcccccactgcagtccaccatctagtgccttctagaaacttggccttctctggctgagccagctgtgtggctggggcacaaggccccggggatcccgggttctgacagccacgatagtgggtttggacccaggtttccaggccaggtcctgggacacttgcctggttggtggggctggggcagggactgtacaatggaggagtggggggccagcccctgggagtcattagacactcaagccggaggccccctgaacccaggaggtcatctggaaaaacatcaagtggcccccactgagaatggtctcaatgcccccagtccctttaaatctcaccttaaggtttcaagcgtcgagcaggggtaatttccaagtcattgtccaaacaagagtggctcagtggtggtcccacacctggctgggcagctccccctcccacacagcggccactcggccccccagttctgctaccctataccctgctaataaaatccatatagtccctaaaaccccctcggccaggctgcccctcctgtgcccttccccaccactgccagccgcgcccctcccctagcaccctgcagcctcgccccctctctctctgcctcagacagggtctcctgaagggcagtcatggacccctggggggctccagccactttcaagtggtcttcaggcagcgtggtggtttcagaagaaaaagtgctggagcaatttggttcagatatattcactaatgtgaaatttaagattaattatgatttctgcagaaatcccattatgcaaataataactgttttcttctgaagggctgcacagcggctgtgaggcctgcgggggccgagatccatctccctgacccccggggcattatctgctaggaaactttgtcaaatataggcagggggcccttgaagcttttgcatctcttttttttttttttttttttaaagctcaggaacctccagataaaatcattttcttcccctagaacaactgcaaaatgctttttaggtttaagtggaagaattttgctgcgaaaggtagagaagtgattccactcagaattgcacagaatgggcattcacgctgcgtggctactgagaaggtcctagaacagaccacaaaggtaacagccgaggacagcgcagaggcgcccagcaccgagtctgcgtgagttggaggatcgatggcacctgcctcggccgggaggtcgagtctgtacttagaatccactacggggcagatgtgaattagtgtctggccctgggtgacttgggagtgcttcaaaaccatttgtcccattgtctcccgaaactggtgatagaagcaaggacatttcattggcttgacctcttttggggaggaccactgtgccgccaggagggcccagagcaggagggcccggaatgcagcgaacacagggattgattcacagagacaagaggccagcacagcccctcccagcccactgcagaggggaagccatgtctggaaaagcgacacaaggccttgctgtagtcaagagtatttatctttgaggcctgctgctccaaaagatggaatattcagctcttctccagatggggtaccccgtgcaatctgtgtgatgtgaggggatgaggcacgagtatttttttctgactttggtcatgttaaaaaatctgatttccataacggctgtgcctgacttgagggatttgttgaggacattgaataacctgcagctgatcctgtcagaaataaaacagcattctcttccgcccttgttagtgaaccttttaattcagtggttctcaacctttttggcacccaggacgggttttgcggaagacaatttttctatggatctggagggtgggggatggtttggggatgattcaagggcattgcatttatttggactttatttctatgatgattacattgtaatatctaatgaaataattctacaactcactgtcatgtagaatcagtgggagccctgagcttgttttcctgcaactagatggtcccgtctgtgggtaaggggagacagtgatagagcatcaggctttagattctcatgaggagtgcacaacctacatccctcgcatgcacggttcacaatagggtcctggctcctgtgagaatcgaatgccacaatgccacggctgatctgacgggaggtggggccctggtggcgatgtgagtgttgggcagtggctggaaacacagatgaagctttgctcactcacacgctgctcacctcctgctgcacggcccggttcctaacaggccatggacccatactgtggtctgggggatggggagctctgttttaatggaagcatcagtgagtgcggaaaactgccccactgtggctgaacacccttgagaaatcaccctgtggaccaggaaacagggcagccatgtccactcctggcacacttggctctcctcccaaacctactgccaccttgaccgccagggccatagcttggttttgcccctctctgaattttacataaatagaatcatgccatgtgccctcctgtgtgtctggcttctttccctcaacattacgttgctgcaatgactccgtgacaggcagagctgtgacttgtcaccttcgatacatagcatcccgtgttgtgacgatgctgcagtctatttgcctgtcctattgtcagtgggtcatgccgacctcggcaatattgctaaccatgctgccgtgaacactgcggtatgtcttttggtgaacatgcgtgcacattcccacagagtacttggctaggtgcagaattgctgggccataagttatgtgtagattcagctgtaggaagtatggatacccagtgttccagagtcacgccactttctctccctgcacgtggggtgctggagttccagttgctctgtctccccaccaacctttgcttatgtcagtctgtcattgtagcgtctctcataagtgtgtatgggtggctcgtggttttaatgtgctttccctgatgaggattgacacttcgcagtttttttttttttttttttttttttttgagatggagtctcgctctgtcgcccaggctggagtgcagtggcacgatgtcggctcactgcaacctctgcctcctgggttcaagtgattctcctgcctcagcctcctgagtagctgggactacaggtgtgtgctatcacacccggttaatttttgtatttttagtagagatggggttcaccttattggccaggctggtctcgaactcctgaccttgttatctgcctgccttagcctcccaaagtgctgctggaattacaggcgtggaccactgcatctggccgacatttagcactttttaatcaaatgcttataagataacttttgcaaaatgcctgtcggagttttttttttaaccctttttttgattatgggttgccttttgttcttgttcttactgatttgtaaaagtctggtatatatctaggaagtgagttttttaccaaatacacttgttacaagtattttgccacagtctatagtttgcctttttactttcttaatagtgccataaggtctggacttaagaaatctttgcctatcccaaagtcatacaacatttcgcctgtgttatcttctagatgttttactgctttatctttgatgtttagaatctatagcatcccaggaactgatatttagaaatggtgcgatatagggaccgaggcttatttcttccagacggatacccaagtgacttagcaccattttttgaaaagaccatcctgcccccagcttcgttctacaccaggtcgccatttattgtgggtctgtttgtgcactgatactacactggcttaattattgtagcttcatcttagaccctggcctctagtggggtaggtcctcctgtgttgctcttctcctgtagactgtctggttctcctggtcttttctttccttcttttttatttaattaaaatggagtctcgctctgttgcccaggctggcatgcagtggtgcaatctcggctcactgcaacctccgctgcctgggttcaagtgattctcctgcctcagcctccctagtagctgggattacaggtgtccgccaccacacctggctaatttttgcatttttagtagagacagggtttcaccatattggccaggctggtttcaaactcctgacctcaagtgatccacccaccttggccttccaaagtgctgggattacaggcatgagccaccgtgcccagcccagtcccaaccttttcatttcctgtacactttaaaagtgtggcttcctttcaccaataaaaacctgctggcgttttaaaactagcgttgcatggaatcactgtgttaatgtggagatgattgacatctgtccacctttgattcatgaacgagctggttcctccacttggggcctccattacttttgtaaaatgatgttttgtagttttctgtgagagaagttttgcacattttagatgcattctcaggtatttgattctttgtgtcattgtaaatgatactgttactggctgaaggtcttgctacaggtcgttcgggttcttggctttttgcacaaagagttggacaaaatgcacgaacaaagtgacaagagaatcaagcaaggaaagcacagacttatggaaacaaaagtacattccccagagtgagagtgggctcgagccaatagctcaagagcactgcttaagaatgttctggggtttcaacagcctctagaggtttctcattggttacttggttacaatctatgtaaatggagtggcccacgaccagtctgagtgattgggaccaatcagaggctgaaatgaagttacaaagttacaccgctgtgcaaatgaagagtaaggccgtgaccagtctgattggttgctggaggtgaccaatcagaggtactttccgtttttcatctgcaacgcagtggaggtggtggggacattgctaagggagtcgcctctgatcattttgttactttggtgggaagaggtgaggttttccttttgattcagttctaggaagtcagggcgaatcagccttagactccagaccctattctcctgcctcagtatcattttacttcttggttattttcttttctaaacacaattagcacaatccgcggcaacagtaaaggttctgactccagttttgcggttttcctgcagaaggtcttgaagcctcaccctcccctccctcttctgtcccaccttcctgtgagccgatgagaaggcctgggtccccctctggcggtgctggcaggaagttcaaagcctggggcccctggcctgcctgtgggaaccttcaccccagcccatccccgacctctgggacctctgggacctctgggaaggctgagtccacctcctctcccagccgcctcaagccactttcagacaaacttgggcatcagccccgctctccccagaaagcctcattgcgtgactagtaagccttgcataccctcttggggtgtgtgaatgtgtgagagtgtgtgtgagtgtgtgtgtgagagtgtgtgagtgtgtgagtgtgtgagtgtgagtgtgtgtgagtgtatcactgtgagtgtgtgtgagctagtgtgtgtgtgactgagtgtgtgtgtgagtgtgagtgtgtgtgcgtgtgtgcaaggcatcatcagtattgacatccaaaccaaattttaggaacgtgggggagtgatgtctatcttgtttcttgcagtggggtgaccacaacaccagcctagacaaatgtcattgatttttatatattgaccgtgtatccggtgaccacactgagtttacttcatcagtctgatggtttatctgtagcgtccttaagatattttacatataaaatcatgttgtccacctataataaaagttttatttcttcctttccaatcaaatgcctcttatttccttttcttggtgtgatcacactggtgaggacctcagcatgtgtgacttaaactacacaggggagctgccatctttgtctcatctctaatcttgtgggaaaccttccatgatttcaccattaggtagaatatattctccaggctttttgcaggtgcttttgatcggagtaaggaagctcccttctcttgttttcggatcgtttgttttattatcgtgaattttccctgctttcttctcatccttttctaattgagttctcctgtgttccctcccactcctctgcctgcgtgaatctgggagtgagcatccctttatattttgggcctaggggaactcactggactcaccctagtcctggccctgcctttgacgtttgtcaaagcctgatttctgtccccaaatatgataaattttggttactattccttaggtacttgaaaagagtgtgtctcctgcagttttgggggagagtgctgtgtatccgtacaatgaactgcgtgtttatgtctgcttgaattcagatgctgaaatcctaactcctaagatgacaaggttaggaggtggagacttaggagttgatgaggtcatgacggtggagcccccgagaatgaaataaatgccttataaaaggaaccccagagagctggcttgacctctttctaccccgtgaggatacaagggaggtcagccgtctgcaaccccgaagagggctctcaccagaacccaacgatgctagcatcctcatctcagagtttgtctccagaagggtgagaaacagatttctgctatgtataagccatccaatctagggccctttgttactgcagcccaaagggactaagacaatccatacatcaggtcatatttaaaatcatgttttcaaactgtctgttaatatatcctcactcacctgctgtctgttctatcagttacaggctgaggtaggtgaaaattttttcattatgatgataattctgtccatttctcccttctcaattccttccctttatgttttgaacttatattattgagtgcatatgagttttaatttatgtttcctgatggattgaccgttttaacctgtatcgtttaacctgtatcatttctcccttctcaattccttccctttatgttttgaacttatattattgagtgcatatgaattttaatgctatgtttcctgacggattgaccgttttaacctgtatcatttaacctgtatcattttaaccggtatgcactgtctcagtgatctcaagcacggcttcttgcctggaggtccgccctgcctgtcagcataccatcagcttcctttcggttattgtttacaaggcgctgattttcccatccttttattttgatttttgtatgtctttctaattaaagtgtgtcacaagcaggatgtaagtggttttcaaaaatataatctgacaatctttatcttttaattggaatatttagtactttcacatttaatataatgacaaatatttggggtttaaatctaccatccgactatctggttttctattgggttcgtctgttttttgatccacttttttcctgttttcccttgttttatctcttgtcctgttaacttgttaaatatcctatatgttattcttcttttagtcttttccctaaaaaagattaaaaacacatccttgatttattacactctaccatgattgcatactcctgtcacttccaagacaaggcaagtactttagaatattttattttaattaagtaattaatttttccctgggtcagaaatggacaatttattacacatagaaatagcagtagctagactatcagaatttctgggaagtttccctgagctctggttcccacagggtgatgggaagaaggttggatgataactgcacgcccagtgggttgcattacaggaaaactctcaggttagggaatccaaatcttttcaaatagaaagtaggcatgcttgcaatatatatatatatatttttgagacggagtcttgctctgtcgccccaagttggagtgcagtggcgcgatctcggctcactgcaagctctgcctcccaggttcgtgccattctcctgcctcagcctcccgagtagctgggactacaggcacctgccaccacacctggctaatcttttgcatttttagtagagacggggtttcactgtgttagccaggatggtctccatctcctgacctcgtgatctgccctccttggcctcccaaagtgctgggattacaggcgtgagccaccgcgcctggccgcttgcaatattttaactccattttctgctgctacctgttgtgtgactgctgtgtatacacgaattctatgtatatttaaaaccctataagacatcattattgttgtttagttgagagtcattgatatttacctacccagttactatttctgtgcacttaattttctcctaaatttcctttctgtagcctgggatcattttgttctgcaggagaattctctttaatatttatgtgtgtgtatttgtgtgtgcatgtgtgttgctgctacctcagttctctcagtttttatttgtctgcaaaatttttttttccttctcttttctttaaaccagctttattgagatataattgacatgccataacattcatgttttatgtgtacaagtcaatgaattttagtatatttacagagttgtatgactgtctccacaatctaattttaggtttccacaccctaaaaataaataagcctgcctgtaatcccagctactctggaggctgaggcaggagaatttcttgaaaccggaaggcagaggttgcagtgagctgagatcatgccactgcactccagcctgggcaacaaaagcaaaactgtctcaaaaaaaaaaaaatcactcttcatttcctcccctagccctagccagccatggatctgctctatgtctctctatatttgattttttggacattttatatcaatggaatcctgtcatatgtgttcttttgtgtctggcttctatcgctggggataatgctgttgagggtcatccatgtgctagcatgaatctgtgctttttaatggcttaataatattccactgtatgggtagacctgactttatcactcaacagttggtggtcccttgaattgtatcctctttttggcttttgtgtatgatgctgctatgaacatttttaatacaaagtttggtgtagatatgtgtttttctttctcttgggtacataactaagagaggaatggctgggtcatatgttgggctatatttaacctttaaaggaactgttggcctttatttttgaagttattctcccttgcattagaattctaagttggcagttgttgtttttagcatatttttccccagcactttatgacataccattaccttctggcttctgtcatttctgttgtgaagtcccttgtcatattattgttcctttggagggatttttcagtcctagaatttctatgtattattttttcacagatttcaattgtctggtgaaattctctactttcttaagtgcacttttgttaagcctgtctctgtaactccaatagcgggatcacctgtgggtctgcttctatcgtctgctttgctgttcctctcttggcttacctggtgtattagtttcccatggctgccataacaaatgaccacagagtggtttgaaacaccaggatcttggccgggtgtggtggctcatgcttgtaatcccagcactttgggaggccgaggcgggcagatcatgaggtcaggagatcgagaccacggtgaaaccccgtctctactaaaactagaaaaaattagccaggcatggtggcgggtgcctgtagtctcagctactcagagaggctgaggcaggacaatggcgtgaacctgggaggtagagcttgcagtgagctgagattgcattactgcactccagcctgggtgacagagagagactccatctcaaaaaaacaaaacaaaacaaaacaaaacaaaacaaaacacaggatcttaatgtctcagttgtggagaccagaagcccccagtcaaggtatgggcagggctgcactccctccagtgcctctgggggaaccctcccttgcatcttccagctgctgtggcttcaggaattccttcgtggatgaagtgactgcatcccttccgtccctgcttctgtgccacatttccttcccctcttctctgtgtgcctgtctccctctgtgcttctcagcccagtctctttgtttcttacagagcgtacatgggactgcctttagagaacccaggataagctccttctcccaagatccttgacttgatcacacctgcaaagacccttttttccaaataaggtcacattcacaggttctaggggttatgatgtggatgtatcttttttggggccagcactcagctcactgtacctataatgtaaaaagaaaattctccacattgttcagaaaacactgtagcgctctgggttgtttatctccccagaggagactttctttggttcccagcaggtggctgcaacggggccggatctccattgtccaactaagaactgagctgattccactgggtttggctcctctgaggcctggcctctctacaggctgctcttgctcctgggtggagttggagtcatcggggcagaaagcctgtggtgtttagcagggcactgcttgcttggcaggctctgaacacagtgccgtgagcttgggggtgatgctaccaggatgctctctgctgctgttggcttggattgtcagcccacaggcccttgtcacgccaaccacggaatccgttctcagactttcttccctgcacttcccttttctccaggatgtcggctggtctcgtgtcccggctgctttgctgctgctgtggttttgtgtgtccatcctagagttttcagttgtgtttgcaggaggattggtcgtatataatctactctaatatagtggaaggtaaagggcatcatcatgtataatacaattaaaattttttaaatactgaattgaaacacgcttatttctttacaaaattgaactgtggtgcaaatggaccaaccactgagagttgatcttttccctgtgcaactgatttaactgtttaagaaataagttaggtcgggcgcggtggctcacgcctgtaatctcagcactttgggaggcccaagtgggtggatcacttgaagtcaggagttcgagaccagcctggccaacatggtgaaaccctgtctctactaaaaattcaaaaattagccgggcatggtggtgcctgcctggaatcccagctactcaggagtctgaggcaggacaattgcttgaatctggaaggcggaggttgcagtgagccgagatcacaccactgcactccagcctgggcaaaagagcaagactctgtctcagaaaaaaaaaaagaagaagaagaataaataagttaacaaatcaaggccatattttaaaagttcatgtcgattctgcaacagagcatggagaaaccccttgagaacctcctaaaaccaaagaggggcttaggagttctttggcccctatctcccgagcccgatggctcacactgtgggaatgacacggggtcctgggggcctcagttcaaatcgcggctccacctcggactaaccggatggcttagctgacttccatctcagttttctcaactctgcaatgggaaaggcgataatccccacctttgggctgttgtgggaaagaaatctctacaaggcgctttgcagtgcaggatctcaacccatggtgagcctcagtgaatgtccgtgagtggtttctccataattctaggtcctttttgtgtctgaatacccaaagctaccatgcaggacaccagatgcacccaccgtctctgaggactatggcatgaaagggaatgtgcaatttaatggcaataaagtgacaagacagagaccacgtgggggcccggctcatccccccagccaggtgcaccagtcttggacacaaaccagtaatgtgtgccctgctcccgcctcccccaaggccagcagccctgcttggcctccccctcccagggggactggtgggggcttgagccatcttggcagaattcacttttctttctgtgcacccagtggcccttttcaaactggagaaaccctagtgtgaccaactcatcccagtctgctcaggactgtcctggttttacaacggaaggtcctggatcctggaaactcccttggtgctgggtagagtgtgtcagctggtcaccccgtgctgttctctttaagctcagcacacggggtgtggctggagggccacattgtctgcttgtctgcttgtctctgggcatgttccgcacgggtccgctcctgtccccggcactgcagagggaaggagggcctgtgcctggccagtgccttcctgtccttcgggcgttggcctcatgctgccaccgcggagctgcttttcgtccccccacgcctttgaggaagctcttcccagtgattctcctgccacattcggcccatttccttctagacaagtgcaagggcacggctttgcctgttcacttccttatctcccgtcttcttctgtggctgcgggctccatggtctctttcttcacccctatagccagtaaagggcttggggcagcctctgaggcggccaggcaatgtcccaggggtggggaaacgaacccctctgcctggggcagcccagggtgaggcttggcattctcatcaggagacaggagcagtgagtccttgtctgccacacggggatgaggccgaggtctgccaggtgctgccacggggccaggatgccatcctgctgccacctctgcctcgagcctcaggctgcagggggatctccacccacgcagccatctccacccacgcagccgcctccacccacgcaacaatctccacccacgcagccgccttcatccgcgcagccgcctccactcacacaaccatctctacccacacaaccatcacccacgcagctgcctccacccacacagccagccctcccctctctgcagagctgagctgctccagcagggatgaggacccaggtagggatgggtgacttgctgtcctcaccctgtgcagtcacctgagaaaggcccattcagaggctttgcttgaacactgcccaggaggtacccagagagggggtctccctggggccagtgaccagggatggggagaggacctgggaggggcagctctgggttcttggcttctctgaggacaaggtccccgtcacaggcataggctgctgagagctgattatgtgagctgccagtgtggaggccagcacccagagggttaggtcccctcactttgggtagggacagaagccaagggtttcacgttgtttaattaaaaattttagataactttcttgaggcatgctttacatatcatcaaatgcacccatcgggatgcattttagtagaatggctgttatttaaaaaaagcaaaccaggaaaacatgagtgtggatgaggatgtggagaaactggagccctgtgccctgggtgggagtgaggagttgagccccgtgccttgggtgggagtgtggaattgaaccctgtgcctgggcgggagtgtggaattgagctctgtgccctgggtgggagtgtggaactgagccctgtgccctgggtgggagtgtgaaatggaaccctgtgtcctgggcgggagtgtggaattgagccctgtgtcctgggtgggagtgtggaatggaaccctgtgtcctgggcgggagtgtggaattgagccgtgtcctgggcgggagtgtggaattgagccctgtgtcctgggtgggagtgtggaattgaaccctgtgccctgggtgggagtgtggaatggaaccctgtgccctgggcgggagtgtggaatggaaccctgtgccctgggcgggagtgtggaattgagccccgtgccctgggcgggagtgtggaatggaaccctgtgcctgggcgggagtgtggaatggaaccctgtgccctgggtgggagtgtggaatggaaccctgtgccctgggtgggagtgtggaatggagccctgtgtcctgggtgggagtgtggaatggaaccctgtgcctgggtgggagtgtggaatggagccctgtgtcctgggtgggagtgtggaattgaaccctgtgcctgggcgggagtgtggaatggaaccctgtgtcctgggcgggagtgtggaattgagccctgtgccccgggtgcgagtgtggaattgaaccctgtgcctgggtgggagtgtggaatggaaccctgtgccctgggcgggagtgtggaattgagccctatgccctgggtgcgagtgtggaattgagccctgtgccccgggtgggagtgtggaatggaaccctgtgccctgggcgggagtgtggaattgagccctgtgccctgggtgggagtgtggaatggaaccctgtgccctgggtggaagtgtggaattgagcggctgctggggaaacaacgtggcatttcccagagaattaaacagaatctccacatgacccagccattccactcccaggaacatccccaaagaactgaagcagagacttcacagacccacaccccagtgcacacatagcagcataatccccagtagccgaaaggtgagagcaaaccaaatgtccgtcaaaaggtgagggcaaaccgaatgtccgtcagcagacaaatggatcgatagcgcctggtgcagtcacccccttatctgtggcttcgcgccacagtttcagtcacgcccgctcaattgaggcccaaaaatatcaaatggaaactttcagaaataaacaactcacgagctttaaattatgcaccattctgtgcagtgtgatgaaatctcccgccatccctctgtcccgccctgcaggtgaatctgtgctgtctacactgctgcccgtgagccacttagtagccaccttggtgatccgatcgacggccatggtatcacagtgcttgctttcaaatcacccttatttgacttaaatggccccaaagcacaagtctcgatgccgacaactcagttatgcgaaagagaggccgtgaagtgcttccttgaagtgcaaaggtgaacgttctcgatttaataaggatagaacagaaactgtacgccgagcttgctgagatctgcagtaagaacaagtcttttctcaaactctcaagaaggagacagaaatttctgctagttttgttgttgcatctcaaacagcagcagttgtggccgcagagcatggcaagtgcttagagaagacggaaaagcgttccatgtgtgcgtggaggacaggagcggaagcgtgttctgggatggcatcatgtggccctggaaagcacggagcctgtagagaggcctcagcaaggcacccctgagagagtgacgcccagccgttgactcccagttgaggacagttatgcagattccaggctgcataagctccatggtggcctagctgcgtcccagtgcctgcgtcctgcgcctcactgcaactcagcacatcagcgcgggaagcaggagggggagcacctcgcagagcggcaggatattcaggagagagaaagagagaggcaggggagggaggagagaccacaatcacgtaactttctattacagtaaatggttatagttgtctttattgttagttagtgttaacctcttcctgtgcctgacctgtgaattaaacttaatcatcggtgtgtatgagaaaaaacagtatagagacgatgtggtactgcctatggtgtcgagcacccactgggggtcttggcacctatcctccaggattgggggctgctgtgtatccaaacacgggaatgttattcagtgtaaaagggaataaaatgctgacacaggctatgacatggatgcacctcgaggacattctgctcagtgaagtcagccggtcacgaaaggacaaattccgtggaattccacttacaggaggtccctagagctgtcaaatccaaagagatgggaagggaagggtgggtgcctggggctgggggagggggagcagggagtgagtgtttaatgggtgcagaggttcaggttgggaagaagaagcgttctggggtagatggtggtgacggctgcacaccaagctgaatgcgcccagtgctgcggacgtctaactgaaaaatcatgaagatggttaagttttacgctatgtgtatatttcaccacaattagaaaaggcacccaggtaaagttggataaatgttgacaaatgtgtacatccatgtaactgccactccatcaagttagagcgcattgccatgtccccagaaagttttctcccacacttgccacacaatcccccttaccctccaccccaggcaacccaagatcggattccggtcactgtggattagtttagattcttctagagttttaccaaagtggagtacaagcatgcccgctttttggtctggcttctttctctcagcataattattttgtgatgtaatcatcctgctgcatggatcaatagttctgcttttttactgctggggaaatggtctttgtatgtatccatccactgcaaggacccagacaggctatccatgacatgtatccacaggttgtttccattgcaggcacccacaagtcccatgcactctatggggagctacacatggtgtccattgcaggtacccatacgttttctccactgtatacacctccacatcgtgtccatggcggacacccacacatctcatccactgtatacacctccacatcgtgtccatggcggacacccacacatctcatccactgtatacacctccacattgtatccatggtggacacccacacatcttatccactgtatacacctccacatcgtgtccatggcggacacccacacaccttatccactgtatacacctccacatcgtatccatggcggacacccacacatcttatccactgtatacacctccacatcgtgtccaaggcggacacccacacatcttatccactggatacacctccacatcgtatccatggtggacacccacacatcttatccactgtatacacctccacatcgtgtccatggtggacacccacacatcttatccactgtatacacctccacatcatgtccatggctgacacccacacatcttatccactgtatacatctccacatcgtgtccatggcggacacccacacatcttatccactggatacacctccacatcgtatccatggtggacacccacacatcttatccactgtatacacctccacatcgtatccatggcggacacccacacatcttatccactgtatacacctccacatcgtgtccatggcggacacccacacatcttatccactgtatacacctccacatcgtgtccatggcggacacccacacatcttatccactggatacacctccacattgtgtccatggcggacacccacacatcttatccactggatacacctccacatcgtatccatggcggacacccacacatcttatccactggatacacctccacatcgtgtccatggcggacacccacacatcttatccactggatacacctccacatcgtgtccatggcggacacccacacatcttatccactggatacacctccacatcgtgtccgtggcggacacccacacatcttatccactgtagacacctccacattgtgtccgttgcgtgtatctattgtatggtgaaccacaggccatttatttattagccttttggtgtagttttgcgtgatttccagtgtggggctacaatgaataccatcgctttgaacattcacctacaggttgttgggtggacacatgctttcatttcttgggtaaatacccaggagtggaatggttgggtcctatggtataagtgtaggtttaacctcaagggaactgcgaaatgattttctgaaatggctgtgccgtgggacactgagttccagttgttccacaaccttgcagcacttggcattgtcaattgttttcattttagccatcctgaaggtttcacgttcatgttccttttcttctgctttaaaattttgtttaggttcaggcatgatggctcacgcctgtaatcccagcactttgggaggctgaggtggaaggattgcttgagcccaggagtttgagaccagcctggcaatgcaatgagaccccatctctacaaaaattagctgagtgtggtggtgcacacttgtctcagctactcaggtagctgtggtgggaggattgcttgagcctgggagttcaaggctgcagtgagccaaaatcaaaccaccgcactccagactgggtgacagagcaagtaaaaaaaaattttttaaacttctcagctggcaaataaaaatcatgtatcattattgtgtgcaacacgtatacactgtagagcagctgtgattttcttttcttttctgcctttgaccacgatctctgtggcctcctgctcatcttcacttggcctcccctgcctgccccgcccagccaggaaggagtctgagttgaggcggtggctggtgtttgctgtgtccagctccgtgccatgagcctgggtgctgcagacatagcctgtgtagggcatctggtcctgtgtcagaggctcactcccgtccggagctgagactcacatgcatgaggctgactcctgggacctgagaccagcaccgcctcctgccaggggcccccagacactgcctaggggaggcaggcatgcagcagagactagaaagctggaagatggtagatggtctggcaggtgacggggaggggagagccttcagaggggtgcaaggtgcacgtcctgccccaggcccaggctggccagggccacgggatgttcccttatctcgtcctcacctggcccaggtgggagttacagctccgtgatacagaagataaagccaggcttggagctgtgttgatgtaagccccatgggcctccatgaaggagatgctataggaggggaaagaacggtgaagccagcttaagggtccagggcccagctgggcagcccagcgggtgccaggggacgcggagtgaggaggaggggcagcgtcctaatgcgccgtcacctcagcctgggtgtcctcctagtcacaggggcagccctgcccacggtttcacagcttggcctggaagccagagctctgtgccctgctctggtggacggaggtgtgaggggcatctaggggagcatgggggcgtcccactccacgcagtctcggttgggtggagtttcttgtgagtagttctttctgctctgtgggctcttctgaaaaaagcgggggtgccggccagcgtgcacaggtaggatggaggtggatggggatttatgcacctctagctctaagtctccaactcagtctgcaagccacaggtcagggtcaagaaatggcggagccttgctccaggccctgcaaggtgatgggcagacggcagacaccagtctaaacactcaggggctcccgacggctccccaggcactcccttgcctctgggagcacccacggtgtgcagggcactgggtgctctcgggaaccaaggcccaggtatgcatgaggtcgggaccccagggactgaggcagctcccggttcacagaggacaccaggcttccagccacatgcctagtgagcagccccggtggacacggggacagtgagggcctcctgtccttactgtggccaagtttcaccacctttgaaattgctcggagtctggcatctggggtggggagctggtcagtgcggggggactggggggcttgtctctgcgtgccctggctccccctcccggagggccctgtcagaggcccaccgcgttgtttctcttctgtcaccccagaggtggggaattgtctttaagcaactgctttcattcagtgataattatcgcagtttctctttttaaaaagtttaatcagagacatccccggatgccatctgaggtctgatcaacctcggtcaccagcgtgcccacattggcggcagcgggattccagcccggagcacggaaacttgacgttctcgacagcctggaaatgtaggatttccgttcggcttgttgtaacactgagcccagctccagggaccctgtctccctcttcgcaggctcccatggggggctgggggagccaggcgggctcggcagcgggtgctgcgctctgtggggctgccccgctccccaactgttcttctctgcccctccaggaagcttccagaatcctcctcaactctctgccctgcaggttgcaagcaggggagcccggccccgggccagccctcctccgcctccccctccactcagggagcgcacgggttctgcgctatcttgccctctgtcgccttgtgcgaaatgtaatccacaaaatgccttcgtggtaaccttatccctgggcagcccgcgatagcatctcgcggccccgtgacaggcaggaactcgcaagcatggagttaataatgcagactttcaaaaaccgaggctggcagagggaggcgagggcgggaatgaaagggccggtgtggctgtaattgggaccatgtgaacttcctcggaggaggattaggaggagagacaggccttgcccgcgaagattagtttcaattagacgggctggaggcgaaaggccggctcggcgaaagattaaaacaagaaggagaacgtttccgcggcgcaggctccgggcctgcagcaggggccggcaggacccactaatggaaggcagagcgtgcccgcgttcgcaagactcggctaattgattcgacgctggctttgcttcgtcttcccctgctcacccgcgccccgtgcacttttcagatactcatttgtgcttgaaaccactttggaggggggccctgccccggctgtgcctgcaggtcaggggagagctgggcagggtgggggcagccccgccagacactggcccggccacttgggttcccattcttggccacaggccatggtgggaccgactgcagtgctgagatttctgcagccttggccggtcgtgcgcagccgtgacctcgggaggctttgctgggatcttcaaaggggctttcaaattgcaggtctgggtgtgcccccactccctcctggggccaagcctatgtctttcctccctccttccttccttcctggactctggcctctgtaactttgagaatagttttcttaagcaaaaactgtgaagacaaatgcctgcaagttggatgtttccatgagcgggcagtcgcttctgaatttctgggtcgggccggtggctggcaccccttggaggtcagaagtagcttaaacaccagggctaagggctggggatggggactggctgggccacagtcctcagtcagaggcctcacgcagaggccagtccctccctccctccgcctccccttctctccttcttttcttccttcgaccgagaccgggctaggggtcgggggcccctccgtctcagaacctcccttcttctctttccatttccgtgggaggtcagggagtgagatccctagcccactccaggggaggcaggggcacagagaggtgcgtggagcctgacacgccagcctgacctcctgcttagctccccagctgcggccgatgctgcaggagctgccggatccttgggcctcgaattcctcatctgtgacgtggaggtggagcctggagctgcccagtggatgctgttgctcctgtacctgagacaggcgggagggctggtccccgctcatgggccactgtcttgtcctgcacccaggcccaagctcagagccccggggaggtctgtgtgctgcagtggactccatgcatgaggtcggggggcagcactgtgtcctgatctgggagccagaggccagtgcccgggtgtggctgagcacctgtgcctgcgtctcacaggcagaaccagctgcctcccggcctcctccgctgcttccctccaggccctccaagcacgaggttgtgtgtgtgtgtgttttatcaatccttcccattgtaatgacagctaaattatggaaaatgcattttcacagctggtgagaaaaaccattagcattaatcaaggatccaggctcattggggattcataggccgagttttgttggtaaagtcacggacgtgctgaacagtcgttagtggggttcactggaaatggggccgatcatttctcttcacgccgtgcttcctaccaagggacacctccttgcctggggtccagggctgagctcagtgctgggcccctggtggtcactgcaaccctcaccctgtgctcaggtggagcctctgcttttcagggacccacccacagccaagggcccctttgtatcaggggcaggggatgccgtcttggtgacatcgtggggctggcttggttgtggtaaggacgggaggccctcactgtcccggtgtccactggggctgctcgctgggcaagtagccgggagcctggtgtcctctgtgaaccgggggctgcctcagtccctgaggtcccgacctcatgcatgtctgggccgtggttcccgagagcacccagtgccctgcacaccgtgggtgctctgagatgcaagcgagtgcctcgggagccggtgggaccccagtgagtatctagattttgagcgctgactgcattaaagtgatttttaacataaatgtttattttggaagaattttggatgaacagagaagcaataaagggctagtatagagagtccccacagccccttttttaggattttttccaaaaccccacaaccccaggctagacacgagaaacacatccgacaaacccaggctggtggcttctccaggaccctggcctcctcccgaagacagtcctcctgcccccatccaggctccctttgctcacaccctgtgcccacgggtggagatgccgccagggcacactgcacaccctctgctccgggcgctctctggaattcaccagtttccacatcaaccatcaggaagtgcctaggaggacacaggctgtgcctgtgcctggtgtggctccccaccacccggacccccacccctctagttccacaacaggggtttgctcccagtcctggctggcctgccccgcagaatctcccatcacactggcctctctcacccaatccatccctgagggttcagtttaaacccccacctgcagcgtccccactggctccctgaccccaagagtctcgccccccttagcacccaaatctgtgcttttgtccccaactctctcagggcatgaacaagtctctcccatacccctgttaaaaatcaccctgccaactatggatatgtgtgcctgcaagggttggtatacacatggctgtgtgcgcaggtacatgtacctacacacatgtgcacaggtatgcacagacacgtacacacatgtaacctgtgcacacatatatgttataccagcccacgcatacagatattggtatatttgtatacacacgcatgctgacctgtcagtacacagggtagtgtacatacgtatgcacaccccggttgatatgcacccatgttttacgtcgctgtatctgctgagaggcccagcggggacgccccagtggccatgcacacgccctgcacccagatcccatttctaacaccgtccccagtgaaggggccggagatctgcagagaagggatgggttctaggacaggacagggaaaattcaagatgagcctgtggcaccttgtggtgccaggaaatgaggaagagtttgagaaacaaagcgatggggcatagatggccaaggaatgcaggagctgacctggaggagctcctgatggccacagctggaagaaggtgatccacaaaaaggcgcagcattgggttatagctccagggatgaaaaaatacccacctgttcatgcgccataaagtaaatggaggaaggaagggagggaggggaaggagggaggaaaggaggaaggaaggaaggaaggagaggaagaaaggaagggaggcaagaaggaaggaagcagggaggaaggaaggaggaaggaggaaggaaggaagaaaggaagaaggaaagaggaaggaagaaaagaggaaagaaagggaggaaaggaaggaaggaggaaggaaggagaaagggaggaggaaggaaggaaaaaaggaggaaaaaagaaggaaggagaaagaaggagggggaaggaggaagacaagagggaggaaggagggaggaaagagggaggaagaggaaggaaggagggaggaaggagggaggaagaggaaggaaggagggaggaaggagggaggaagaggaaggaaggagggagggaggacagaggtaggaaagaaggaaggaggggtaggaggaagaaggcacagatgtttcttgttgaacccacaggtgcaggtactcccccgtggaagtgcaccttagcccccaccaccgcccccagtcactccaggggtgacccctggccgactccaccttagccaggcccactcactgtggctgcatcctcaggtgggtgctgttcccacccacgtcacagacgggacagctcagggagtcctgagacaggctgcctgcctggggtcattgaagccatttctgacccctgggctctggcctcaaggcttggaggacagtttttttcccatttaaaccttgactgtaaagacctgtgacctggaagttctctgtggtggggcagctgcctgtggactccagccacctctagagtcatggttggtgccccctggagtcaggaatggcctagactcggcaaacaggatgggccagagtcgggggccccatgcagggtcctggctcagcccctgctcctgggtgacgttggacagccgctggaggtctcagcctctgtctcttcatccataaggtggaatgacagctgcacttgccccgagacactacggggttgccagggctcaggggtcaggcgttggcagagcactgggtcccgtgtatcagggccctgaggaagggtgacaaaactttctcatgctccgcatcacgataaccagctcagtgtgaatggagtgaaggcttttgccacctctgctactggggcctccacaaggctgatttctgccgtccacaccatctggcccaggaaggcccctaagaagtggtgtccacgcctctttgaccctcacccacatactagagatgggggtctttggacctccaaaaaggcacctgactgctccccggtctctgccccagccctagccgggggccaaaggggagaccatgccacacacagagaggtctgcaagcttcaggggaccccgcagggctggcaggataccctctgctaaaaccgcctggttggcgctctcccggaattcctcttcctggcggtcaggccgggacagtcgggaggaggtggctgaagggctcttgccatcggcaaccatttgttcctggtgagccccaccaaggccgggcgcctggctcagcatccatgtggacaccccggagtgcgatcatccgtggtgggcgagcctcctcccggtgacatcccgggagaggccaccaccctcccattgtcggtggccaaagagtgtatcctgagggttttgcttcttcctcactgatcttctaaaaattaagcaaaaccaaacgcagcaacacgtcaccggggctttccccgtgctggggacaccgccgacagccaaggtcttgccccatccctgggccgtcagcaaacctggcttccctttgcctctgtgctgcttccctctggcctgaagacctgggggccgccatgcttgtcgcccgggctgtttccctcccctccaggacacttgggaacaggtggattcagaggctgagccagggccccgtctccccaggcagctggcagaagggagtctctggggtcagagaagcctcctccctgccttggtggggccgactctgtggttgcattgaggagtggtcagcggggcgtggggggctggtgggaggcccaggagctgcaatgagaacccacacctggggcaggactctctgaggagagcaaaccaggagggacacagggcgtggggggcggggagcactcaccagggaagcccttcagtcccaggcacagtctctttggaggggtttcctgaaagaccggcctgtgtggtcccagccttgcactcacagacatgccttgggcattgagaacgccccactcttctgggagccgcgcccaggccccagcaggctccttctcagggcagaaacggtcacttgctgtgggttctgtctctggggggccctccttgggccaaacacatctggctttttcctaaagtcagcaccgccagagccgggccaagttaggaactgccccgtccctcaagggagctggcagaagggagcctctggggtcagagaagcctcctgctttggtggggtcatggagagcctgttcacctggccctgggccattccagagcccttggcacagcctctgcaagggagcagctcacctggtcaaccagagaccagcatctctgccctgcaggcgggccctgtcctcagacctgccacgtaccactctccctgcgaaaagcctgttggagctggggagggtggcagagagggtggccccaatgaaaacccacccgtgccaaaccagacccttccttgctccttggaggacagtttttttccaattaaaacctcagatccaggaaggggaactgagcctcccgcctgcggcccccaggaggagctccttgctcaggaggtgcccggacctggagcgtggagccaggatgcctctggcatctgggcactgggccggagggtgggataacccagcctgcagacagacctgctcccgggctacggtcgccagtgcatatggactccgtttgccctctgaggctggcagtgactcgactgaacgcagcccagtctctgaagggcggtggcgctgatttctttatgaggtggaagcgagagtccccctctggattcacacacctggaggcgtctgagtgactcctcgggtcccagagcccggtgagcactggcacatgggagggtcacagcactgcatctgagtgagctggaccggaagcctgtgtcatctgttaaatttagtgtgagcatccaagggaggctgatcagggtttcagagattctgctcactgggggctgaacgaaccgtcaggctctgagctgcaaacttgcagaagggcactcaggtcgtgatcaatttgttagcgatagccgccataaatacttgattccccatctggctggacagctccgagggcgctgacgttaactaattgcccgtggtgggagctgttgccggacggcgcccccgcctcctcacacctgccgcgcttcctggatagggtgatagggatcggcctccatccacggccccacaaggtacttcccagcagatggggagaccaaggctcttgggggtggttttatgtcagactcgggtccactgaacctttttgggtcacaagagggggtcaccaataaaggggccgctgggtcccagaagtctctggaggtaaagccctcagcacttccctgggggaacagcaagctgacccctggcagctggaaacactcagccaacctcttccagggacccccagtgaccactcacccacccccagacaccgagagatttaaggggagtccgagatgctggcttccaaccaggagagggcacctccccgtcatcgggagcccagcccagatacgccacacctgggcgagctggggggtctgtccctggggcaactccaacctcccagcttctccgtggccctcagtattgctgggaaatgaaggcttgaaagcagcggagaggccagaaaccccgccccgaggggcctcagtcgcctgctccagggagaaccaggagaggacagagtgcatctgatctggggctgctggccatggggggtgctggccatggggggtgctggtcataggggctgctggccatggggggtcctggccatggggagtgctagccacggacgggtggtggccacggggggtggtggccatagggggtgctggccatgggagggtgctgggcactagagggctgctggccatgaggggtcctggccatgtggggtcctggccatggggagtgctggccacgggggggtggtggctatggtgggtgctggccaccgtaggggcactggcggccaagggggcgagccgaggcctcagccaggccacattcaccccaaatcccacatcccatgaggaggtgccgtgaggcattcctgagcgaggaccctgcttccttcagtcccttagccttgggggaggggtccctggggaagccaggcccagctgcagatgcggggtaccctcaggctgggtgggatcgaagaaggccacaccacatgccggctgcatccagaagccccagtccatgtgggggtctgagaaggaaatgctgactttgaagggcacaagtattaggagctgcaggtccggggccaccccgtggtgtcctggtgccagtgggacggcccctcgacagcttagttgggctctactcaggtgggcgaagcccctggggtctcttcctgaccccccacccccaactccctccgggcagggccggctctgggggcggctgactccagcctctgcttctccgaattaagacggatggcggcttctctaagaaaggaaatgtatatcaacaaacttccatcccggagatcaaaccgcttcctcccgccctccccaagcacctcccgtgctgccccccctcgccaccccaccccccagtcctgctggccttccctggccccatgtgccggctcaggggacctcaggaggggtggtgggggtgcgtgtgaggtgagctgggctggccagagcagggccaaggggccactctgcactttcaaatatcattagagtcagcgggctcccggcaagcgccagaggagccctgggggagcccctgtccatggcttcccagtgcaccaggtcaaggccgtttccatcaggggcatctgaaaatccctccccaggaaatgcctggccaggagggactggaattccgagctcctgtcctcaggaactgatggtctttttgggattggcattagccccgggtgacatcgcctccggcagcgagcgggtggtgggggggattgggggctacagcgtggctggcagcctcctccattgcccctcaccctggggggagccaccagctctcagagcagttggtatccctggccagcagcactgtttaaaaaagccagagagtgtggcgtggggaagacccagcacccacccggcctgtgaaccgctccaaccacttttcagagacggctgctgttgtgcggggctccccaggcagctggggtgggggcaccagcaggggctctgatggggcatcctggagggcggagctggcgtcggggctgacgtgcgcccagtcacgccttgtcttagggctccctggggaggtgccagtgcttggcaggacagaccctccgtgcgccctctctgatggccgctcccctcgagactcagagccccatgagactgtggggaggacaccggggggagaagcgtggacctcctgggaagctggagtaacatacccgagccaggccggtgggctccatgggccaagagacccccacaaagcctcctctgcctgcacctctgctagggctcccggaggcagagccggatccagctcccaggataatgtgcgggggcatcatgtggctcagacccccctggagcttgtgttcagagggcaaggtgctcctgggtccacactgtcacacaggtgggggtcttgcagctcccctctgagaggctctggcctggcagggttgaggggtccctgactgaggaccaggaagaacggggaccgtggactcgcctctgaccagcgctggtgggcagctgtgtccacagaagcctccgcaggaggatttctcacagcccagccccagccgtgagagagccgaggcctcaaggacaggtgacggtccaggacccagggccagtgccagccaagccttcaagccagctgtgcctgccctgcactggttgcactttccaagcaagggaggtggaggtgcaactgtgctctgaggatgagcaaggatgagagagacccagagacagagacagagagttgaaaggagggaggggaggatgccgtagagatggaggttctgagacctcactcagggcattggcctaggtgctggggttctcctggcagctctgggtctgagaccctggacgaggctggcctagagaggcagctactgcagaaaggcgaactcctgggaatctggctgcccaggggcctgagaggtgaggtgggcgactatccagaggcctcatcctgtcccttcctgccggggcctcagtccggccgtctggtgctgtgcaggatggggctggctctgaaacagtgatcaccgcgccagccacggggcagcctctggtggaacccagggttccctgcaagccagggtgtgccagaggctctgggatcaactggtttcaggcccacgtgctctgagggacctgcatctcactgcataggatacttgggtcctggaaggtgaagcacctcctgagacccccgccccagctgggcagcctctgagcgtccgcaccctatcccaccacgcggtgacatggaagggccctgcgtgctggctggacacactccctgacctgcaggggccccaatacccagcactcactcacacccgttcccatcctgcagcctggcacccagagagatgggcttgcggccctgtgcagagggaagacagtggctcagggacaccagccacatgccaggggatggttctggccgagtgggggcccctccatgggggggcttggagcaccccccatctgcttggccaaggctgcctgcctgaaggttgacggattagctcagcagccctgcccggccagggtcctcgccccttcctacgctgggaagaggcggcaagctgtgtttatttagactccctcaagctgacagcttgaatcaggctaatttacctgaagtacaccaaccgtctctctatttattttacgatatttcaccagcgtaacccaatccccacccctcaccgcctgtttaccgtggcccaggacagcgcatctgtccctcatagccctcggctgctgccctgcctttcaaggatggcaaagacgtttccgaacggggtcgcccgggggcaggctgggcttgaggacagctgggcggcacccggagccttcgggactcagggtgtggagttggggtgtgcagtacgtgcccacaggctgggtgaggcctcagggtgaatggccggagggggccttgcacctgcacgaggattctggcctcacctgggcagggggaggagctgctggcgccagcccagcaaggaagcaaggagggccactttgaccccagggcggcacatgccgtctactcaggttccctcacgctcggcccggacagaaccattgacccactttgcagaaaggaaagacctggacctggagtcactcacccagccggcatcaggaaggcccggctgctcccaggatcgtgctgcccaggctcagggcatgggccaggcaggctggacaagttaccccagggacagggctggggctgctggaggcagagaacaccctggcccagcgaaagaatccacaagccagccaagagaaggccgtgccttctgtcctaggaacaactcgacagaggcagagaccacgcacacagagatggttttggctattaatcctgacagagaagaagcaggaatggctgtgtgcccacctgagggaaacgcttgctgagcctgctgtgtccagggctcgggcatcaagcaggactccaggggccacccagaggccatgctgctgcgcggactgggtgttggctcagcgtttgacaaacacctctgagagtgggctctgtgctggtgccagtcctggtccgagggtgcggccaccaaggaaagcccctgccccagctgcgtgggagctgcccggccaggctaaccacaaactcgcaaaagacaagtggacaaatacctttgagaggaggttggagaaagcaaaactgaaatacaggggcccagatgaagggtgttccgtgggcagttaggaagggcttcctggaggaggtgaattggtgctgaggttggaatgctgaggctgagcctccacaggaggtctgggcaggagtcctgggcagagaggagcctgtacaaaggctctggggtggagctaatcctgagcatgggtggctggagtgaccagagctccgaggcttgtgggaggtgaggccacgaggacctggtgctcacagagccgggggaacatggaccagcccagctctcccagtgccctccaagcccggcagggaggaagcgcatcagtgatgtcatcatcatcctgttcaggatgctggggttacgggcaattgtaaattagatttctacaccatccaaagtgcctccaggacgttttcttttccctgaagtgttaacaacagacaaactctagagttgctgctcccctctgccctggatccgtggcctgacagggtggctgctctgcagcggttggtcacctgcagggggaaggggcccagcctgcccgtggggtcccctggcctccctccagcccctcactcccctaagccccagcctcctggccagggggaaggcagcctcctctttctcacaccctgggtgcctcaagggggcagtgctcaccccaagctagggcttgtggcccccggccctgggggctgatttggaggtgagagcgcctcagtgcctctcagatcccaagaaggagggccagtggcctccaccatcccggcctgcagccccagggccacctatggctgctgcctgcctgggcatcgtacggaggccaagggttcaggggcctttgcctcttcccctgcaagaacgtgagcgagccattccctgatgtggggcaggggcggcgaggggaggggaggtggagccaggctgggccaggcaggcaggcaccaggggtcagtgggagggtgggccggcccggggggatgctgtcgcccgtctgcagtgccagctcttctcctgcacgctccctcccgggacgggccatggccttgctgggccatacgtctctgtcaaaatctctatgaataaattaacctttttaaagattagtgctctctaatacctcagggttttttaaacacagcaaatgctacaaatattttgccgagcatggctggcgtgcagggctgccgtcggcaaaggccccacccagcgtccctccatgggccggccctgccagctggacctccacccaggctgccctgacactccaggagcaggttccggcccccatgggggagcagcatcgccctgtggggcggaaagttgagggcgtccaccccacaggaggcaggagggcgtggctgtgcccacgggcagagagtccgttgctgctggcctcttcctctgagtctttgtgcacaagatgggccgggcagtcacagtccctggagctgtccacgaagccacctgactcctggggtcagatgggggctggcacttctgtcacccacctcggtggccttcctcttgtcagccaggggtggaggcagtgtgaaggcggggcggggggttttacagtcaggggctgcggcttctctccagtggttgaggaaggggggcgacccaggcaggggtttgaggtgcaggaaggcaggaagttgagaaacactggcttttgggggccgtcgaggtgggggactctgtgtgtggacagagggcgtcggtgagctcagagggtgggggtctctgggcagggagagaacaggctgcaggggctgctccctggggtgcccggctgcaggtggaggagtggggctcttgtcctgagcccaagggagccactgaaggctgtgaaggaagaggtgatgtcacagagctgggacaaggcccccagagagcaggatggagtggggtgtgtgtgggctattccaacaggcccggtgaggccatgaggccagagtgggagcactgaggggaagggaaggggcccagacccccgagccctcttctcaggacaaagtcaccctctgacccactccaaggtggtcagctccccgagggctgggcttggccacggctggtccccagctcccagagcctggcctggcacgggcaggagctgaagagctcacacctggggggatgtgggtccacatgtgccctggagccccggcctccctctggcctaaatcggctcactttcctgggagcgggggtgactccccgcagcgtcccaagttcccagggctccccacaggccccaaggacgcagtgttatcttcactgctcaggggacccaggagggagctaccagccgggacctcacctgccacgagcctcccctcatcggtgtcggttcagaactgtccagctctccctgcaggagcaggcagcctgcgacccccgccccaaggcccttgcaccaggcgagggtcctctgtcaggtgggggctccaaggagctgtggcgggtgtggggtcttctcctcgctcccaagttttgtatccagccctggcccatgaggggcagctggggtccctcccttgtgcctgctgtgtgcccggcaccgggaggagagctggcccctgccctgccagtgtgcagaccccagagggaagaggaggatgaagggccttgggaacaggactgggcagacggggatcctaagccttccttagagtgtgcgaagcctcaggctctctgttgaggagcgtttgctgcttcatttcaacaaataccctttgtgcatccactgtgcaccaggctccagctctgtcccctcctgggacatcctcgctgtggcccccgtagaaggggaagccaggctcctgccctcacttgctgggaggcagcagggcctggctcaactcctggcatctccacccagtgcagcccccggggccagccctccctgggtatttgggtcttccagatgctgactgtcctcttccctacctccccactcttttgcctccacttaaatgcctcttcctccaggaagcctgccctgatccccatggctgagtttgaccccccaccccaccatcattcctggtcaaggcacctggccctgcgtggtcactggatgatttcacatgtcacattctcccctgagagctgtgggtgctgagagttccaggccaccagtcacgaggatggagacggacgggggagttacacagggtgggaggggagctgggctctcccttgaccaggcaaggtggggcatgtggaggagaggacagccccttgcctggaagtagacaggctccctggggtgtgtgtccggctagggtgagtgagaggagccggcctgtcaccacctggtatcatcaccacctccatgacccagccctgcccagaaggcccagagccctgaacccagctggcatccaatggcagtaggtcagcccaccctgagggtgtggacgtcctgctggccagagcctgtcttagcagcctgcctggagacagggcctccctagactccctgggggcccaggcattctggccttctgaggctgttctagacatcatgggttgcagaatcttgaggggtcaaatggccccactgccagggtctgcctggagaccccaacaggggccccaaggcggtaagcctcagagagctctaacaaaatcgagtccagcagcctcccctagtgatggattactgtgccctgagccaaattcctggggcaaggacttggtgagaatgaagtttgtgaagtggaagctagacaaggaaactgagccttcacgaagctaggtggctgggccagggtcaccctgctagccaacaacgtcagggctgggctcaaaggcaggcacctggccctgggctggaatcccctccatggcctagtggggaggtgaactgagacaggaagggcaaattcagattgagtttcatcccagggcactggcccagccccagcccaactattcttccatctcgtggtgcagccttggatgacccagctatccctctgcctcatggtgcagccttggacagcccagctatccttctgcctcgtggtgcagccttggatagccaagctatccttctgcctcatggtgcagccttggactgcccagttatccttccgcctcatggtgcaggcttggatggcccagctatccttccacctcatggtgcagccttggattgcccagctcctctggctgtacttcctccccacacagaggaaagctcaggctgaggtcaggccgggaagagttttggagcacacttcgtcttttgcagtcttcgcttcccacctctcacagcctcttcatattttcctctcactaaactaaacactccaaagctggaaggggctactagaacattccttctaaggggtggtgaagggacctggggggtgagctgatatgagaaagagccctcaatttaccactttgtgactcatccctgacaaagtccccaagggctttgggcaccagccgggcagcttggctggtcagggctgggcctctgcagcacctctcagaagcctcctgtcctgaacatgcttttccggagggagtcccttggtttggtcactctccagggcttctctgtgtggcttggaggggcctgggaggactggcctaggcagctgggtaggagcccccctttcttctctgcatgtcccaggggccttctggggatgaggaccggggagccaggcagaaatggggttacggcagagcattttctggtgggtcctccccgtgaggcctcaggtgaagctggcactgcccagacacctccgagactcatccctgcccctgagctccaagtcagggaccaggacctgggcccccagcatggcttcccttaggccagggcatgactgtccccagcctctctctctctgagttgaggggtgcccagccactgcttcccactttcttaattgcagcttatccctctggcaggggtgcgggaggggcagcatgagccaaatgtccaccttcagccaggggtgacagcgtgtggagggtgtgaaacctggcctgtctgagtgtttgctgtaggagggctcctgtgtcccctggcccccaggcactggggctgaccctctgcttttccaagtgctcctcagagcctaggaaaaggcacctgttacccgcccatgccctattagtataagctccatttattacagctgcaagctctccccagcctgccaacctgaggatttttttttttttgatgtagttttgctctgtcacccaggctggagtgcagtggtgcaatcttggattactgcaaccatcgccttctgagttgaagttattctcctgcctcggcctcacgagtacctgggattacaggcatgcaccaccacgcccagctaattttttgtatttttagtagagatggggtttcaccatgttggtcaagctggtcttgaactcctgacctcaggtgatgcacccaccttggcctcccaaagtgctgggattacaggcgtgagccactgcgcctggccagatttttcttttccctttctttctttctttctttctctttctttctttctttctttctttctttctttctttctttctttctttctttctttctttctttctttctctttctttctttctttctttctttttttctctctctctctttctttttctttcttttcttttcttctctttctttcttctctttctttctttttgcctaaaaaatgtggagccctaaactgcagcgttatttacaagatgaagtgaaactaaggaatgtggcttccaggctgtggctctgtcctggatatcggctcaggagacccttcctcctccccaactccctgggcctggattcctctgagggctgtgctgctgtcctggggttggagtctctctctctctgtctcctggaggtgccctgaggcgatgctttaaggttcctctgtcctagggcgattgttggcgtaggtttaatctctgctctctcttccagttctgccccctcaaggaagccctcctgaagaccctgcggctccaccagaccctcctcctctctgagtccctggatggatcccggggggtttccgaattctcccctgggtgagtcgaccccttccacttgccctctgaggctgtccgggcctggaagacagagacggccactcctcaggtccccccagcctccgcccaggcctgggacaggcagccactggggagagaggtgagactgtgatggctcacgggcagctactgggcaaaaccacgacgatggcaatgatggcaacaatggtgatgatggtgacggtgacaggaattgctcccctggggtgcccgcagtggccccgcacctgcctctccctgtttaatcctgtagtggctgctggacatgggttctctctcctcatcctatggtctcagacaaggacgcagaggtgttgggaggcactgctgtctgtccagcctgcctctggaaagtctagctggaggcggtgccggaaggttgggcaggggtagccgtggggcagaaggaggcctggtgaaaacacaaaatgtgaacagcaaggtggcttcagcgcatgggtttgcttaagtctcagagtcaggagcggccagccagggcaggcaggggcccatcccagcattacctggcctccctgagtggcttggttggggggcaaccatggctctgagctggggtgatgcaggattgggggtctgtgtggaaagggggcacccgatgctcgttaaacgaagccttcctcatgcgacagaggcagcggcacgtttcacccaatgctattattaaaaatgcaaccagtgcttttgtatggagaacaacccacctgctggtcagcctttgccccacaccctctggcagaagcatagtctgtgccaggaactagggagggctgggagtgacggcggtgaggtcctgaagaaaataaaagggaaaaacacaggtcctgtcccagaatatcttggagtaggaaggaggggccagggttgaagggctgttaagccaggaggacttcttggaagaggcggtatttcactcaagagcagtctagcatttccctcctaccgtctcaggtgtaatttcctttcactgggaaatataaaaccccaacgtaaggcaggcggacccttctctaccctggtgggcaaaattcagaggggtctaggggaggatggtcagcccccaggtcagagtctacaggacacggcccctgtgggtgtgcatgtgagccatgtgggtgctgggtggggcagagagaggcccggggcacttagttctctgttgggtgacgtcatggtttcagctctgccagctgggcttggagtggccagtgggctgcaggcatcagctggccgacgtctgcgtcctgcagacacaacattagagagagggggaagggggagttctggcacttcagagacccccgaggactctctatcactcctgtttgcagggtggaggggaagggctggccttgcaggaagcctgggggagggtgcgtccggctggctctgccagatcgtccctggctgggccacccaggcaggacggcacctcccgggccagctggctcctgtccatcctcggtttccctccctccgccccacatcatggcgcagaaagtggggcaggcgctgggctctgtggtgctgtgtctggggtgaagaccctctagaaggaggggcagggtggggctcacggggctcctgtcacccagccccacccgtgacccacacagacgcatggcagatctcacaaaaggtgactccacaggctttggaccaaatcccaaatttgcttccaagagcctctgttgatagagccgggctcctctctggggtcggtcaggcctccatacacctcgagagtttacaactctatcgctaaatcgaaagttggccttggttttaattccaagggcaaaccacatactgtggggggaatcccgggaatgcgttttagggcgattgccagcgaatgtgtttccagggctccccacccctagagacggcctgggtgggtccaggagcccctggaggatgggctttctagaactctccgccccaaggtgttccggcaggttccctcacaccagtgcttgtcacctctgtgcagccgtgtgggttatgggttggcatctgtctcgtagctgcagcttttgggggcttttgcaggacccaagaccctgcttcctctttctgtttgaatggagccgcctggtggcctggcctggggtgctcttggtcctgtggtctggaggacgaggggctccttgaggcctggggtcccatccataggatgatgtcacaaacccactcccgtttcccggtgtggggccgggccccaggttagcgtgctcagctgaggaggggccaaggaagctcaggagccccatcagcctctcttaggtcttccccgctttctgggcctcccagtgggtcctggacactgtatcagtgctctgtgctggactcctctctccccggggctctccaggcactcttccagctgccgtgggcaggggtggccgctgggagacagaacgtggccacagaggcctgggctgagtggctagcctggcctggaagccgagggtgccctggcccctgccctgctccgggccccgctcatgggaagggtcctcagaccctcgcaccccgcaggaatctgctgcatccgcagagggagttgggcccggtgccgcctggccggccagtaggtggtgtctctggcctgctttccagcgcctggcctgcctttcccgctcgctggcctgccggcggccgcccgcacctccgcgcaagctggccacatctggaaatgtttgatttgatatagtgtcgctttacattgcagaaatgagcgtaagcggttttttaacccaccgagtgagaaatgcgatctgggttttactgccgaccctttaaataaaaaacagatcacttattaaaccattatctatcaaggatggggggtgggtgtcgagagtggacggggatccggcgcagatggaagggatgcggcctctgtctcttggctgatggaagggttgggggcccgggccgctggcatgtcactcccaggggatgagggagggaaccaggtgcccaccgcctgtcccatccaccctgtgccagctgctgccagtggagaggcgacactttccttgctggaggaagggcttaaggctcactggcctggctgctcaccggccctgaaacggaggctccccatcagagtgggaggggagaactgcaggggctgaccaggccacggttgctggtcccagggcaggggtccccaaagccacaggagaaggcatggacctggctgtgctcaggggctccttggcatccctctcctcagagtcctctctcccttgaccttggcttttgaacagagctgggttcccagttcaggacctttaactccgtcagccacccctgggctcgtctttcaaggagggttccggggtttcaaaggtgcctcacatgaccctgccacgtggtgactcagtggaggggccgtcccaggggtgctgggctgaagtgggccacatgctttgtctctggccacggcctcgtgtgtgggttgtgcggatgggcctgtcggtgaccagcacttggtccaggggcctggggcccttcccggggttgtagacacatttctacagctgtgggccgggcgccgctccaccggctggcacgagcctctgctgcccactctgtgcctggttcctggcctgctgggaacaggaggagctccgggagcgtggaaggtgaccagtccccacccgcatgggcgtttgaactgttctgtgctttgagtcgggagcctccttggagtggggttcagtcaatgctgccctattcctgcagtatttttggtaagtgactcccttccgctctgtggacatgcctttggtaagctgaccagagtcctcctggcgttcctccacctggacacaccgcagacgcaccctgtccggtgtgagcagtacccgttcctcagccgtggagccccttcctccatcctccgagaagctgggggctggtgtgaccccaggggtttcccgagctggtaccagagatggtgttgagaagatggtcaggctgaccaggcccaggcacagaggcagagtgacctggggcaggcggcgttggggaccgtcaggaggacagaggcggagtggcctggagcaggcggcgttggggaccgtcaggaggacagaggcggagtggacatgagaggatagcatcccgggacacgggtgaaggaggtgccatgctgatggtgaccaggcaaagccaggggccaggttctgaggacagaaccacaggttacgcggcgtgaacagagctcaggaggatgggtggtgggtgcctgctgagctagctgggaactgggcctggggccggctctgccgcaattccacgggaatctgcaaatccccaggcctcattgcaggttctgtggcctgtcgtgagacagagggaggcacgtgaccatgtagacccactgggcctcgagacctctgggctgggcactgcctgggcaggaatggggttcacggagagctcccacctccagggctggcagggaacagggtgtgtggctccccaggagggttggctgccaccatctttgccctcgtcactcaacaacccttggtggggtgcagagacctgagcttgggggagtctcagagacacagacagagccagcactggtcatctaatgtctggggacagctcctggcagccgggcccatctgcgtcacccaccttctctgggcagggcaggctggccctggctgctggctgttgtgggggtgggccaggggtggccaacggatgggtctcaggagaccagtgaggggtgggctgtccaggaaaggaggtgggccgagcggacagagaggaccctggtagtggagcggaggcacgcagagtggggaggcggggtgaggtcctttcggggcagccgtcctggggctggtttctgtcatgtcagtgcccctgtagagggatttactgagctcatgactggtcccctggcatggcagggtgctcataaggacagccaaagtctcctgtgtgtgcgacagctctcagcagcccccggcttggtcctgactgcactggagtgggagccgtgtccccagtctgcaggtgagaaaagggaggtctaaagagggtgaggggctggcccagggccacacagccagaaggggcgggtgcaaggctgggaagcacagggcggtgctgggcaggatcccaggggttgggtgccactgtcaggggccccaagtccctctggcccctcgcacacaagcatggccaccgaggctggaagggcagcagcgtttctgtgccacggccgggtccttcagcccccaaggggacagggaggaagccgcctcacttcccacctctggcagcccctgggcctcttcagcgagggtgaccacaaggtcacggcctccccaccgtcccccggtcatggggcttccagacagcacacacctggattggctgccccgtcctcgctatgccctgctgcccatagtggcttggcttggacagatttatctgagctgtcacagccaatagaaaaatggggccgcccgagccaccgtgtagttacagtgaccgagcgggcactgggcacacgtgtgatttatgggtcctgctggacctggtgggcctgatcctgacactacaatgtggcccctgcatgcaggtccccgaggggcagaccgggggccgcttctgaccttgagctggattctgggccgcagcagggaccctcacgagtgtgcaggggagtgctgtgagtcaggccccccggtgcagccggggccactccttggtgggcccaggggcacccaggcgtgggctggctggggcacagggtctccaggaggcagcctggactcagggacaagatgtggctcagctggggacgtgggcgcctagctcaggggacagctgggtccctgagttcctggtggccaaggcctaagccaaggcgggaggctcgccgagatcctggccctttatccaggacgcccccttcctcgttcctctggtgcaaatgatttttggccacaggtgtcctgactggcccccactgggttggggctctggctgggagcctggccctcccgcagtcctctccgggccgtttccctgaccccttcttgctcagctgcccccgagcccctgcctggacgtcatcagccacagttcattcagagccctagggccctcagggttgggtcgccatgagccccgggttcctgaacgttcggctcaggaccacctggatggagaagcagacacgcgagggtcctggtcactcaccgagggccgggaggggccctgaatcccggcatgctggggggaggcccacctgtgggaagatccctgggtggctcttttgtctcctgctcagctggggatggcggacactagcccgggtgtgtgcaccgtgtcggccgcgccacgtgggtgctgcaatgggtccctaacccacagtcctcacaaggaggtttctaggcttcttgcctcacacaaatcccagcaacactggcatggggctgcacggatttacttcctggagaatcaaacccggagtggcaccatctgctctgaggatggggctgagctgggctgcccggggctgagatgctgctgtgcccgggggggcttccagggacttcactctgccgtctgcaccccctgtaggacttgggggtgggataacccgttgtggcctaggggcaggcagcccctgcttcacagccaggaccccctccctgcaggcgtttcctgccacctgggcagatgaggagtggaggctcagggagggggcggtggggcggtgcggcccggcaggtgctctggggcccaggccccaacctgagtggaaggacctgctgcggcagcacggggttggctctgaatacctgctgggtgagtgaggggtggcagcacccaccaagtgggggctatggtgaggcccccagggcagcaggaacagaaggctgggtgtctaggggcgggggctccacctgtagctgcggcctccacaggtccagggagaacagggtggtttttgctggtgggtgaggcagggaagggcagctgggcagagggaacggcctctgcaaaggtgtgagggtgagagtggccttgcgccttgctgtggctctgaggctgaggcagggagtgctggagagtggggctcacagagggtgagggctctggtccatgagcttggatcttgcccctcgagctggacgttcaccccagggcacctgttagtgaccacgcccctgccctgctgacgagacactacagtgggaacccagtgggggccgggatgggtacctgggacatggcaggtgccagacaagtgtttgccaagtgcacaaatgactgtgggggaggctgctgcctcaggggctgtgagaccttctctctatcccacttgggctcccgaaacatggtctcctgagtgtgtggtgctgggcagggtgcacacacgtgtgagcatacacacacactcatgcatggacacacacctggcaagcatacacatgtgcacacatgtacaccgcaagcacacacgtgagcacgtgcttgtgcacacacactctacaagcacagggagaccctggcacacgcagccagcaccgccgagccctccctgccggcatctctggtcctgaacccaaactcctgcctgtccaggctccggccagcgtgtgcgggttaaaaactggagcatagtcaggatacatgattctaattagaacaatctatgtccatacggagaaaaaattgtatgcagagggtgaccaggcagttatggaaaggttccgctttctaacgatgtaaaacagaagagatggggtgattttagtttcaagaacctgggtggggtagtggcgcctgtatgcctgtctagaggggtgggggcaggcacagggtttgggggctgcagccggcggggctgctgggactgaaggaggaccctgggcccagcctgcctccatgggctctggggccagggcagggagtggggatccggagccaagccgacccaggactcagccctgtgttacccttcgttgccttggaaggacatacaggcgcctccccttccacactggggcatgaggtaggtgggaaaggacccacagggcagccgagagctccaggtgtcccaggcgccctccggccagtcccactgccggggccctctggccatgagaagggagggtggccgagagagcatggagtcctccccggcacggagctgcagaccccaggactgggcatgggtgaagcactcgcagctcactcccctctgtgagctccaggaggcctctgtaccccagagctgcgtgcaggccctgcagggaggaggcatcaggaggcgactgcattgctgctggtcctgggtggcctcagtcagcgcggcttggagagcaccccccaggcttttttgccgtcacggtggtgtagaccagcaggtagcacacaggccgtgatcccgcacctggggatgggctagcccctcttggaggactgctggctgcacaaccgtcgctgtgtagacagggatggcccctcggcccctctgggagcttcacctgcctaggccatagctgtcttcctgagcctggcccaccacagcccccagtatgcatttgttgaatgaaagccagaaagaatggtgcctgtaccctcactccctgcgcgccccagacctcgaaggctgggggagcccagggaacccacacacaggaggtcctggacccaggccaactctctcaagggatggccactctggacccaggccagctctctagagggacggccgtgctgcttctcggaggaccacatgatgggtagttcccacacttgcatctcacagaggggccccaagaatctgtgaggggcttggtggagcccactggcctcctctaccccccaggggtcagggcctcctcctgcatggtccagcttctccatagcaccagggtccggtgggtgccttccccaaacatgcagccccaccctccccaggtcagctgcaggcacgggggtaggacagggccggtcaggagccctgggtttcattaccctacaatgcccctggccctggaaaacatcccaaatctaacccatccctgcagtgtgatcctatgaggcctctgctgggttggaacaggcttccttcatctggtttccatacttcacagccgtggggatgtgagcgggtgtcaggtgggcgaggtctggggcataaattcggccagccccatcagcctgaccctccttctctgggcagcacagagggcaccctcaggggcacgggtcctcgccccaggacctagatgtgcatcattgcagccgaaggacaaggtcagagggcgggactgtcccctccgcctctccacgccgccccttgtgctggaagcgcacctcctgctggtctgaggggcgtccggagcacctggaccttagctcctcatcaccccaggagcagtcacctggggtcacacacgggtgggtgggtctcagcctgaggccggccccactgtccacgtgtgcaccttgatttaccatccctgctcctttaacggcgtctccgggcgccggctccgagcgcgtcctgcccccgctgccccgtgcggcagagcttgggaaaatctattaccgccgagtcattaatctgaggctgccgcctcgggcactttctggcccctctatttaatgggctctgcttccggagctccggagccgtgctgcttgcctctcttgatcagctttgtttaattatcaaaatatttgatgcagaaaattgacattagttctgaaggttctgccctcctccccccacccggctcctggtagcattgagtggctcagccgctgcgcccatcgcctcaaaatagcaaatgggccgccagcctgtgcttggccaggcggacatgacgagccgcctgtggggctgaggctgcctggccctgctgggaccctgccctggctgcttgggcggcacacagctgcaccccaggcccgtcccccatttccagtgtccctggccctggtgggagcggccgtgctgggccgtcgtggagccttctgtgcgtttccatgcatgatgcacctggctagagcctgtctcccaacacctgggctgggggcacagcacagagcgccgagcttgcgggctggggattggggctgggtgaggccagcgtgtcctgccccctgggctgttgtcagggcctcacccatctgcagagcctctgaggggccctcctgggcaggggccaggccggcccagatggtggagccccctgcttgaggggcaaggtggggctcctcacggccagccttgtgagcagggcctgtggcagggggaggaccaatactgggagcagcaggctcatggtacagagggggctgctgacctgcagggcccagcttgtgcccaggtgaagctcagcagccccttttagcctcagccgcagggctgggctgggcccggccgatgctggcccctctgcaagcattttcatccactttccggcccatagcggggagagcgcttgctaggccctgtccaggccttagtgctgggatggtgtgtgcgtgtgtgtgtgggcacacacgtgtgtccctgagtgtgtgtgtgccctgggagccctgtacacgcgtgcatgtgcgtgtgcctgtgcttgtgtgtgaccgtcatacatgagtgcccgtgtgcatgcctgtgtgtcccacacgtgcctgcgttggccctcgggtacccaccgtggacacccaccctgggtaattcatgttgaacctcatgttgacctcaagcccctcctaatctctccccagccccatccctcccatgtggttccaggtctgtgtctgtccatgggtgtgagtccatctctgagtccagaagtcagcgcctgctggctttggcttcctggtagagcagcgaagcttgggacccagcccttggtgtgggggcagccggagctgtgggcttttgagagggggctggtgcgtgagcgcccgggaggaacccctgtcttcttccccgccggctgcaccggcagacccagaactcatgtatttgctcctggttcccagtctcggggaccctggccggcacgcgtcctcaaatgcggcttttttcagatgccggataattttcaaaacagaaagtagtttcaaggttgagaagataccattatggaaaacaaatagcggtcaagcttagattcgtggcttttcacttgcaatcaatgtccctggtggagggaaaggacaaagggaaggagtcacaggctcagggagggcgctcgccctcatggcttcatgttcacctgcaggaaaaagaaaaaccgtcaggcccttggccttcatggatggtagcctgactccctgagccctgggccaggctcccaggaagcagcgttgctgtggaagctgacgtttgggtccctttctcgccacctagctggcctgtccagcgaaatcccaccacgcctgtctgctgcgcgttcagctggtagatgggacgtgagttctcgaaaagacaatgtcctcctccctccggaatgctctttgcccaggttggaaatggatggctccatgtatctccctgtctcggacgctgaccgcatcctttccccatccgcctcttcctgtatctccaggacagaatcaacacgcccgcctgcagtggtcaccagagccccgacacccccattcgggccaggccgccttcacatggggacctcccgggaggcgcagcagcaagcaggtgtttagtgagggagggagtgcccctgttttctgaggagcaagccctgggcccaagaaacaggagggagtggacccacgcttttctgcactgggcagatggctttggtgaaaatgttttcgtgggtcttgctgacttctctgtagctgcgggcagggtttgccacgaggcctgcgttgggaaggggttcggagagggcgctgatgttggagggaagtcccagggaagaggcagagccaagtctgccgtgtggctgcacaggggacctggagctgcgtcccgaccaacctgttggcagctttccgcccacacagggacaaaggaccacaactttggtggctcaaaacgacacatatccatcctctcctggttccagagggtgcgattcggaaatcgaggtgttggcaggaccacgctccccacgaagcctccgggagaggatcctcctggccccttccagtgcctggtagtcccaggtggtctttggcttgtggctgaattgctcccagccctgcctccttcatgcggccttctccccatgtgtctgtcctcgtgtgtgtgtgtctatgtgtcctcccccctcttacagggatgccagtcattggattagagcccaccctaaatccaggccgatttcatctcgaattccttaactaattacagtccccaacatggcctcattctgaggtttggatgggcctgaatctgggggactctattcaacgctccacacagtgggagggggtctcctggtttgtaacagaaagtgcgtaaggaatgggaatccgtctgatggcaacggtggagcactggcctgttctccgttcacaccaggatgctgaggatggcgtgtgaacgcggggaggacgttaactgggcctaggaggcctggcagccttctccctccacccccttctgagctgagcactgcagtaccaggctggggacagggctccagggacaggagccatgcatttggcttggatggaggctgcggggtcaagtgcgccagcggtggctgctggtagagtgctctgtcaatccattattgatacacacgcacgaagagtaaccactcttttaaatcttggctgaaccaagcagggggtgaaagaacaaactaataaataaccatggtaacgacctgcctcccctacccctgccccagtggcctttgatctcattattccagacgcccgcttggagacggtgggcaggtgaactttgcaaacactcactgaggtctttgcatttttatggcttctgctggccatgccggggcgtctttgtgggcatggggagggatgtgcatttcaacacgcagggatctgcctcctgccagagcatcacccacagcccccgcccttctgaggagctgagggtgagggctgctgtgtctgtgagccaggggtgggagggagctgcctgggtaggggcatttgggcatctcggtagagataacctctgtggccatctcaggggtgggctgggcccggcctggactcctggggttaggctcccccactcccagcctcccagcgccccagcctccaagcctcccagcgccctggcctcccagcaccccagtctcccagccttccagctccccggcctcccagcctcccagcgccccagcctcccagcctcctagcgccctagcctcccagcctcccagcctcccagtgccccatcctgccagcaccctggcctcccagcctcccagcctcccagtgccctgacctcccagcctctcggcctcccagcaccccggcagagccaccgtttcaatatacatctttgtttgtgggcaggacgtgtctctgaccagggcttcccgagaccttggcttttcctgacacaattattgccaccacagggactcattttcagtgtggccaacactgacccagctggtcccctccccattgtccgtgtccacagctacgaggatggctccactcccaggcccaggacctgaggcagcaccggacgcctccgggccctgcccagcatcttcccgaagatcctcctgggagccactctgtgccccattcccctgtggctggccctgcggaccccacccagcacctctgctgccagccagacatgactttcctggctcatgtgacgctggtgtgggaccttctgtgctgtgggctgaggatgggggtcggggaaggagagggtgaggaatgggtggggaggtgggggtggggaagaagagggctcttggtacagaatttc

SEQ ID NO: 520 - DNA, 20625 bp, Homo sapiens
acagtactctggaatccagacagtgcgggtatcagggatgtcagtagggaggagggcctcagtcaccagcccaggaagggctagccagagcctggagagcacccactcctgggaaaggagagcagttctgggtcagttaccagaatggaatctgaggcacagggtcagtcagcaacggagtgcgagctgagggccagactagcggccaggagggcttggtgctgggtgattcctgaaactgggggtagtcattcccttcctttgttggggcagacttgggcttgggggctggtgggactacgcttgaagtgagagggcaaggaaccccaactgtagggagccacagcctgcaggggataggaagtcagcagccatggtgcatgcttctttaaaaagcaaccggttagttattcacaagccagcgggagacagattgtcagataatgtcactgtctcagtgagagtccggtcaggaaaacagaggaggtccaagagaaggaatttagcacagtgaactcattacaagtgtgttggatgagctggaaaacagagatggggacacaatgcagagattaatcacaacaggagccaatacaaccctaggctagagggacaaagcaggagtggagttggcaaagctgggtccacagggaaggctgcttggcaggagctgaacccatgggaagtgcggcccctctggaacccctgcccaaagcagccacccacctgagcatgcttccactgggttagacctcactggaacctgttggtgggggaacctgcaggggaatagatcagtccagagcaaacagggaaatgaccagtgcacacacacttaaatgagtgagcaatgccctgagagtgacagcatagaagacagagtctgactgagtccaaggaaatgatgagcaggctttccaggagctacccaggccaggcttagagagaatgtgacacctctggtgtgtctggagcacagatttggggttgtggggatgctgtgaggctggagaggcaagtcagagccagaccctgccaggccttgaaggacaggtttttatcctgagagtagtttggagagccactgggagttttaaacaggacagtgatgagatcagatgtgagtttggagatatttctcgggttgggatgttggacatgaactctgctgtgaggcactacaagtttctgctggaaggagtgcatttcactcccaaaaccgtggccactagctggtgttccttctggctcacccaaagtcacacagctaggtacagccatcaggattccagcacaggcctgcaggtgcccacagagccttgcagattgtggctggatatcagtaagccaagtacctttcattagacccgctcaaggttgtgctacttctagaagggtgttttcatcatcttctagcccattggtaggtccagcaacactggcaggagtcatgaaaatgacccacaaccctgactgcacgttagaatcacctggagagctttaaaaaatactgacgccaagccccccaacccagaccaatcacatcagggtctctgggcataggctccacagctacattttaaaagctccccgagtaattccagtcaacatccacagattagcgcttcctcctccatgaagaggttcacataactcttttgaagaaggcaccagaacatgattcacttcttgcagatcagaaattgggggaaaaacggggaggttatgtgtggtctttttccaaatttctatagctttatgcgacgctaagatttccttctaattggagaattaacctgggccaactccccaaaccactcacttaaaagatttttcatattccttgtattttacaaactcttcagtctaagcttaaaggaaacaatcttatttattccctctgtaatatttcaaaagacttgtgaatttaaaaaaagagggaatggtttttaaacaaaattatacatgatcttccctcagaaggaaaaaacaagtgatatgactaacactggactaaaaagaacacaaagaggccctatcaccactctgcgaaggccagaaaggaacaggaaacccagttggcaagggtggttccccacaccacccctgcccccgccgagaggaacgcagcgccctccttctttcctctttttcagagtcccacttggattccagggaggatcacaaagggccccacaagtcaaattccttccctagctgggtggtgcagctctgctgggcgccctccttgatcccccactcaccaccctcaggatctgctggctgggctgtgccttgcactcagcgtgaagactttcctcattgaatctcacgattttttgcttttgtctccagtacctagtacctagggggtaccacagcccttttggaagcaccctgctaggttgatcacttcatactcctccctcatctttgtctcagtccaaagtggtgcctgaatctttaaacataaagggaatctgggggggcaaagccaagaggctgggttaagacagaactggatgccattttcactctgagtctcctcagctgaagtcagtatgaaccaaaccctacggttcaagttcatagcagcatgtagggaagctggaacttacacctagttgctatgtgactccacagccaccttgccagcttaggtaacttgtccaaagccatacagctgggaagacaaacctgggttccacccaactctgtctgcgcttcatgatgttttcttgttgctgtttccacccacacattcatacttagcctaaaacagaaaagtccttacacagaattctttgaaaaggaatgtcctaaaagagggtttctacttctgggtaattagatctgaaggtgaagatctcctccagctaggaatccaagaacgaggaacagtttttccagatatgaaaatccaggagctactattttgttgcagtgtccacttgtttattctaaaaaatcaacaactactttcttggtcatattcaaagctgtaggtgtgggcagaggggctggtgaaggtgacacaaaggactgtggtaaggagctaaccccttggtgcatgacagccaaccagtgccaccagcagagcccgatcggagccaaaggggaagtacaggtggtaagggctacagtcatttactttccctttacccttttcttgcagacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacaggtaagccccagtattcacctctgcaccagatgcactcacacatcaaagaccagtcttggcattagatgtgctgcctattgaggttcaatctcatcatagtgattatcatcttagaagcagagatgacagacacccggtgttttccagaacctcctgtgggaccatcttgggttggggaaattccactgtatttgttctgcatatttggtttctatgtaagattttattagaacaaagttttctcattgcatattttctcctctgtggcctccactccaactgtgtcatgggtcacattcatgggtgtggatccagaatccacatcccctttcccttcctctaaaggcatttatgtcattaaccttaccacccctgggcacttggaccacaggaactggctcttaattgtaggtgattgcagatttctttcaccagacatcatgggaattcaaaagccacacaatgccaagccctgtctcctcaccagccactgctctcttattgctcttctcttccagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaatcatttaattgttttacttgaatggaattctgttacctacaaaaagttgagatttatactctgtgggattggagaaaacagtattgcattatcggtattaaaatagcaactaaaagaagtacttggaaaaagagaggggatgaagggtagggaggaagatggcaccatttaccaacccttaccattacctcctctggatatctggaaggtttgagggatcagagagatcttggggaatacaggtagatttcctctgggttagtgtttcccaaactttgatctttgtaaataaccttgtatcagccgcagcccagcaaaaaacagatggtgcgctcaatctgggttatttgaggagaatttaagaaaaggacaatttgccatagtcttttgtggggcaaccacagggataatgcagttccctgaagctactggcagtagaagctgctactaccctacctgtgaagaggccagagaaggaggggaagcaccagaaggctgcagacctgcagtgcagggacacagccagccagcagcaaccccgcagggagggagcagaagcacaggttctctgacttcactcttcttcctctcccattttcctgctagtgctccccattaaggacccccaacagaagccagaggacaaataacacattgacatggcctaaccaggcccggggcatacagcaggacagagaaggttggagagtggatgggaagggggtgcggaactaacagatatggcacacgccttcaccactttcccaaatccaggttgcctcggattcttttattctttaaattcactttttaaaaaacataaataaatgagctttaaaaggaaactgctgacttgctgattcactctccacaatgaagacagggagaatgatgtaagcaacaggctgcaattacttcatctgggccaagtcagccagggcactgagagagcttcggcctttgtccaggccttggaaatgcaaccaaaaggacaggtgaggctcacgaagatgtttaactgtctgcatgatcacagtcatgtctaaagaatacacatgttccctgctatgtaggcttgcaattttctattttgcctcaaaccaaaaaccctcctttccttttccttctctttactccacccaggttcctccctagagacagtcttaccctgagctgtattacgctgcacttccatttgccatcttgggagacactgcttagcacatacttcttccttagttttccccactgctcgttgcttttttttccaaatgtgtatcacatttctgtgatgaaaatcatattgtcggccgggcgcggtggttcacacttgtaatcccagcactttgggaggccaagctgggtggatcacttgaggtcaggagttcaagaccagcctggccaacatgatgaaactccatctctactaaacatgcaaaaaaaaaaaaaaaattagctggaaattagtcagtgtggcggcacatgcctgtaatcccagctactcaggaggctgaggcacaagaattgcttgaacccaggaggcagaggttgcagtgagctgagatcatgccactgtactccagcctaagagacacagtgagaccccatctcaaaaacaacaacaacaagaaatcatgttttgtgatgttgatgctaactggtgttaaactcactcaatctgtttttcagtggcctcaaattccattctgcttttggccatagccctgggtttctttgcgaatattttcttatttttaaacactgttagactttctcacatgttactttgctccgtcagaaattttggattattaccttacatggaaaaaccagtttctctactcataaattaatcctagaaacaaatacaatgagaacattataatgtttaacattccaactagatactgtggtctgatgcaggcttaagtcctgggcctgttttttccttttttttttttttttcctttcatgttcaggaggcaaaattttttctttactacaaaggggaaatttgcaagtatgtgagagatgttaaaaatttatcagcactggccaggcacggtgttgtccagcactttgggaggccaaggcaggcagatcacctgtggtctggagttcaagacaagcctggccaacatggtgaaaccctgtctctactaaaaatacaaaacattagccgagcgtggtggcaggcgcctgtaatcccagctactcgggaggttgaggcaggagaatcgcttgaacccggaggggtggaggttgcagtgagccgagatcgagccactgcactccagcctgggaaacaagagcaaaactctgtctcaaaaaaaaaaaattattaacactgaatggaaacatttttctatatgtaatcactggatggaaaggatataaaaaaatgcataactgtctatgagatggaatgttgtttaatgctgggtctatgtggtacctaaaatcatcctgtccaggggcacgtggcccacactttgggaaacatggctttaagtagatgggatgtctgtggggtcagggaaagggagagctaacacggaactctgctccatggcagaacaaaagcagaacttgggtctcccttccacacccactttgctcactctgctgcagtcttttcatgaacagagactattacagaactaattaaattcaacaggcagattcaccaccaagtgcaagatacactgccgtaagatacagaacaatgtgaccttggaataggcacgcaacaaaaacatccaacattgcacagctttttactatgttccaggcaccattctgagtgtttcatatgtattaacatattttatcctctcagcaagcctatgagatacatgctattattatcccactttatagataaagaaatcaagaggctgaggaaccttcaagatcacaggtctagtaagtaaaggagccaggattcaaatgccagctgtccgccccagagccaggtgattaatcaccactctaaccagactcagaaacatgacacagaagtagcccctaaaggtccacaatgcaaccctgtgggactggatacataatttacagggttcagtgcaaaataaaaatgcaggctccttatttaaaaagttgagaatttcaagatggtgacagcagagcatgaaaccaagtgtggggcctgagtggagccctgtgcccaggtgtacaggtcgcatgcccaggaaactggccttgcagccaggtgagccagctgtcaattcccagagccgggcattccagccgagcttgtgtagtgcagctgactgtgaacccagacaaacctcagttggctaaggaagaaagttgtgaaggatgaaaaaaaggtcatagggcctttgagagggatgctagtgtttcttacagaaaatattcagacccagccaggtgcggtggctcacgcctgtaatcccagtactttgggagactgaggcgggtggatcacctgaggtctggagtttgagaccagcctggccaacatggtgaaaccttgtctactaaaaatacaaaaattagccaggcatggtggcgggcacctgtaatcctagctacttgggaggctgaggcaggagaattgcttgaacctgggaggtggaggttgcagtgagacaagactgtgccattgcactccagcctgggcaacaagagcaaaactccgtctcgaaggaaaaaaaaaaaaagaaaagaaaagaaaaaaaaaagaaatgaaaatattcagaccccaggggacatgcctgtattaaccatcactagattttcagatgaatgttgttgaaggttcctctacactagaggctatgggagcttggttcccactgcacagcttggtgacaggtaggagagagcccaactccagcagcattttggaatgctgtccccaacatctggagcacaagatgtcagagagagactgggatgggttgataagggagaagatgacttcctagcctctttcgaggtctgatgatccacactttgagaatagacgtaggaaagaccttctactcctgtgtcctacaggtgtgagattctctagcaactgcagagtggttaacagcaaagaggacatgcgtacccacttctgaatagcagggctggctgcttcaatagagcgagaaaaaggtgggagtagaaggacaggggagaggagaggagatggaagcatggatggaggtgactgcagtcagataaacagttgtttggcacacaaacccagcgttccataaagtcctatgtggactctgtgagttcacaatagtttcccttgccagcagctcacaaaactgtgccttgattacaaatctcatgacaaatcaagcccttgaccaacagggactttgtcttgtctgctgttgtactccaagtccctagcacacagtaggttctcgaatatttgttagaaaatgaataaataaatggtcccaggaagtattttcacttctaaggcttaattattggcagaattaaccactgaagccatctcagtgttggcttttctttgcgagtagtttttcactaatttaatctcttcacttgttatagatatattcagattttctttttctcttgaatctatttcagtaatttgtacctttctaagagctgtccattttatttatctaatttgttggtacacaattgtttgcagtattctcttataattctttttatttctataaggtcagtaatgatgcctcctctcttattcctgattttagtaatttaagtcttctctctttttttcttggtaagtctagataaagatttggcaatttcattgatctttttgaggaaccaactttggttttccagtctctagtgtgataattgctactctaatctttattgtctttctcgatcagatattattctacatcatttttaaaaacagctaaagccacaaatctgccttgacccttttgtttttgcttctgctctgtcgatcttccttgaggcagcagatctttcatgacctattgcccaaaaaggatagagtcacagggtcacagacaattcttggaaaaatttacattggtgaatatatcaaaatgatattctgctacatatgcataacttatcttcactcttggaccacaaagatctatttcagagacaaatttggagtggaattttccttaacattatcctcaatagagcctaaagtatagaatacactcattttctcactcatatcctgagacctcagtggtcgtttaccagacgttggaattcctaaatgaataccattgccttaaaaatcatattcctcaggtcagaaggctagagtgctctagtacaggagtcctcaacccctgggtgagtgaacattaaacctgagctccatctcctgtcaggtcagctgtggcactggattccaggagtgtgaaccctattgtgaaccgtgcatgcaagggatccagactgtgctctccttatgagaacctaactaacgcctgatgatgtgaggtggaacagtttcatcctgaaaatcatccccctcaccactgtcccagcactgtactggtctgtggaaaaattgtcttccacaaaaccagtccctggtgccaaaaatgttggggaccactgctgtagtagattcctagtcagtttgaggtgtctttttttttttcaggtggacagaaagtaggatttattgttgggccttaggaggggcagcacagtggaagccctcatgagtgcagggcccaccacttgtccagagggccacgactggggatgtacttgaccccgcagtcatctggaatgagccgtttctcagccaccatgtcttcacattgaacttggtaatgccccacttctttgagatgtggatcttctggtggccagggaacttggccttggccctgtgcagggcctcaatcacatgctccttgttctgcagcttggtgccgatggacacgatgacgtgaccaatgtgaaccctggccacagtgccctggggcttttcaaaggcacctcatatacctgtttggagcctgtcagcccagcacaggacgtcttgttgatgtgcataacgtggaaggggtggagccgcacttggatatgaaagccatcctcgccgcaacttttcatcatgtacttattggcacaaattcaggcagcctccagggcttcagaggagagctgctcatattcatctgacaccatgtggccacagagtggaaactcatccacttttaccttcttccaccccaggtcaaagatgggaatctcggcatcagcaacacctcgccagaagagaggctttgtgttgttcttacaataatggtaacactgggtggggcagcggcccatggtgacaccagaatcttcagtggcacacgaaagggaaagagcttgagatatcttttgaacttaagagtcatccctttctctaagaactgacccccatctagaagatgggcagccccaattgtactgcatgaccctgtcctcagacccagcttaatggaccagaagtagacagctgactgaatctggacaaggtagatttccttcctgaaagtctgaaattatgactaagaggcagccgtacttgtcttctggttgttggaattgttccatgtgaactcaggagctgagggcaaacatattccaccatgagaacagagaaacagggaagactgctctgttggaaaacagaaacatgttgcagttctcctaagagaaacagaaacagaagatggtgactgggtccctgacagcttcctgctttccctgatggctttctgatctagtcccatattaaaatctagtggcatttctgactttgaattccataagacacccctgtgtccttataaattctcctttgctttgtcatcataattatcaacattgtcaacattatcaacaaaaaagataaaacttcctgaacatttactatgtgccaagtaaagttccaattagcttacacaaattatcttatttaatcctcccagtgaatccatgtattacttcattttacatatgaggaaacagggacaaagaaattaagtaacttgtccactacagtcagcaatagataaaatcaggattcacaccaaggccatctgacttcagaatctgagctctaaccaccatgttatacagtttagcctgctcacgttggttcttagcacttgcaactaagacgtattagctaaatagggctcctcagtctggccctactctgcctaacaaaaattatctgccattttccccagtgtgctgaagccagcattcccctaaaacatactatggtcaatgtcacctccatgcctttttgctccttctccttcccacccacccccacttttatattctaccaatgattcagggtccacttccagttctatcttccccagggaaactggtcacccgtatgttctatcagtcagtaactatgctgccttgcaatggtggttaatagcttactgcatgtatgtcaggcctctatgatgagattgtaaggtctttaaaagcaggggctatattttctctttcgctgtgtccccaaaacactataattcattgtaagcatgcaataaaagctccttgaattgaactaaaggcagtaatcttagtggcatagacaaaggcagggagagaaggtcaggcacagagaggcttaactttaaaggagagcttaatgtcttttcataagtgtcaggaatggccttcacatactcatcttgttttaaaattttatgtgtcaatattacattttaaaagttttaaatctctataggaaaaaggatattatattgaaacataaatcttccataattgctgaattctcacccagcccttgatctccttgttgagtggtcccaagtctgacattctgaaagtgacatacgctgctccccacagcctcaaacacatctctgatctcactcttgggcacaccccaagccctgggatgaccatcacaactcccctctgccccaccatctcagaggaggtaggtttcttccccttaagaagagtatgggggtgatgagagtatcccagtgcctgagtcttcctaggccccaggaaggccttggaatcctctctgatccttagcattcaccctcatctatgaaagcaactgtttgcattatgtgtccacttagtgtcctgacaacagtctaaactcaatccatccaaaagcaaatcaacatcttccccaaagttgttcctcctctttttacggtaatagctgccaccatgatccaatcatccaggcttgaagcctgagtcatctttgactcagaacatcacagtgctaaaaaaaaaaaaaaaagtattttaagccatttgcctccttcccccagtatatgatttatactcagactctgtctctcaatatcttaaaatgcatctgaggtctgtcccttcctgtgtattcccccgataaggctctggattttggcaacaactcctgaactactactctcttttcctgctggtttgaatagggagagaagcaaaagtaaactggaaagtggaactagaagtctctaaaaccacaagtgttaaccttacccttgccagaatggggcacatgaattgtcctactagcaggtaacagctgagtttaaccaacatttaagaattaccaactacatcctggctaacatggtgaaatcctgtctctactaaaaatacaaaaaattagtcgggcgtagtggcgggcgccttgtagtcccagctactcgagacgctgacgcgggagaatggtgtgaacccgggaggcagagtgagccaagaccgtgccactgcactccagcctgggcgacagagcgagactccgtctcaaaaaaaaaaaaaaaaaaaaaagaattaccaactaaatgtcacacatgtggccttgtgtggggtgctggggccacagcaataagtaagacttccccagccctcaagtgcctagcgagggatgagagctgaggggggcgatcccagagggctctgcgagtcctgaaggggattgttcaatgctgagggcgaggtgaaggccaggagagtgtgcgtagggagaggacatgtgtactaggtttgagggctgaataggatttcaggcctgagggctgaggggtggagggcaattccaggctattaagcaaaggcttagtttacaggctggactaatccgatttgtgtgctgtgtcctgggctcccctgtggcagtgatgcaatcatgtgacagttggtggtcatgtgctgggtaaggacactttcaggaaggatgatatcacagaagtgatataatcaccagataactttctgagtaggaggcacatgtcagggcatgaattcaatggtgacagacgtgaaactgctgacagcattgttttcacttctacctcaagatttgtgtggatgtctacaggaaaccagggggtcaaaaatagaaagagaagaggtgctgaacattggagatggactcaatttccccctccaggcaattcttctccccaggatctctcacgggtttttgctttatacatatatgtaatgctatttttcaaacatataaagagactgttgtggctaatttttaaaacctataaatttatctaaaaatcctattgaaatccaaatgtcttttgccttacatacaccattagataataaaagcacaacttccactacgtaaggtctgattctttggtggggaaaagggattaaaagaggtcctcatcttgagaaaccactgctatacaccacaggtgtgtaatgacagccctgccttggtgatcctccaggttggggagtggcaccacatccaggttatgttgaatctcaatttacaatgtatagtgtactttttttttttttaagatggagtcttgctctgttgcccaggctggagtgcccattatgagtcatggagactcagattttgagtaagagagaaataaaactttgtgcttttaagtaataataagtcaatcctgactaatatcacatggtaagaagtctggattttattctaagtgggataggaagtcatttcaaattttgagccagagagtgataagatcttgtatatgtttaaatgacctctttactgtgtgtaggttatgaggcagaaggactggttgtaagtccattgaagttaatttagaatgaagtagtggtggcttgaaattagcggtggcagtagagattgtgagtcgaattcagaatatacaggcatgcaccatataatgacattttggtaaacaatggaccacatatggtggtcccataagattataatggagctgaagaagaaagtttgaagactaccagatatcaaaacttactgtaaagctacaataattacaaccagatggtactgccaaagggtagaaaaatagaaccatcagacaacagaaaattcagaaacagacctacatctataggaaaatttgatttgtcacaaaggataagctgaacactagtagggataggataatcatttcaatagggagtgctcagtcaattggatagccacatggaaaataatgaatcttggcccttagtcatatatacaaaaaccaaatccaggttgattgtaggtctaactttgaaatgtaaaacaataagaaatctagaaggttattgggagagtaccttcaggggaggaaaagatttcttaaacacgacacagaaagcacaaatcagagacagaaagattgataaaccattacattgaaattaaaaactatgttcatcaaaagatactatttagagaaaaacaatacccacaaaagtaggagaatatatacatatatatataaaatctcaataagtaacagaaggacttttaacctgattatttgaataactcctttaagtcaataagaaaaagcatacaggctgggcacagtggctcatgcctgtaatcccagcactttgggaggccaaggcaggtggatcacttgaggccaggagttcgagaccagcctggccaacatagcaaaatcccatctctactaaaaatacaaagattagctgggcatggtgatgcacacctgtaatcccagctacttgggtggctgaggcatgagaatcacttgaaccaggtaggcagaggtgagccaagatcgcaccactgcactccatccagcctcaggacagagccagactctgtctaaaaaaaaaaaaaaaaaaaaaaaaaaagaaagagcaatggacaaaaaaaaagaaacaagaatagatacttcacaatagaagatatccatatggccaaaaaaaaaaaaaaattgaagaagaagaaaagaaagaaaagctactcaacccatcaggaaaataaaaatgctgctaaacatgcccaaataactaaaattaaaaaaaaaaagataatgccaactattgctgaggatgagaagcatctggaactctcatacagtgcttgtggagatgtaaattggtacaatcacttagaaaaattggtcgtatttacatacccaatgcctgagtaattccattcctaggtatatatccaagaaaagtatacatatgtataccaaaagacaggtacaagagtgtttatagcagcactatttgtaattgccccaaggtggaaactatccaaatgcccatcaattgtagattggataaataaattgtggtatagtcatacaaagagcacacaacaacaaaaatgaaaaaactattgagagggagagatgcccaaggattcccagctgtttcagccctcatctgtttgagtcttcccagacaggtgagtaaagaagccttacagatgattctagactgagccactatctgactgaaacaacatgagaaaccctgagtgagaaccgcctagctgagcccagtcaggtcccgcactcatgagcaccacatattattaggacaattttaagtcactattttagggattgatattacacagcaatagataactgaaatatatgttgaagtatttaaagaaaaaggaaaatagaatatattacatttataaatctactttaagatgtttaagaaaatctaattaactaagtttgtaaaagtccctctaaaaactattgtttaatactaggttcatcaacagaaaaagagatttgtaagttgaatgtcacagcctaagggaaaacgaggtttttaaatttccacttccataaatttgaatcttaattgaaaaataaaaaataaccaccagtgaaaagctggatctttgactccattgatcctttcagacaatgcaaagaaacaacatagggaaaggagttgagtgatttattgagtgcttacttggtgccacggcatgtgctaggtgcttacctaaatcaactcattggatcctcacaacaaccctgtgaggtgggtttcataacccccactgtttaccgatgaggctcacagaggctatgtaacttgcccaagattctgcagctggtaaaggacggaatctgtgcctctgcactaccaatgcctgctcctgaaggaaggtttgtgagggtgaatttctcaaagtcacttcaggtccttactgtagcgacagtgttggcaccttctgtgtcctctctcaccttgcctgtgagccttccagtgggtgggaaaagaggcatgcctatcagtggccattctgtgaacacagaagagagctgcgctggccacagagaagatagtccaatgatccttaaagttcaggcgtgtgggttggagccaaaggggcctgtcccctggatataacttgagagtagctctggagaggaattctagaagctgtggaaagaaaaagagggaggattttagcactatgtctctggacagtttgtctaacttcaaagggttcttttcagtttttttctttcctttaccaattcccaatgttttaactgtactcactgcctgacatgataggggcaggtgtaccttcgaatcatttcatactagaatattagggcaagtcagctttgaaggtatctagcccaatcctctcctattgtagagaccaagagatcaacttttgttgcttcctatgaacgttctatagaactctacttcttacctaaccctatctaatttaaagaaaaaaaccaaaagcctgtattgaataatggtaagtttcataagactcctgactttcatttttacagaaagatgggtaggaaaatgaggcctgtaagacagaagtggaaacatgactcaggagcagccccaggctgctgttatccagagggcaggtggggaactgctgcctctaacttacctgaccgacaatggaacctgtggcaggtagaggtggcacgaccctctagagacccctgctctggccgtgccactttcaagagcaagttttccgagccaggactctttccagtagttctgtgagaaaagcactgtttgctagcactgacagctaccaaaaaccttacagctgcttctgaggggaagagcatgatgacagtgtgactctaatctgcctcctcccaaacagatgaaggagagcaggctgacatgtgacttagctattcaggggctaaagagctagcacatgttttctttaggcctccactttttgctgtaccttttgttgtcaggggattctgccagctgccaccttccctgaaaagccaaactggtggaaataagagggaaaatcatctatctctgataaaagaaagagaaagaaagagagagagactgctaaacaattgtacatacaacagaatcttaaaatacgctacacatttaactagtgcttcagagcttaaaaactgcctttatgtattttatcacaatcacgcctcacagcaacccggtaaggtagacagagccatcttggtcctgtcctgcagatgaggaacatgttcttgatggcaggtgagtggcaagactagagtccagatcttagaaacacagaatcctagagttagaagttaccctgacacaataatccaaggcatccttttcccagagcatgaatcaccttataaaatccctgagatttcttatggcccctgcttgaactcttccagtgatgagtaactctcaccacccatgagcaatccagtatcaatactgagctaaaatccttcttataactttcagcctattcaattcaatttctgcccacaagaactacaccaaattaagtcaaattctaatttacattctttctaaaatttgaagatattacacttgcccttttcttgcagataaaacattttcagttctttcaactacttatcatgtgattacctagaaccatgcctaaaatatatagtaaatagtgtttattgaatcgtttctcttgcccttggtactatgtcctgatcctcctgtcgaggggctccttcccttacctcgagtgtcctcaattttgtaatctgttcatcatttgcttatttaaataatagggagaaaagaaacagtatagttttcagaacaatgtgaaacaaaataaaaattgtccaaatgtcagacagctttcaatttattttgtgataatggattcattatttcactcaacagactacctcggagctgcatttctagaagataagtccctcattcattgagcatctcctgtaataagacacagaatggatccctgtggagagtggccatcgaattaaacagaaaaattctagtgaagggagggatgatttggggtctggctggaagaccctgcatgaatacattatcctgcagcatagttttgcctattaagagaagcagcacccattttttgttcaattttgggtaccaccagactaaaaaacatatgtctcttcaaaaaggagctccagaggaaactctgactattttcagttggtcttaatttggattggtgtgagagacaagcactggtgtcaatgtgatgaggctgtgtcattcctaatgatgcagaattcagccagcttcatgcctctcatataagtgctgtgccgggatgaatagcaatgagcttaacattttgataactaaagagccaggaaatagatggtgaatggtgccctactttatgaaagaaataatagtaaattgctcccaattaagggaatatgcttattcattagagtaataaccttatagcaagtttgatggtaaataagtcaaatcaaacattcaaaacacaatttcagaaaaagaactgaggctaaattatcccatgatcacagactacattgaaaactatcagaagtttggctaatttgatcatgttttcaagttgttctgaaaacctctatggcctgaaaagtaaacgacataagtttcctttctctctattgcttaaacaaagaaacatgaaaaactattctccctatattgcaaattccggtattttagaaagtgagcctcatcagcagttttctcatcttgagttttagaaaaggctgaatttggaaagaggcatttcatacgatagtatgtattaagggttgagggcttggggactgagttgtgatctcctctctcataaaatatccgcactgtaggccgggcgcagtggctcacgcccgtaatcccagcactttgggagcccgaggcgggcggatcaccacgtcaggagatggagaccatcctggctaacacggtgaaaccctgtctctactaaaaatagaaaaaattagccaggcacggtggcgggcgcctatagtcccagctactcgggaggctgaggcaggagaatggcggtgaacccgggaggcggagcttgcagtgagccgagatcgcgccactgcgctgcagcctgggtgacaaagcgagactccgtctcaaacaaaaaaaaaaaaaaaaagaaagaaaaagaaaaggaaaaggaaaaaaaaatctgcactgtaatcacatggtaggtgatagattcttcacaggcatagaatggagggaactgctagttaaacaagacccaccaccacaagggctgaggagagtcccaaggtgccagagaaattgtagtgaaatatcacagagagttcttgctgaaagacactcagatgtcctggggcttgtgtctactgtactgcggactgactactcctcttttcttcctttgaaaaacttatccttgccttctcagatcaatccaagggggttcctggggacagctggtccaacacgctcaaatgaagaaagtaaggtttagtgaggtatggtttgcaaaaagtcacatatttgattagtagcaaagccagacatagaagccaggactttggactcccagtcctggcctctttctcatttaccatgctgcctgcctcctgatgtttggaaaacattcctaaagctggggattttacaccttcacttgaatggttttctttataggcagagggaaaagtactgatctttggaagagttaggatta

SEQ ID NO: 521 - DNA, 25341 bp, Homo sapiens
agcacacagttcatacttaattagccattattattactattattattgaaactaaaacttacctgtgatggaaaaaattccacagcaaattgcttcctgctttccagctccagattccttcaggaagaactgaagcctgagaggcagaggactctggaacgtctggagggcatttagtcgtttgtcccatagtctgctggcagttctgttttcttctcaggcactgaagtgaaagggagcaggtgcagttggctggtataattctacactagacatcatccacatggcgcaggctgccacagtctgtgggaaccccattctggaagtctaccactcacagagccttccactatcccagtatcatgataaaatggtctacacattccgccatttgcaaagtacttccctgaacagtttgatttgatctggaaactgaggaggaaggccagatggatgcttttactatgacttctcagggagcatgtgaaagctgacagactgtcaatggcacattgagaggtacgtggctggtaagtgacacactcaaatcttctgattttggttcagagctctctctctccaaatatacatatatatatatatatatatttgcttgtctgtatatatatatatatatatatgcttgtctggatatatatatgcatgtgtgtgtatatatatatatatatatagagagagagagaggtacatggctggcaagtgacacactcaaatcttctgactttggttcagagctctctctctccaaatatatatatatatatatacacacacacacacacacacacacacatatatacacacatatgtatacatatatacacacatatgtatacatatatacacagatataggtatacatatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacgtatacatatatacatatatgtatacacatatacatatatacatatatgtatacacatatacgtatacatatatacatatatgtatacacatatacatatatacacatatgtatacacatatacatatatacacatatgtatacacatatacatatatacacatatgtatacacatatacatatatacacatatgtatacacatatacatatatacacatatgtatacacatatacatctatgtatacacatatgtatacacatatacatctatgtatacacatatgtatacacatatgtatacacatatatacacatatatacatacacgtatacacatatatacacatatatacatacacgtatacacatatatacacatatatacatatatgtatacgtatacgtatacatatatgtatacgtatacatatatacacatatgtatacgtatacatatatacacatatatacatatatacacatatatacgtatatacatatatacatatatacatacgtatatacatatacatatatacatatatacatacgtatatacatatacatatatacatatacatacatatacgtatatgtgtgtatatatacatacatatatgtatgtgtgtatatatatacacacatacatacatagagagagagagagacagcacaattaagatatttggatagtcaattctgaaccaacttatacagcagtgtgtacgtgttctcttttctacacatccttgccaaaatttatctttcatcttttgataataactactgtaacaggtgtgaagtgatagctcattgtggtttggatttgcatttctctgataatttgtgattttgagcattttttaaaaatatacatatacctgttggccacttgtacacattattttgagaaatgtctattcagatattttgctcattttgtaatcaggtgattttcttactattgaactgtttgagttatttatatattttggatattaacccattatcagatgtatggtgtgcatgagacatatatgtccttccattctgtaggctctttattcactctgttgattgtttccttgactgtgcaaaagttttttagtttgatgtaatcctattcatatacttttgcttttgttatccgtgatctggggttcatatatagcaaagtcacagactcttaagagtatatcccatgaacttcagggaggcctgaggatcctaattaaagttacactaatataagagaaaaatcaagaaaactagattttagcctagctctcctattaaccagcagtgggaccttggataaggatttaaatccagtcagatttcccagatgctctgaagtacatggaagtgttggccttcttgagacttcagtttgttcatctataaaatgaaaaggttgagccagatcatctataaggctctttatagctccaaaaccctctggtccttactgagttgaattacaatatgaccttgcttctagtaactagataagtcaccattcatacatcacaaatgcatctgcagccttctttctccaaagctacaaaactcaaaaactcagtctcctttccaaaagatagcttggatgtgatgcaaagtttgagcaaagggatacagactcaagagtacaatgtgacctgaattcaagaaaatatggatttcaacagatgattggtccagtaggcgaatacttagttatccataaaaatgcaataagggcaatgttttgctcaaaagtgactgttaacatactcagagataacaagtatgagagttctctaccataaaaataaaatgaagtgcaggcaaaatggagacaaacttgacagaagaaggtactaaatgaaatgtagaggaaattctgtgggcttcagtgtttccgcaaaatgtgtataagccaattgtgtctactctatctgccaatctttcttttatagcctcataggcccctaggactaaaagtaagtgtggatgttaaatttatgataataggggcattgaattccagtgcaatagtctctaagcgctttcttatggggaacaattctgaactcccttaaagttttatggttactgaaagaagaaagatgttactgaaagaataagaagtacaagctgccggtggggcagctgacagtcttcctctccctgcttgaagtctctgggaacttcaagaaggcactgtgttgatgacaattaggttagcaatcaaccaagaatagttttaaactgaacagagaactggaaagcaccgctctagtagctgttctatagacattttgtttgctataatgatgccctcctactggcaggatgtccctgaactagtcattttctctcttaccttaccagacttgttatgaggactaagtaagataatagccaacagtaggagagatgactgtgtttctaatgtatgttgctatattgctaatacagattgcaatgtgttgcacaatttctctgtctactttctaggcacatatctagcctacattcctctgcttcccttgctattagacatagctatgtaactgggttctcaccaataatagcatgagccatttcttaggctggcccataggatgttcccgtgtgatcctttattatctttctttctctacactctgtgtgaatgaaaaaaatgtctatagccatagaggaggaagaagcaaaaaatggaagtcacctgggcctggaatgactgggtagaggctacctggccagaagcatactctgttacttgagtatgaaataaacttgccttatttaagccactgatggtctttggtttacttgttttcagtgaccattatattaactaatacattaatattagtgagtgcttgctatatggtaggcacatacacacttctttttttcctggtgatagaatataccaacataaaatttaccatcttaaccattttaagtgtacagttcagtgttactaagcactttcctaacgttatgcaaccatcactaccagccgtctccataactcttttcatcttataaaactgaaactctacacctattaaaaactccacattccctgctctctgcatgccctggtaaccactgttctactttctgtatgattttgacaactttaagtatctcatataagtgcaataatacagtatttgtctttttgtaactgacttactccatttaatacaacgtcctcatttcatattcatgttgtagggtatgtcagaatttatttcctttttaaagttgaataatagtccattgtatgttgatacggtgtggctgtgttcccacccaaatctcatcttgaattgtaggtcccataattcccatacgttctgggagggacctggtgggagataattgaatcatgggggcagttcccccatactgttctcgtggtagtgagtaagtctcacgagatctgatggttttataaggggaagcccctttcacttggctctcaattctctcttgtctgctgccacgtaagatgtgcctttcactttccgccatgattatgaggtctccccagccacgtggaactgtgagtccattaaacctcttttcctttataaattacccagtctcaggtatgtctttatcggcagcatgaaaacagactaatacatatgtatataccacatttcgtttatatagtcatccctcaatagatatttgggttgcttccatgttttagttattgtgagtaatgctgctatgtatgtgggtggacaaatacttctttgagaccttgctttcagttcttttgggcacacagtcagaagtaaaattgctgggtcatatggtaattttagttttaattttctgagggactcccatactgttttctactgtggctgtatcattttatagtcccacccacagtgcacaagtattctgtattattctgttctcacactactgtaaagaaatacccgagaatgagaaatgtataaagaaaagaggttgaattggctcacggttctgcaggttgtacaggaagcatggctggggaggcctcaagaaactttcaatcatggcagaaggtgaaggggaagcaggcacgtcttacatggccagagaaggaggaagaaagagacgcgggaggtgctacacactttcatataaccagacctcatgagaaccctatcacaagaacagctctagggagatggtgctaaaccattcatgaaggatccactaccatgatccaatcacctcccaccaggccccacctcccaccaggccccacctccaacattagggattacaattcgacatgagatttgggtgggtacaccaatccaaaccatatcaggttccaatttctccacattctcgccaacactggtgttttttgttttttgtttttgtttttgtataatagccatcccaatgggtatgaggtagtatttcattgtagttttgatttgcacttccctgattagtgatgttgagcatcttttttattattattctttcaacttttattttagactccgggggtatatgtacagttttgttacataggtatgctgcatacgcacctctttaagtctcacagaactccacaatacaggtactattacaggcacagagagcttaagtaaattgttcaaattcacacagtgtgttgggctggaatgtaaatctagggaccccaaatcatgagctctggctctgaatcgttgcactagactgtctctctcaatacaaaaaaaaaaaaaccctactaagtgtaatgtaatgacacagagttagttcttagtttatgttaactattgttatacagacaaaagagaaatcagaatggagagcaaacaattaaaaacaaagaaaattctaaaattctatcaaccgaaatctttacataagcaaacaaatatttttattttttaataacgtttggctggctaaaggtaaacagtaaggaaacagaaaaagttgaatatgttaacctgataatccaaagtgtagtttatatctatagatcaataaccaaaatagcattttaaacaagtttgtttattatatgtgatagcaaataattgagagagtccttatttctcaccaacaaaaagttggtagaattatgcagccattgagcattatagcttcaaagactttttaatgatatgaagaaaatactcatgaaataatgtgacccgattacataaagacattcatttattgattcatttattttaaaaaagtttgagtacctattacatggtataggccctagtctatgagctggtcacatcatccctctccaaagagtatatggtctagctttcagtgcaggctttgtaaatagactggcagagttcctcttctagggcttagtttctttatctacaaaataaagaagttggatttgatgactgatacggtttggctgtgtccccacccaaatctcatcttgaattgtagctcctataatccccacatgtcgtgggagggacccagtgggaggtaattgcatcacgagggtgagtttttcctgtgctgttctcatgatagtgaataagtctcaagatctgatggttttctaaggggcagttctcctgcacatggtctcttgcctgctgccatgtaagatgtgcctgtgttcctcctttgccttctgccatgattgtgaggcctccctagccatgggaactatgagtccattaaatctctttttctttataaattacccagtcttgggtatttcttcatagcagtatgaaaatggaccaatacaatgactgtcaacatctctgcaacaactaagttctacaagtggaaacaggaccctttattcagtcaggaataaaacattatttgatatatctgcaaagctgcaactcaactaaaattgtaacagcaccataaacctattaatgttagttctatttagaaccgcccaccatcttggtttatccaagactaaggtgtgacctgagatgttgagatttttaggactaaaacctggagattcccaggcaaactaagatggttggtcactttagttctatgtcaaatttttaagcttaaatgcaaaaactagttttaattacagaaacgtcaattaatcccttttttgtgttgggatgtttcatatgcagtaaacaaacaaacaaacaaacaaaacccgagaagaacaggaactacgtatatgtagtaaacccactcattgtcaaaaattcttagagaaacaatacatttggtatgaaagttaacaatgatcacaatagtcacaaaattttaagctacagtcatcaccctctaagagcttggtggtggttgttttaaaatcataatttcagttcagaaattggaaagaactctgactaccggtactctattaatatttcaattagagagagacatattttcaactttgaaaaattgcagttttaagaggcatatgataattttcttttcaaaatacagatgttcttctaaagattattcaaatacgactgtcttctgaagtttcatctttcttttttttcctcatttaccacatagatcagtacaattaggctaacaccaatgataatgttccttcaaaccaaagctaaagaacctcaaggggctggtaggggaatccagaggggtttgtagtgtctcaacacagccaatcgaggggcaagaactctttacatcaacaataagaccttgctctcctgggaactcttgggctcttgtctccaattccgttctccttcaaaaattccaaggtcttctaccacaccttaataaataactattaagtgcttttttactaactaataaattcaggatcccaggactgggtgagctcattaggagtaattcagatggatttgagctctttaagcaagaagcaagtaagagatttggttatgctggttcattgattcctcttcgtccaatgatgcaaaaatgcgtgtttcctcttcatccatcccaatgacaaggagcttttaagtgtcagttaacaagacagtcccgaaacccctttgcagagttaaaaaagggtaatttctaaaatttggaccaattaccaattcaggcaattcagcaaatttctaataattacaccacatttcagactctttcataattgtcatgctcatttttcctcttctgtccacagcaagccccatcctctcacccaaattccttcccccatccctgacacacatttcttcctaatgataatgctcttctctctgtctggaaccaaatgcatgcagtggtcaagtagaaatgggaaaagctgcctttctcactcttgccttggggaagagggaaattagtttaaataaatgatatgctaatttgaaaagaaatgaatcgaacagtggagagacagagtccatttcctccactggagcagctagtgcctttgagatattctgtcacatgcggaatcattatcccacctgtctgaattgatgtcttgttttagtcttcaatacctgcctaataatgcctagagcttacatctgtcgttgaatgcttactatatactaagcactgtcctaagcattttacatgtttactcccacttaaccatcacaatcctttgggataagtactgatattaaccctactttagagccaaggaaattaagccttaaagagataaagtgacttgccattagggacacagctcataaattgcagggctgggacctaagcagtgttggcctggtttcaaaattcacaccttggtccctgactcacaccattctcatgaagtctcttccaaaacctggaggctgttctagatctggcctcccaagagcaactctcaccatcattaattgctccgactgctcctccaagacctacctctgtaaagctcctccttgaagggcacaacctcatctctcttccactcccaggaaggcaggctggaaacctaatagagactccctaagaaacctgcattctatctttccctgaccattcaatttccgtacttccaccagagcccaacttctatcagacaaactccatgctatctgcatgctaactccatggataatctgcatgaaaaggggggaaagagacaaaatcatgttacaaaacttgggcaagggtctagactcaacttgctttgaaagatcttaaatcttcccattcatttgtagacagcagtgggcctttttcttcctctgctctgcacgaccttctagcccaagtgctagtatcaccttttcctaaagacttttaagacaaactgtgaccatttatgtctacatgacacagtttcaggataacaaagtgtgaagacacacaaagacgtcaaacatttatcagagacctaagcgaaacgccaataaatgttacagggatcaagaatatggttactgacattgaatgtatcctgtggctttgaagaatccaaaggatgattctcgaataatgtatccttccaaattctccagaagttctaagtttagacatcataatgaaatgtcaccacgttcctctgccagaagttgttcagtactgaggggctaatgatgctttcgcttaaagccgattcccccaataaagggtgccaaggcttttctgaagccctgcttccggctggcgactttgaagctgagacgcaggttcacgcgcagtttccgaagacctattccgtccccaccctcctccccttcctcggagacacctccacttaacactgccttctcagtccctcgccgcctgtttaaacacaacttccacccctcacaaatcagaaagctgtaatttcaaagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatttcaggggccgaccaggggagggaggtgcccggggacggggagggaggagggctgccgggatgtgaaccggggaaggcagctggggctggagagcagcgcggaaagggggcccagggagctggaaagagggccaagaggagggcaaggaaggtggcgggcgacggggagaggaaagaaaaagggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgtgggcggccgccgactcggcgcttccccgccgcccgcccagggagtccctgcctggcaagctggggctcggggaaaagtccagcagcgagagggccgcgtgtcccgggacggttccaggggagcccgcgcggaaacgcggaccaggcgcttcggcccggatgccggatccaggagaaggggacctcgcttgccgtgtccaccgccgcggccccagcgccaagaacagagcctggccgtgagtgaacgactggccggggtacaaatggttctgaagcacttgaagctcacaggcaaaggctaagagtctaaatcccatcccgccgtaagtattttcattcccaaacctaaatcgtaaaggaaaagtggaattctaattgggtgagggaacaggtgctgccgactctggcttttgcgtggaggattttctaaaagacaacatgttttgttttgtcttgccatgacaatctaaatcatgttagtggaataggctcattatttcatttttaaaagctagggctggaggagtggaaagttcaggaaggcactttgatcagtataaatctagagtaaaagtgttattggctccagggccatatgtgtcccgaagtctctgatttgcatgcaaatgtgagcggatcctggcagatgtctggcctcatccattcacatgaaggaatttgaaaagacaaggagtcttcagttaacaatagaccttaagaaaagagaataaagacgcagtgtgagtttttctgtttgggaattccatggtttgctgacacctttattcaggagccaaattctttaagtgctattgtattgaaagctcaaagtgctgcttgctctttacctggctgtatatattcgtgcaatattcaagctggatattctaagctagttaggaaaaggtttgtgtgaagcagacagtaactttaacccacttctggcggcttgaagtgatttctgaattgacccctcaacttttcgagttttcttttaataatttgactcttgctcaaatttggtcctcatcttcagagctattcattatagtagaagatcgttgtcgttgaccgacatgaagatttcctgagaatgtccactgtctagctgagaatgtccactgtctagccaaagtcatttcggttcttaaggcaccaaactgtagaactgcaggtgatgcaactgtcccaaccctagttacccgagtggttttcaggtcacataacagtgaacggggaggtagtcgtgcagtagactctggagcaagggcctttctgccgtgtctaacattagctgcgtgaccacactgcactgttcacctcttggcgttgtgcgacagctgaacaaaaggcaggcagtgtgggccgcacgtgaggcaggcgattatattaatacctacgactaaccagccccagtggcctcttcttttgtcaacctcaaacactgttgaagggaaaaagaacctattcacggaacagcatttgccccagtattctatatattcactgaaagggacattaaaatacaacacccccccaacccccgccagaaaaaaaagacaacattgttttggagggctcagtgtttcgggggaggggtggacaacagatgttagtctgctattttacatgttcctttaagttatttttgcaggttcagtgccttttatacataaggcaatattttcacaggatggggaaaaatgaattgaatcaaatttaagtaagaaaatgttatagccaagtttgcattttgtgtcttagagctatatagaagtcagaaagtaacaaatcattctaataaactcttaatttgactctacacgcctgatgtcttcctgatagagttgaagggtaacttaaaataaacttgacatttctagactataaaccattttgttgtaaagttatctagatatttttgaaacctggtaagttaaaaatgaccctcacatttgtgaaaccttatctttggcaattaacctgcctgtgtaatcgttattctgcaagtctaatgaaaggacagattagaactcattccttggtaaataaaactgataaagtgtttaattattagaaaaggatcattctgctaaataaaagatctcaagaccagatccaactgcagactgtgtttctaaaacataacctcagctagctctggttaatgtctgaaattctgggaaagcaaggaaaaactcaaccattgatctctctctggttagtctgtgctaaggccaccttcttgatctaaactgctagagccattaccacatattctaaagcagtgacactcatgggaatatactaggtactaaagaaaatcggtctctacggagttatattgctacttcccaagccagtggaatataaataataatgataaataatcagaatggtgggctttttataccaccataagtaggccataagtcataaataaaatatggtaaattataggatgcagatgccagttttacgagacttgcacaatgcttacttaaaatttatttttaagttacaaaataatagttccccgaatgattcatttcagcactaatgtcaggttattcaaatattgtatttaattttaaaaaattatgctgaacatctgttttgggttaagccaatctggagataaagcaaattccattgtagaatcatatgatcatttagaatcatatgtttctgggaacaatgaaagtatctttaactcatgaatagagctctgattaatatttaattcaggatgaaattatatggatgaagtcagaaaaacatttattctctcttgttttggctcaaagtacagaatagagataaaagttaaaccctatctgtaaaattcaatactttagtgaccaagggatccatttgttctaaaggtctttttaggtgaagtttgctttttaatttcttgttttagcatatattagcattcacctgctttacagatctgttacagaatgtagcctcccgagttctgaaacatagataaatgcatgataaatggtttattgacattgcattataatccatgataaaatgataaatgtttccagactttatgggcaccctgtagaactgttaagcatattatccaataattaaaatacataccattttatgttacagttttttaaaagaaacaatatgcaagctttactactatttatattttctactttttgaatgttttcaaagctctaggcaaatgtcgggagttattaacaattttatcagttgattggttggttagcaagctattatccagtcgtagctggatgatcttggatcagttgcttaaccccataccaaccttcaattttgtcatgtataacataatcgagttgggagaataacgctggaaggactaactgccataatcagtgagattactaaaaggtttatgtaagccatgcctccagtaccacaattaacatcaacatttaacttatatggaaccattgtacctaatgaactgaggatcattcctgagatgcggagaatctaggggtgaacttggaataatacattcccaaggtcctgtccactctgactttagagtaccctctaaagatgctgctgtatcagcttaagacacttagttttaaaatctatggagtgaaaactgcttttagagtggcttattgccttccatttatactctttattgctcagaggttagagtgttatttgaaagctccgattaatataaatgagttgtaattttccaacccaggctgtcctagctcacatctattataccactggcagacatgtggactccacagctgtcccctcatttgtgtatgaaacagacacactggtggcattttttggttaccatagttacattaacaatgtacatgtgacatccttctatgtgaaaggtttctgtggcagatattttgtagaactgggagtaaaggaaaactatttaaagtttggggaacacataaattagtctgccattgtattccggagccaccatttcaatccagggaagagagccatcctacagtggtgtccaggaaaggacaatcttggaaacaaagattttcaagggaggcatttccagcaatgcctaacctcttcaggagagtgtccatttaatattcatttcaaaatatttgctcttcctatttgtgactgccctttgtgagataatgtattagcatagtcattttcaatttgcagggggacagtgggcagcaccaatattagcacctatctcagtaagacctaggaaacaaaaaaggagtttgcactattaagcagtgagccacagaaagaatcatcctttagaaaaactaaaaaagctttaaaagagagaaaggtggcttaattggtttcatgcctataattttcccctctagaaagaaaaatgttagcatggcaataaagaatatcattaacctgcattgttatttcacaatagtgataagtcttagtttgcatccataataatcagtgtaatcaagtactgtacagagaatcaggaaggcgcaggctcaattcccagcaatgacactaatgactcaatgtctgaccttctggatgtcctgcaaccatcccggtgcttcatggctctatcagagttgtgcgttaaaggatccaggaacactggtagatgatttcaatatcaccagtgcgaataatttgatttctgccccaagagctagaattatatggagagctaatggtctgggtacagcccctacctttctgcaaggtgatgtttctggtccctaatcccatagctaagagattttgttgttctttttaaaattttctctccctagcattgacagtttctcaccacctcacctgggcccgcttgaggggaaaaattttaccaggggtacaggaagccatttacaatcattaaacatttgttcacctcacaagtatatattgagcacctgctgtatgccaggcattacagaaggcagtaaaactgaaataagttagcttgatttttctgcagcttgtacattggagcattttgtttccatcaacctatgcattctcctacaagtatttattgagtgctctgtaggaaaaaggcactctgcacagaggatttcaaccaagggtgatttttgcctctgaggggacattaggcaatatttggagccttctttttgtcatcgctgtcacaagtgagggtgggatgagggtgttataccggcatctaatgggatgctgctcaacatcctaaaatgcatagcacaggaagccccacgacggagaattatctggtccaaatgtcagtagtcgcaaggatcctgcctctgccctcagtgagcttcagtctagtcggggttacagaaaggagactgacaagtgcagcatagcgtgctatgatggtgggagtgcaggctacacaagtacagaagcagcagccttaactcagatgtcagctgccagcagaggctttaagaaacagactggttaattcacagaacaggctttcacctgccacacaagtgctcagcaggagacgattttccatctagcctctttgaacataagggggttggatggttgcttgagagagggtagactccttaagtttgtcaagaactttaaactgaagatggagttaattccttgtaggagttggtcagaattcagtgtgtcttgagtaaacgggagaggaggctggaaacagagagaaagtcgatagcaatagacataggacagcacaagctgcatgaagagaagatgcagctgagttgacaaagctgtcactgcctcatattttagagctttaaactttgccaaatccttaaatatttatctcatttgacctataacatcctgagaaaccaaatgtgattgttctttctccttttccccagtaactgagggacaagagtcatggagaggttcattgtgactgtggacaagtcactcgatgaagtttatctgtaaaaggagaggtcttgtgaggctcctcttcccagcacaagttgaatttgtctagggtcacccatctagggggagactggaggtgggataagacctgagactcctgtctctctcagacctagtgtcttccactcagatggtagcagcttcctagaccgtggagtcctaacaggtaacaagctgacggtgactcagcatgctagctcttgggttaccgaagaaagcaaggacctacgatgcatcggttaaaaagtatcatgcagagaaacttaagctgggtttcccctatacctaaggattaaccacgccccctacctaatggcttatcttaagctgaccttagccacttaaaaaaagacttgtgacaatctgggaagaaaggttcataggagagtgcagctagagttagaaaacgagatagaaaatgggacaacccagaacatgtgggaagaatggactgcctagaatagatgttatagtggtatcattttctgttttcattgatttttgttttttctttgataggagcgttttaactttcctatcagagaataatgaccagtgtatacagatatgcacacttacatgcacacacatcacacatatagagcaggggagacagatttcatacaagtttatgtttctttcttgtttgtttagtaagacttgcacgtcagaacgagttttggagagaaccttccctcaaggtcttatttctggtttctctgggataatgagtgtaaggtttcctatgagaagtaagactgagaagccacatgactactcaaggttcttttcattctctgtggtttccaggatcaggagtgagagttaggtaggacttcaaccatatcctgagagtttccaggacacatgtggaatctacatgaactcatcagaccatcagagaaccataaggacagtggagtagcaatgactggctttctccaggttgttattccagctgactgtggttctgtgcagtgaggactacatgtaaggcctaaccccccaaaggaccagttagctttgctgtgttccacagggacacagccagcctcctcacgtactcagaaactcatcctttctcatggggaggccatgtgaaaaatgtaggtcacttcaaagccatctgaaggcaaaacacaaaatatgtgggcaaaggctggtgggatatgtttctcttcatgcattcattcacactgtcaaattggagtcctggtgaacaagttcccaaatggcttcactaccaggattgagcactggagcggagattagttctatgcaaatgagatgctttagtgatcgagaggaaaatattacatagagctcccaaattctatccccagagcccaccatttttcctaacgtagcatacagtagtagcagtagaataatgatactctacactgtgcctttccaatgtgttgggacccatcaccaacaccttatgtgcattaactcctttaatccttgcaacaactctgtaatgtagacacccactttatagctcaggaaactaaggcagaccgcaactaagtaccttgcccaaggtcaaacaactagtgtgtatgtaataaatatttgtcaagtgaatgaatgaatgaatgaatgggtacacatctgttttagaggagagagtcctttatttgaattctcagtttatggcattcctgctttccaggcagagcattttcaagaactgcctctgtgacttgtgaatgataggggaagagctggtcggtggagaagcaggggttgaacttgggtctgtctgactctaaacctgtactgttaaagtgcttggctatatttcttcctctttaattgcagctataaaacaagaggactggactacgttagctctcttagcccattccactcaaaaagttacataattccatattaaagtctatgtaaaataaatcactttttttttattttactacttttaattttgaaatctagtttggtatttttatttaaccaatcattgaattatcttttaaaattatattagaattattaacagaacatatttataaaccctctttaaatcattttaaatggatgagaatgcatagttacagattgcattctcctaacccttaccatctcactgcctattaagttatatcatcattgtctaaatttaggtgtctaaaaattgaaaagcatcttttgttacacagggaaaagacaggtaaagtgattaattttgaaaaaattactgccgatatttgcagaaataagtaggttgctgaatctaatgaatagtattgaatgatttttttttctttaagatggagccttgtttctgtcgcccaggctggagtgcaggggcgtgatcttggctcactgcagcctctgcctccggggttcaagcaagtcttgtgcctcagcctcctgtgtagctgggatcacaggtgcctgccaccatgcccagctaatttttgtatttttagtagagacagggtttcaccatgttaaccaggctggtctcggactcctgacctcaagatatccacctgcctcggtctcccaaagtgctgggattacaggcgtgagccactgcccccggccatgaaaagtattgaatgatttttatgagcttcaaactgctagcaatattaaaagctactacttgagattcgcttctaaggattgttttgctttaaggtatcctcctgacatgcaagtgaagcatcagagcaatgtgtcagtcattgccgtagtgttacaggacatgcagcccaaggcaggggaaggagtgggtaacaaggcatgtcctagatttgggaagagttagtttcagaactgcttctcagctctgtgatctagagtgatttcatggaacctcagtatctacatctgcaaaatggggatgataatagagcccgcctcttagaatcactagaatcattcagtgagaacatgcatataaagtccttagcacagttcctcttccaaggtacatacttagtatacagtagcaatgagtagaagtggtatttgtgttcaaatctgacatttctgcctgctacaaagtctgcattctgaggatgctaattctgaggcaagtggagagattttaagggacaagaagactcagactagatattttatgaagtccgtagttgacatggttgtcacctttcgtggtggacccctagagtgctttatgtttgtctagacatgagaaatatggattccactgatgtgctttgaaagaattggcaaacaggtgaatacattagagccttttttgtttgtttccagattctcttctgtatcccactctctcttttctctctgaaaatattataatgcccctaaatggtgattcatggaatcacattttctaaataaagagaataggttaggttcagagatatcattccaccaagaggagctgaatttaagacattgtagcaaacaaacccaaaagcttcacctctctgcctccactgtgatatgaaggttggccatgtaaaactcttagaacaatgctgagcgtgttgtaaatggtccatagacaatgcagctaccattgttactgttaattcttagtatcatcgtcatcatacaatatcatcatcttgtatcttgaccaaaccacaaggcttctggttaggaccagattagaacagtgcagtttaaccacaaatctttctggaagcaagagaaagtcaccaggtatgctgggcatggtggtgcacacctgtagtcccagttacttgggaggctgaggtgggaggatcacctgaacccaggagattcaggctgcagtgattcctgatcacaccactgtactctagcctgagtgacaaagcaagatgttgtctctttaagaaaaggaaagaaagaaaagaaaaagagacagtcaccaggcaagccaaatcaggtgtgatccttagggagatgaacccacagaggccagttgctatgagttggcctccctggcacctcccgtgttttagctagctgattttcacttgcacatgaagggaagagttgagaataccattaacttgattttctttgaattctttgtgaaatggaaatagtaattatttgtggagaacttcattgtcttgtttaatcctcgtcatcagtgcttcccaattgctgtgaccacatttacaggttaattgtagatatccatactcttagctctgggggaaagccagtaccacacagctggtcacctggctacccttgcaggccaataaatagagttttctaagtgtgctgagaggaacacataccaactctgggagttatgtattatccccattttaaagatgtggaaaaaaaaccctagacaaggatcttgcccagtatcgtacagctagtaagaagtatgcataggaacaatactcttaactctggttttcctccagactgagttagtcacattgtccttgatcttcccacatctccttgtcctcactcaagtctagcatgtgttatctttatttacatcctgtagtaccaccaccaccaagcagcttcgtaagggaaaaggctatgactgagtcttaggtccctggcacctataaaagcatttggcacatggaaaatgtacttagcaaatattcagtcgttgaaagaggaaaggggcttccgtatcatatgtctatttcattttgccatattgctgctttaaaataatttgtacaaagttatttcatctgtattttggtagaaaatgagtagttcataaacctgtattatactcagagatattactatgttactgctttagagagcttattatagaaagttgaactcatttgggaatgctttttgtgatattattgccaaggaagtgttattaatcaaaaagtattcattaaatgcatgtcgaatatcaagtgctattagaaaggtgatatgagggttgaagaaaatgtacatggtgttatttctgtccagatgagcttccagactcattggggaggtagagtgaatagaatcaaatcaaaataattaagtgatcatctgtaggaattctgcaacaaagcagaaaaacaggggctcagaccagacgggtttgaatctcaactttgtcacgtaatagctgtgctcagtattggttaaaagactcaatttattgaccgcaaactcatctgtagaatggaggaataatgtctacccttagggctgctatgagaatgtatgggaaagcacttggtacaattcttagaacatgacagtcattcactgcaatcatttggcagatatctacagccccacttgtgtgcagatctttttctgggagtacagtggtgagcaaaacagatgatgtgtgttcctttcccatgtggagcttgctgtctgatgtgagataaaagcaataatccaattatcacacaagtaaatgtaaaatgatggctgtgttaagtccagtgaagaagaagtacacgaggccaggagaatgtaacataaagccttctaagagaagaccttcctaaagaactgacacttatttaagccaaaatctgaaggtcatgggagagttagccaggcaaagcgtatggagagggaagatctttgtaagccaaagcccagaggtgagaaggactttggtatgcttgatcaacagggagaagaccagtgtggcttagaatagaataaaagggtactttcttttctgcctacttccaaagtgcacttggagttcagagaaggcagaacttgtacaaagttcagcgaaggaagagactgcatcctataccgaagagatatgtcaccatgacagaaggcttgaattggtggagagggaaattgtgtgagtaattctattgagtcttggctggttaggtggcatgtcattgtcttacatgtgtggactggcatatgccaagtcgggcacaccaggaagaaagtttctcctccatttctgtgtggctttgagcatgctgattaacttctctgaatcttggttgtaaaaaaaaaaaaaaaaaaaaagatgtagcaccacaagtttgtgaagtttgtgggaatgggaagatataatgcatgtgaacgtggcacatagtgtctagtaagttagcttagcttattttattttctgctcctcataacctttttctccctgtactacactttcctttcattgtagtgaacctctcattatgatacttgctaactgagatcacatcacctgtgttgctcacagatacagattttttatagtagtttggtgatagccgaaacatttctcttgcttggcatgcaaatgctatcattctcgttcatgaactcattgtgtaaaatgcacttagccacatctggctgctgttcgcatgaacagaggtgactgctggtgagtggacaagatccttcacaagctttagatggtaatttcgtcggtgctctaatgaccataacacttagttgttattgatttgtcctcagtggagagatgtacttttctgcctgatcttaattatggttcataatattagatcatttcaacactgagttagcattttgcccttgtaacaatttgttttagttccatctttgtattgacttataagtaaatttagacactattaccaaatacttatcagaaaaagatagtgggggtagagtgggttatttttcagcaagatgctgagttatcctttattacatgctttatggcagtaaatcttggactcccttgcacccttttattactaacctgcttttctgtgtcccttgagatcttaagtcttctacttactagattatgagaaaaactcccaaatttccctccaaccataacctcacttccaaactccagtcctatatttccaaatgcctgctggatattttcaccctgaaaatcccaacatcaccgaaggagcaagaggaagaggtggtttccaggatgcagagtgaactgtggctgtacaagaggagagagaacgtccttttgcagaggaacgaagcccctgcctattgacccagcagggagggaaccaggaggagaagtactccagcctctcttttcccaccctcttctaatcattcaaatggaaactcaccccactcccaaaatgagctcctgccattgctggcccttatcttgttttgagaactgctatcatcccatcactcaggctcaaccttgaaattatttgtaacacctccctcccctgtctgcacatctagtcaactgcagtatccaatagatgcctctctagttatatttccctagtgtcttttaaatatggcacttcttctttgttcctgtcaacaccacccgaattctagccctcatcgcctctcctttagcttattggaagtgcttcttaaccagtttctccctatctagtg

SEQ ID NO: 522 - DNA, 81032 bp, Homo sapiens
gggcacccccacaggagacagagaaggaagctgggtgttctccccctggctcctgccacagggtggcatgcatcaaggggggctgggtagggaagctcctgacaatgggactctttcctggtggtggcaccaccaggacagggggaggccccagcttccctgtggacccttcaggctagcagtggtaggggcttcccaccacctgagctagtgaactctataccctgtccatacctatgcaaatagctcccttatgaaactctcctaacattaccccatccacatgtgccaatgattcgctgatttgcacaggaatcaatggcttggaagaagattctgaaatcaatcatggaaggcttaggaaatgctgccctgcccatgctcctgatggcacagaggccgacatcatgctgcccgtgctcctgatggcacagaggccgacatcatgctgcccatgctcctggtggcacagaggccgacatcatgctgcccatgctcctggtggcacagaggccgacatcatgctgcccgtgctcctggtggcacagaggccgacatcatgctgcccgtgctcctgatggcacagaggccgacatcatgctgcccgtgctcctgatggcacagaggccgacatcatgctgcccgtgctcctggtggcacagaggccgacatcatgctgcccgtgctcctggtggcacagaggccgacatcatgctgcccgtgctcctgatggcacagaggccgacatcatgctgcccgtgctcctggtggcacagaggctgacatcatgcagaaaattatggacattaatgaatttgagttaacaatagattcaaatgaactgtcactggagaatttctggaagccataaaccaatgtgttttactgatatattcctcttcatgaatgtacaatagtgatacatcattttttaaaatctttgtcttaataagtctacctatctcagtaagtataaagtaaaaatcctgggtgataaagcactttatcacaatttagctgaccacctacattgttttaatgaaacaaagtaatgataaatcatacaatcaatggtattttagattcaataaaaaatgacagtggcttttggcatgagttctgcctaggctggtggtaatactgtgttccctgctttccttctgcagagccatgcatagccttagctatcttttcattttcaacatttctgaattactttattttagaagtctctcttttacatagctcagggttttgctttatgagtgacatttgtttgtcttatttctaccaagaatatatttaatgattttcacaaatccttttgtcatagttccctttgtcgtctcttggttggctgaaatttattctccaatagtttcctaaaggaagagcccatgagaacagtattttctatcttaatgcatgtttaatggtttaatggtgttttactgactttttttttttttttttttttttgagacggagtttcactcttattgcccaggctggaatgcaatggcgcaatctcagctcactgcaacctccgtctcccaggttcaagcgattctcctgcctcagccttcctagtagctgggattacaggcacctgccaccacgcccaactaattttttttgtatttttagtagagacggggtttcaccatgttggtcaggctggtcttaaactcctgacctcaggtgatctagccgcctcaaccttccaaagtgctgggattacaggtgtgagccaccgtgcccagtgttttactgacatttttacacaaaaggacagtttgccttcaactttcctcttttcagtattttgctggtgttgctttgctaccttttagttaaattttgccaagaggaaactagaggctaatcttttacctgccttgcaagtaattttcttttctttttttttcatttttttatgttgttgttgctttggtcgtgctgacttcgaaattctttatcttcaaagcacaatgattttactagaatccatttcagcgtttacgattctagttctattttcctagggcatagtatgcctttcagtatgttgcttgtttttaatttcaggaacattttttgaattaacatgtaaataatcattgttatttttttctgtaggattttaattttttgtgtatcacaactctcatctgatttctgatcatcttttctccctagtccttttaatttttcctttgttcccatttcattgaatttacttttctcatctggcgtctctatccatttgtgcgtcttcaatttctgttcttcctagtgctccttttgatttcattttcttttccttttttcttaaataataattctgagttctctaagctcatgttttctctactgttatttagtcatcatttccttaagttctcaaatatctgatttgtgattctcctgcatagaggttatttattaagtttttttttatcatagagaaacagtcactttaaaaatctgtgctgtggcaacgtgtttctggtgagtgttattcctctattgaaattttgttgcttttcttcaaaatttgtcatgtagtatcttatatcagtgatgccccagctccttcctacctgctattgctttttttccccatcattgaatgacttagaatttgtggaaatttcgtatataaaggaggggtcaagggaaccctcagatttttactgtaaaagattctgccctctgctgccatagaaacagttagattcctgcaagtgtggccagttattgtatttccctctctctccttcttttttgatatctcatttcctctaacactttgagctaagccaagttcaagaagccttctcccttatactctgtttctccatccattgttactaacaaggaatttagctgtatgtttcagttcagctgtatgtttccatcattttcgggaaatgtgtttttctgaacttttccaaagatctgctacaatttagctcaccttcagctcttcattattttactcttcaatcttgcttgcatgcttctgcaggatcttagctgtttctagtatcctgtgcatgcattttgtactagagggaatacatctatctcctagttttgctcaaaatggaggttttccttttacgatttccaagaggagaaagggagagatgatgatttatgcagcaatgctcatagtgtaaatccacttcgaaatgttttaatttgacttattggaaatattttctgtgggaatcagcttttggttaatatactatacagagatgctcctcgacttacaatggggttacatcccaagaaatccattgtaggttgaaaatacgataagttgaaaatgcctttaaaggataagatggtcaagatggtgaaatgcagaagtcctgactcatgtgcaatggccattactgtttgcagcttcatgccgggaagttatcttgagtttcatctcaagaataattgtcttcttctcatcagaagcaggaaacacagaggagtgtctgtagaaatgaagagatgggaaaacacgatatccaaaaaactgcaggcaatacagtccactgtgcagtattggctgttaccccgatggtcatggggctgcctggaagctgcggctcgctgcccctgcccagcagcaggagggagtattggacagcacgtccccagccccggaaaagatcaaaagtcaaaagtggaagtatggtttctactgaatgtgtatcactttggcagcaccgtaaagtcaaaaaattaagtcaaaccacggtaagtcagggaacatctgtctagctgtaggacaattcttgaagaactaattgcagtgctcccagcatggtgcaaatatgagggtaacattcagtttaattaaatgtcaaatcataggatggaaaatgacagtatctttgtccaaaaagcagatgcagaagcagcataatccacagaaattttcaatttcatttgctacccagcggctcaaatccattatatgttaagtattgttccagggcttcagcctccccggcagatttctcctgtttttgctgttgctgcagggactggccccgtcttctgaggaccaggcctccacggtggctgcacacctctgctttaaatacttttaaagttgcagaaaaggaccttcttgaagcaaaaaagacaccgtcctcttctgcatgggccaatgctcaacatacacatgcatggaaaaaaatttccaggaagtgataaactaagcatggggcaaataaaacaacacatgacctgatttcatctccaagtttgctcttgtgtaggaaaagataagcatttctttcaatgttaagttggggtggtatctaataaatcagaatgaaaactcaggtttcataaaagcagtgatttctcttccagagagggctctgaatacattgttacttacttgaacatgctgtccttcaaggtaggagctgaggcagggcctacacctgtaatcccagcactttgggaggccaaggtgggaggattgcttgagcccaggagtttgaggccagcctgggcaacatagtgagacccagcctctaccaaaaaaaaaaaaaaaaaagaaaaagaaaaattagccagacatggtgatgcttgcctgtagtcccagctaccggagaagctgaggtgggaggatcactggagtccagaaggcagagattgcagtgagccgggatcacgccactgcactctagcctgggcaacagagcgagaccctgtctcaaacaaataaaacaaagtagaagatgatatccaagccatttgtgatttgttctgaccttccaatctatgatttaggtattgatttagaatgcattttattcatcctataaaaatctctgccaattattcttttttttttttttttttttttgagatggagtctggctttgtcatccaggctggagggcagtgatgtgatcttggctcactgcaacctccgcctcctgggttcaagtgattctcctgcctcagcctcccgcgtagctagctgggattacaggtgcccaccactacgcctggctattttgtgtattttagtagagacacagtttcgccatgttggctaggctggtcttgaactcctgacctcaagtgatcctcctgccttggcctcccaaagtgctgggattacaggtgtgagccaccacgccctcacagaacaatgtattccttaactttttatatgctttttttagattgaaaaatttcaaaattataagcaaatttaatgcttgaaattggacatcagcattgagctggagaaaaatcaatggttccttctgatgtgaaaggaagcaacaatatataaatacaggtctatgtcttcatttctccttgtaacaaaaatggggtattcagtgttgaaaatttccttaggcaattccccaaacaactacttaaaaatacccagagttggccacttgttctgtgcctacatcagactccaaaaaaggaacaaacactttcagcaatggtgattgaccctcctataagtttctctcattttaaaacatgggaaaatcatcacttctcactcaatagaagaggttaggtttagggccgtgctatgtttattttattgctactatgtaagccaactttgattctggccagaacgatcagcttatgtttatatcagctttaacaagatccataactgttttccctcttcactagcctggctatatgtgggatacaaacttctgtgcttctcacaaggaaaaaaaaatccaatttcaaagactcaggtctaaccactcaggtgactttaaaatcaaattattctatagaattttacagggtgacagcatatttgttgaatgatatgatattgatgtgtacatgaatttttagttggagactaaaatctgttttagaaatagatccagtgctttttagaaaatacttaaatttttcccattgatcatatagttccctaaagttttagctttttaaaaaatctaaatggcattatgcttttaaagaaaggaaagtggaacgtttgattatgaaatgtagggaatgctaatgttttatagtttatgtcttcaagaatcagtttttaagttttttttttgtttttgtttttttttttaagacacagtctcgttctgtcgcccaggctggagtgcagtggcgcaatctcggctcactgcaagctccgcctcccgggttcaagcgattctcctgcctcagcctcctgagtagctgggactacaggtgtccaccactacgtccggctaatttttgtatttttagtagagacagggtttcaccatgttggccaggatggtcttgaactcctgatctcgtgatctgcccacctaggcctcccaaagtgttgagattacaggcgtgagccaccgtgcctgccccagtttctaacattttttataaccatcatacaattgaaacaaggtgcaactggactcacgaggtcatgggtcaatttcctgtgagtgtgggcttagaccgtccagcttgttctcctgccacccactcttagcatggaaggacgaagcgggtgacaatcagccaacatgtgctcaaatagctagatgttcgatactgagtagaaaaatccttacacatcagctgagtttttccatgtttacccatatattttggcatagaatgaactaaatctgtgatttttcagcatgttatggttgtagagttcatgaactattattccatcttgggaatactttgagaagtaaaagtaaattttattattgcaaaagatgcagtaatatttagtattttgttttaaaagtcaaaacttactcagcaaatgcacggcatacagatggtgaagaggtgattcagtaaagttttggtttcaagaaatcctggcccacctaagtaatctccagcatagcaaggtttatcttaaagataaaaaaggatcaaaaggcccttgagaattaggcagctaccccctctgtctccctctccctcgtgcaagattatctgctccccacctatgactgctctctccctttcctcagagtggattcttccccacagccacttgtactggcctcacatggtcacctgtgccccactttatcatggctcactggcccctcttatcattttctccctcccagattattgacagatgaatgggattttcacagtttaccttttcaatgtggctctgtatccttagcaaacctatggattctctgccagtggcagaatagagacagttgcaaactcttttcttctcccatcaaaagatgaagtctgatttccctctccttaacactggctttgcctttgagatttgcttgatgcatagaatacaagagaagtaactcagaagaagaacttccaaggttaggtcagaaggagcctcgcaacttctatctgggtctctggtagaaccacactcttgcccttggaaccatgagctgccactttgctagaaagactttgtgaaaaggctcttggacaacacagataggagaggagtccagctgagtcttgccttcctatgcccccgccaaggtgccagctacaggagtgaagctatcttggacccttcagaccagatcagctatcagctgaataccatccaccatcctgagtcaatgccacgtgcaacagcatcacccacaggagcactacccaaatctctgacccacagaatgatgaaatttaatacaatggttgttttaagccactaagttttagggtagtttgcgatgcagcagcagatgcaacgcctctgttcacagcggctaagactcaaagggacgcaaaccaagcaacctacgtctaccccagcaaggacagtgggtagaaatttccttacagaaaagactgcatgtcatcaggaatcataactgaaatctctcagttaattcctatcctaaatttccctcgaggatataacaaggagaaacagtattaagttacagctagactctggtgggatttagattaaaaatataaaagtacatctagatgctagatgagactagtgacgtcacgaaccagactgaaacttaatcacattaagaagcaggtaatcatattcaaacgagatttgtacttggtaacttaaggataattacatctcaaagccaaggactatctttgtcaatctcatgttttcatgatcagctgaagcagagaaattaatacattttaatgatgaaacttagcctacatgtattttgtagatattcacttagaagtgaaaaatatgatgtaaaatcagttatgtgtagatatttttggagaaaaaaccttaaaacttagaaaccagttacatagtcattattaacttaaaacagatcatactgatatatttctcatatttcatgcccttccttaaagacaatgattttttctcaaacatcaaacatttcagcctttacatatttctccagaaaccaccacaagcatccatatagtgtgtttactgtcaggtttattctgacttgccttcacaacagttgactctcagtttagcttgttgattcacagaaaaaaaaacctgaatgccaccaagaaatttccaagaattgttaaaaaaaattaaatgtgaaaagaagaacctctgatccttactcaatgtgttctctatttttccctcggactaattaagaaaagcatgttaattataatggattccaaatgtgctaacctccagttagtattttttaaagtattgactattttggccagtccaagattgcctattagattataagctcctctgagacccagaggccatgcctttgttgtcattgaccagaaagggagaaagagtaaatctctgttcattttggggggtgtgataactcccatttcaggtgtgctgaaggtggcagtgatggacatttgctgtttttaccatctagcatctgtttattgcttttttctctcttttttttttttttttttttgagacacagtctcactctgtcactcaggctggagtgcagtggcctgatctcggctcactgcaagctctgcttcctgggttcacgccattctcctgcctcagcctcctgagaggctgggactataggcacctgccaccaagcctggctaatttttttgtatttttttagtagagacggggtttcactgtgttagccaggacggtctcgacctcctgacctcgtgatctgcctgcctcggccccacaaagtgctgggattataggcgtgagccactgtgcctagcctgcttattgcttttttcaaactagcttctccttgaggagaacagccttccctatttcatccatctgatttgggtggacagaagacctacctccaactgcaaggatgagacgtcacgggcttcagttgatcaacacagctcagcacctttgcagacagatttgcttagaaatgtccaaatagtctatagccaaggtggtatgttttagggcttctgaataaataagagcttttattctccggcttgcaggagctcctgaaaagcaatctccttcttctcctgagtgtgatgttgaagatctgtaactacagtcgccagtttgccgccaggtgggaacaccagttgggaacaacacgggcctgcgagggatgccgctgaaagcaggaaagattagtgacacagacagaagctggacgaagtctcacctcaggtgcacatctgggcttcgcaattttatgaacctgtaagttctctgattccaaaggtgagttgtattttggcttatgttttgcagctgaaagatttctaacttcttttccaccacagaatctttgaatgatttagatataaacttcaagctccatttaggtcagtgatttttgtctgtattgttcactgatgaatcccactgccttgagcacagcctggcaatattaggtgctcagtgaatatctgttgataaaacgcgcaaagttggttcagcctttaagaagatgaatgttgttaataacacatgcctaatgaaagaatctgagtacatattcctagaatacacacataaaatttaaaacacctaaaaatgcttaaatacatttaaaaaaacaaaaaacaaaactataacgattggtgagattcagccagtagtgtgttggagctggcttgtcctggctttggagactgagctgtatacatctcctcctgattccgcatccagtgtcttcatgttggcagcctgaaattgaccagagggggcatttataccatggtaatcggcaaacactgcaaatgaggggtttatttcctctcctctgccctaccctcccagagagccagttcagcattatttttcctagaaaaaccttttagtgaggtgaacactttcttttaaaaaaataaaatcttcccatttcagagctggaaggaaactctgaagttttcgacttcggtatcctaagttgacaggcgaggaatctctccatgagctaagttacggaggtgacagcacaccccggaccctcaatttgcaagatccaaatcacacagccactccgcaagaaaaagcgtgggaaataatccaaacacatgcgtctctagcgagatgccaggcatttgttggggaaaatatgtccctccaattatatgatgtcagggatcactctagatggggtttgtgtgggtcaaatgtggtaccaggacccctagatctggccaggcctatcccaggctcactgtcctgcagggactaaatacccagccgcagcctagtgtgctatctctgtaggttgtgtgaaatgactcaacatttcctgctctttctcaaaggtaaactcacaccagcccttgcgcggcaggccaattctccctgacgatcacacagacaggcctgcatgacggtcacacagacaggcctcctgacgatcacacagacaggcctcctgacggtcacacagacaggcctcctgatggtcacatagacaggcctgcatgacggtcacacagacaggcctcctgacggtcacacagacaggcctgcatgacggtcacacagacaggcctcctgacggtcacacagacaggcctcctgatggtcacacagacaggcctgcatgacggtcacacagacaggcctcctgatggtcgaacagacaggcctcctgacagtcacacagacaggcctgcatgacggtcacacagacaggcctgcatgacggtcacacagacaggcctcctgacggtcacacagacaggcctcctgacgatcacacagacaggcctcctgacgatcacacagacaggcctcctgacggtcgcacagacaggcctgcatgacggtcacacagacaggcctcctgatggtcgaacagacaggcctcctgacggtcacacagacaggcctcctgacggtcacacagacaggcctcctgatggtcgaacagacaggcctcctgacggtcacacagacaggcctcctgacggtcacacagacaggcctgcatgacggtcacacagacaggcctcctgatggtcacacagacaggcctgcatgacggtcacacagacaggcctcctgacgatcacacagacaggcctcctgacgatcacacagacaggcctcctgacggtcgcacagacaggcctgcatgacggtcacacagacaggcctcctgatggtcacacagacaggcctgcagagcgctccagttacacagatagatttccacagcacggccgtcacatggaacgaatagttaaacctagggaaatcagtgcccagacgtcaaagctagaaatgaaacataagacggtcagtaggagccttacatggccttctccctaacctggagcaagctgaaataatagacagttttacattcctagtgccaggacccgtctcgggtcgacaaaatctgagacgagtcaaggtaacagaggcagctgtttgaatagattcattggagggtctaaggtagctctctgggccaagctgtaaaggagatgaagtagaaatgatcactccggtgccacagtagacgggccttgaaggtactggggcctcacagctcaatcgaacttaggaagcatttctttgcctctgaccttctagttgaaacaaaattcgttaccaatagacttaggcaatgctatactgcacgcaggcgcataacctcaacctatattagcactaagaaaattgtaacactttgagttggtctggtggaattctctctggccttctccctgcatccggttacagcaataaattcccttctttcctagtttgtctgcttcttattattgggccccaagaaaacgcagcgagacccagcttggttctgcgaacacttgtgcaccagaatcgaaggtaaggcaataaaagaccttgatctttattatatcctgcgagccaagaataatgactgtctttttctgggaaataaaataaataaataaacacacataagaagagatggagaaaattatctcaaatttccaaaaaaaaaaaaaaaaaatctcgttttccctcacctgaagatgataaaacaaggcattaaagtagcacagactgatgatcctggtgtaatgcaggctgtgtatcttggttttccctgtaaggtaccctgccagctcccagctaggactctaggcatcctccacactcctccctgccccaggcacgtttccttgatgctgcgaggagcacgtggaaggaataagggcattgcggttcactgccgtcccagaaaagctgctgtccctgtcgctgatgtctaagagtagtctggcactggctgggagtggtggctcactcctgtaatcctagcactttgggaggccgaggcgtgtggattgcctgagctcaggagttcaataccagcctaggtaaaacggtgaaaccccatctctattaaaatacaaaaaaaaaaaatagctgggtgtggcggcgtgtgcctgtaatcccagttacttgggaggctgaggcaggagaattgcttgaacctgggaggcaaatattgcagtgagtcgagatcaagccattgcacattgcactctagcagcctgggcaacagagtgagactccatctcaaaaaaaaaaaaaaaaaaaaaaaaagagtagtctggcacaactgtaaaagcagtgtaaccctgattatgtcaactttgtgtggataaatcaggtgttattttctttatgggattttttttttttgaggcggagtctcgctctgttgcccaggctggagtgcagtgacacgatctcagctcactgcaagctccgcctcctgggttcatgccattctcctgccttagcctcctgagtggctgggactacaggtgcccaccacaatgcccagctaatttttttatattttagtagagacggggtttcaccgtgttagccaggatggtcttgatctcctgacctcatgatccgcccttttacccatacttagtttttgttttccttccagtggaaagaagaaacaaatgccaatctaaaaacatatggagtttctatagtcagtctattttttcttggccgatcgtttgatcagtaataactttgcacttagcatgacctaggtaatgacattatttctatcattattgcattttccctatttggataatcaattaagtcaacagtatttagaattttgctgctcagactgagtcactggaaaaaaaaaaataagccagtgaaaatatagaccccagattagaggcccagtcgggatcaggccgtggctgacgaagtggagtggaagccgcaagaacagggagaggctcctgcgctgacccagggaagtgtgctccggcaggcgctgcatctctcctttgctcagacacccaatgcttgaatgcttggaacaactgtcttcttctttttcttttcttttttttttttttttttagaaggaatttcactcctgttacccaggctggagtgcaatggcgcgatcttagctcactgcaacctccgcctcccgggtacaagtgattctctagcctcactctccccagtagctgggattacaggcatgcgccaccatgctcggctaattttgaatctttttttttttcaatggagatgcggtttctccatgttggtcaggctggtctcgaacacctgacctcaggtgatccacccatctcggcctcccaaagtgctgggattacaggtgtgagccaccacgcacggcttttttttttttttttttagatggagttttgctcttgtcacccaggatggagtgcagtgacacaatctctgctcaccgcaacctccacctcccaggttcaagtgattctcctgcctcagcctcctgagtagctgggattacaggtgccaccatgcccagctaatttatttacttaattattgtatttttagtagagatggggtttcaccatgttggcaaggcttgaactcctgtccacaggttatccacctgccttgatatttaaaaaatatctactgtaaaaatgtgcttagtgaggaacacgtatgcacgctggctagagagaatcaaaataggctctgcatcaattactcaaattagtccagaaactgttctacaaacgagcactggacttggagaagcccacgccagcccttgacatctgggttactacaggaaaactgcctgcctcccagggctcttgttttctaatcttgaaatgaggaattggagtaagaaactctagtacccattcgtattttaacatttattggttctgaatgttcttacctccttgtagtgctgagccagtttctgcagataatctaatatgcatatttccatcagccccaaaaggcaggtctgctggaagagtggaggaaggacaggcgctcatcgagtaatcgccaaggagaggcatttagatattccggctacttaacttagaaaattaatattaagtatcattagcattggcatgattgttcaaatgacattatcaatttctaataaatagatcaaaaactcatgcatggattcagcagttattcagtaggtgtcaaatggtctgtgttcaaatatttgaagtctagcggtgggggtactatttaagacatcacaagacagtactgtatcaacagcaaataagctggttagttcagggaagaggagagttcatctggatgtgtgtatttcataaggtcccgatggggacagcggcactcatacgtggtcttagagaatgtatgtggcttgaataagtgggggagcgttcacaggacattccctgggggctgagatagcgaagggggacaaaccttctcgaggaagagtgcctgcccatctgaacacaacagaagcttcctctgggccagtggaatggcagtgggaagggagcctcggcacccacttctggagacaggacatgtcaagctcaactgtcagtaatgacccacgcataactatcatacttcccaacgctgtgcacacacggcattacccacccgtaaccatcatacttcctaacacggcacacacgacattacccacccataaccatcatacttcctaacaccgcacacacgacattacccacccataaccatcatacttcctaacgccccacacacgacattacccacccataaccatcatacttcctaacgccccacacacgacattacccactcgtaaccatcatacttcctaacaccgcacacacgacattacccacccataaccatcatacttcctaacgccccacacacgacattacccactcgtaaccatcatacttcccacccataaccatcatacttcctaacgccccacacacgacattacccactcgtaaccatcatacttcctaacaccgcacacacgacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacaccacacacacgacattacccacccataaccatcatacttcctaacgccccacacacaacattacccacccataaccatcatacttcctaacgccccacacacggcattacccactcataaccatcatacttcctaacgccccacacacggcattacccactcataaccatcatacttcctaacgccgcacacacggcattacccacccgtaaccatcatacttcctaacaccgcacacacgacattacccactcgtaaccatcatacttcctaacgccccacacacgacattacccacccataaccatcatacttcctaacgccccacacacggcattacccactcataaccatcatacttcctaacgccccacacacggcattacccactcataaccatcatacttcctaacgccgcacacacggcattacccacccgtaaccatcatacttcctaacaccccacacacgacattacccacccataaccatcatacttcctaacgccccacacacggcattacccacccataaccatcatacttcctaacgccccacacacggcattacccacccataaccatcatacttcctaacgccccacacacgacattacccacccataaccatcatacttcctaacgccgcacacacggcattacccacccgtaaccatcatacttcctaacaccacacacacgacattacccactcgtaaccatcatacttcctaacgccccacacatgacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattacccactcgtaaccatcatacttcctaaggccccacacacgacattacccacccataaccatcatacttcctaacgccccacacacaacattacccacccgtaaccatcatacttcctaacgccgcacacacggcattacccacccataaccatcatacttcctaacgccgcacacacattacccacccataaccatcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattaaccactcgtaaccatcatacttcctaaggccccacacacgacattacccacccataaccatcatacttcctaacgccccacacacaacattacccacccgtagccatcatacttcctaacgccgcacacacgacattacccacccataaccatcatacttcctaacgccccacacacaacattacccacccgtaaccatcatacttcctaacgccgcacacacggcattacccagctcataacccatcatactgtcctaacgccgcacacacattacccacccataaccatgcatacttcctaacgccccacacacgacattacccacccataaccatcatacttcctaacgccgcacacacgacattacccacccataaccatcatacttcctaacgccccacacacgacattacccacccataaccatcatacttcctaacgccccacacacgacattacccactcgtaaccatcatacttcctaacgccccacacacgacattaaccactcgtaaccatcatacttcctaaggccccacacacgacattacccacccataaccatcatacttcctaacgccccacacacaacattacccacccgtagccatcatacttcctaacgccgcacacacggcattacccacccataaccatcatacttcctaacgccccacacacaacattacccacccgtaaccatcatacttcctaatgccccacacacaacattacccactcataaccatcatacttcctaacgccccacacacgacattacccactcgtaaccatcatacttcctaacaccccacacatgacattacccacccataaccatcatacttcctaacgccgcacacacggcattacccacccataaccatcatacttcctaacgccccacacacgacattacccacccataaccatcatacttcctaacgccgcacacacgacattacccacccgtaaccatcatacttcctaacgccgcacacacggcattacccacccgtaaccatcatacttcctaacaccgcacacacgacattacccactcgtaaccatcatacttcctaacgccgcacacacggcattacccacccataaccatcatacttcctaacgcaccaaacacgacattacccacccataaccatcatacttcctaacgccccacacacaacattacccactcataaccatcatacttcctaacgccccacacacgacattacccactcgtaaccatcatacttcctaaggccgcacacacggcattacccacccataaccatcatacttcctaatgcaccaaacacgacattacccactcgtaaccatcatacttcctaacgccccacacacgacattacccactcataaccatcatacttcctaacgccccacacacgacattacccacccataaccatcatacttcctaacgccccacacacggcattacccactcataaccatcatacttcctaacgccccacacacgacattacccacccgtaaccatcatacttcctaacgccgcacacacggcattacccacccataaccatcatacttcctaacgccccacacacggcattacccactcgtaaccatcatacttcctaacgccccacacacggcattacccactcataaccatcatacttcctaacgccgcacacacggcattacccactcataaccatcatacttcctaacgccgcacacacggcattacccacccgtaaccatcatacttcctaacactgcacacagggcattacccacccataagtatcatacttcctaacgccccacacacggcattacccacccttaaccatcatacttcttaacgccccacacacgacattgcccactcataaccatcatacttcctaacgccccacacacgacattacccactcataaccatcatacttcctaacgccccacacacgacattacccacccataaccatcatacttcctaacaccgcacacacgacattacccacccataaccatcatacttcctaacaccccacacacgacattacccacccataaccatcatacttcctaacgccccacacacgacattacccacccataaccatcatacttcctaacgccccacacatgacattacccacccataaccatcatacttcctaatgccccacacacgacattagccacccataaccatcatacttcctaacgccgtgcacacatggcattacccacccataaccaccgtacttcttaacgatgtgaacacatggcattacccacccataaccaccatacttcctaacgatgtgaacacatggcattacccacccataatcatcatacttcccaatgaactgcacacacggcacaactgcaagtgttcctacctagtttcagtatcattttaaacattttctagttcgacttggtcataaaaataaagtttagaaattactttgtgccctttttgtagaaaagaaataaagcattttgaaatgttaacacagtgggctgggtccaatatattaaacacagaaactttaatgaatagtagatacacagcaatcttcccagctgtgattcctggagattttttggactgtattcatacctggcattctagacaaaggaggggaaagaaagtatgaatggacaaaaggccaagctaagaaggcagtaaagcttttttaattcaaattgtaagaaatagtttgtttcaacagaatgaaggataaaaaccatatgatcatttcaattgatgctgaaaaaacgtttgataaaattcaacatcacaacaagataaaaaccctcaaagaactgagtatagaaggaacataactcaacataataaaggccatatacaacagacccacattagtatcatactgaatggggaaaaactgaaagcctttcctctaagatctggaacatgacaaggatgaccactttcaccactgttattcaacatagtactagaagtcctagctagcgcaatcagagtagaggaagatgtaaaggacatccaaattggaaaggaagaagtcaaattatccttgtttgctgatactgtaattttatatttagaaaaacctaaagacccacaagactattagaactgataaattcagtaaagttgcaggatacaaaatcaacatataaaaatcagtagcatttctatatgccaacagtgaataatgtgaaaaagaaatgtagaaagtgatcccatttacaatagccacacatacaattaaatacttaggaattaaccaaagaagcgaaagatctctgtaatgaaaacagtaaaacactgatgaaggaaattgaagaggacaccaaaaaatagaaaaatattccatgtacatggattggaagaattaaaattgttaaaaatgttcatactatccaaaggaatctacagattcaatgcaatccctatcaaaataccagtgatgttcttcacagaaatagaaaaaacaatcctaaaatttatatggaaacacaaaaggtctagaatagccaaagctatcctaagcaaaaagaacaaaactagagaaaatcacattacctcacttcaaattatactacagagctatagtaaccaaaacagcatggtactgacataaaaatggacacatagaccaatggaacagaagagagaacccagaaacaaatccacacacctacagtgaactcattttttacaaaggtgccaagaacatacactggggaaaagacagtctcttcaataaatggtgccaggaaaactggatgtcaatatgtgaaagaatgaaactagacccatatctctcaccaaacacaaaaatcaaataaaaagaaattaaataattaaatataagacctcaaactatgaaactattacaagaaacactgggggaaaatctccaggacattgaatctccaggtctgagcaaagacttcttgggtaataccccacaaacacagtcaaccaaagcaaaaatggacaaatggaatcacatgaagttaaaagacttctgcacagcaaaggatataatcaacaaagtaaagagacgatccacagaatgggagaaaatattagcaaacaacccctctgacaagtgattaatgaccagaatatataaagagctcaaaaaactctacaggaaaaaaatctaataatccaatcaaaaactgggcaaaagatttgaatagacatttctgaaaagaagacatacaagtggcaaacaagcatatgaaaaggtgctcaacatcattgatcattagagaagagcaaatcaaaactacaatgagatgtcatcaaatcccagttaaaatggcttatatccgaaagacaggtaataataaatgctgataaggttgtggagaaaagggaacccttgtacactgttggtgggaaagtaaattaatacaatcactatgcagaacagtttggaggttcctcaaaaaactaaaagttgagctatcatatgagcctgcaatcccactgctgggaatgtgcccaaaacaaaggaaatcagtattgtagagatatctgtactcctatgttcgttgcagcacagtttgcaatagctaagatttggaagcaacctatgtgtccatcaacagatgaatggataaagaaaatgtggtacgtatacacaatggggtactattcagccataaaaaaggaatgagatccagtcatttgcaacaccatagatgtaactggagatcattgtgttaagtgaaataagccaggaatagaaagacagacatcacatgttctcacttatttgtgggatctaaaaatcaaatcaattcaccttatggacctagagaatagaaggatggttaccagacactgggaaaggtaatggaggattgagcagacatagggatggttaacgggtacaaaaaaatagaaagaatgaataagacctactatttgatagcataatagggtgactatagttaataataacaattatatattttaaaataacttaaagaatgtaattagattgcttgtaaatcaaaggataaatgcttaagaagataaataccccttctccatgatatgctgatttcacattgcatggctgtatcacaagatctcatgcaccccataaatatatacacctactatgtatccacaaatttaaaaaaatagtttgtggattaaaaacaaaatggaaccctagaaatgtgtaacagtagttgttttacagacaggaatactaaagtagaatacctctgcagtaggtagaatacccaaaaatgttgaagttaatgagaaaagcaatggggaaacagcagacactacctcttccccagctcctgggctagaagtagaattctccattgcttttatgatcgtgaactacgtttgtagagtgctttgtagcctaaaacttacctataatgtgaattaattcttgcaacaagaatatgtggtctgattctcactttataagtgaaaaaacttaatctggtcagaaagtggtagcggaagcaagacttgaaccaagctttccggaagggatggaacatgcagcacagagcattgctgtttccctctcatttcgcaagctcttgtgggctattctgctctgtggaattccactgtgggacacagggagggtgaatctgacgttctggagtagtgtggctctcaactggttttggtgtaaggacacctaaaaccaaatgatttcgaagaccttctagttaaagatagtgcagaaagaggctgtttcctttttaaaaatctttgtatccccaaccattaaagaaagaatggatgaaaggcaaactcatcaatgaaaacggactaatgcaatcctgaacccaccttttgaaggctacccttcataggctcagaaatctgaatgcagggggatgctgagagtcaacataatttcttcagagctcagtaaacacatttccccaaagcccattgctgaaagtgatctccaagggggaagcagggtgaaataatgagggaatcagtgatcttcagatctcagcattaaggaggtgtggctaagagctattatagcaaagcacatacacctcctgagtgttgaaagggagaggaaggctggacacagtggctcatgacagtaatctcagcactttgggaggctgaggcaggaggatcacttgagcccaggaagttgaggctgcagtgagctgagattacaccactgtactccaacctgggcaacaaagtaagaccctgtctctaaaaacaaaaacataaatgaaaacaaacaacaaccagaaaaaagaaagaaagaaaaggagaaataagttaccaatggaaaaaaaatgacagatttactaaaagtattttggagatggcaaatccaaacagaactgcttcacatcacttcctctccctaactcccctcccctctgtccctgcctttgttattcccatttttgtttacttactaatttatccaatacctgcatgataaataattaaaatgaataatgaaaatgaaccaacatggaatctactgcagaggttttaattggaaaaagaataaaagcaaaaggctgatgaaaaaaaataccatgcaagataaattaaccaaggaaacggaagaattctaacagccctttcctttcagagacaactcttcccctccaaccctatgaattcacaaagccaagggcttaaatatatattaaaatatagtagaagattatctagcagggcctttggaaacaaagataatagaagattttaaaaaataatagaagattaaatgaactgaaagaactccaataacaaaggaaagcaaaatataaaaactttataaagataaaaagcaacataaaaaacagaatttaaaaactaaaatacgaggaaacagttaacagctgtaatgaagtcatacagaataaaatgtaaaagaaaaactataaaaataattagtaataaatatgaaacaaagagttcaaatacattttaagtgacgttcctgaaaaataaagctttttttttttttcaaaaatagagtaaaaacaaggattacataagcttccagatacagaaaacgagtcaggttcttgagggaaaagatctgggtagcctcaaaaacgtgcacagtaagactaagtgccagaaggcaggtcagcaatgtctagagtttataaccatgaattttatagtcagtttagcttccttacagttacaaagagatcaggcatttttaaacattaaaagctgaaggaagataatgatagttattgctgtataactaaacatcctaaatgtagtgtccttagaaaccccaacttttatcttgctcatgaatcagacctggctggctgggataactcattctgctttactcagcatcagctgaagaagcctggagctaggggctgggtcatcggggggttcccttactcatgtgtccgatgtctgggcaggaaagtttcaaacatctgtgagctggaactgctggggctcatctattctctctccatggttgctccaatatggtggcttcagaatagcctgacttcctacatgtcaacccagggcttcaagttgcaggccacgaaggagaacatctggaggaagctgcgtcagcccttgttgtctaccacgccatccttccatcagtcacagaagaccaccctgactcaagggaataggaaatagattctgctggatagggaatgccaaggttctgaaagaacatgtagggcttcaaatatggatgcaacttaccagaataatattgaaaattctcaactgtacagtgaaattcaaccaagaatcaaactgagtaaaaaatccacagtataaaaaatgctaatgttaatttttaatgcattagagattggatcgatggtccaacatctggctcttctaccatcctacttcgtctgagtcttctgtccttgattcatctttcatccagtcgggactccagggtcaaccactccatgaatctcttaaaatatcctcaattccttttttcccttcttttccagatgtcacacaaaatctcgaccctgggtcaatttaactttcccattctccactcctccccccaggatattaagaactgttggtaaaaatcatgtattttgggccaggcatggtggatcactcctgtaatcccagaactttgggaggctgaggcggacggatcacttgaggccaggagttcaagaccaccctgggcaacatggcgaaaccccatctctactaaaaatacaaaaattagctgggcatggtggcacgtgcctgtaattccaggtgctcgggaagctgaggtggaagaattgcttaaatctgggaggcagaggttgcagtgagccgagatcgcaccactgcactccagcctgggcaacagagcgagactctgtctcaaaaaaaaaaaataaataaaataatgaattttatagccagtttagtttccttacattgttttatgtttaccataaaacaatgcagaatatagtcactataaattcatagtcttcgaccttgaataagacttcaaagctgcctacaattcctatttattctctttctccatgacaattatatcaatgctttttttttttttttttttgagacggagtttcactcttgctgcccaggctggagtgcaatggtgcgatctcggctcactgcaacctatgcttcctgggttcaaatgattctcccacctcagcctcccaagtagctgggatttacaggtgcacaccaccacgcccagctaattttgtatttttagtagagatggggtttctccatgttggtcgggctggtcttgaactcctgacctcaggtgatccacccacctcggcctcccaaagtgctgggattacaggcataagccaccgcacctggcctatcaagccttttatactatacttacaccttctagcccacacccactctcagtggacatcacactcaaatgcacagagaaaatagagaccctcaaatagatgcaccctcaacgctcctccattatatttacaatcttggctgaaagtggcaatgatgagggtgaggaacaaaggtccatgcctcctccagaccatgctgtaaaccacctctgctgcttctcagagtgggtgctattggcattttggatacagcgattttcttgttagattttcccacatattgtaatacttttagcatctctatccctagaacaacataaaccattagcaagtcaagtcactgaaataggcaatacatatcctgagatattcataaaagcccctcaaggattgggacttggttgagattttcagaccggtaaaccctttgtgttacagatgaagaaaccgaggtccagagcacccaaatcagtttcccaagagcatggtttaatagcactgggaccggcagccaggtgtactggcgttatgccccaggctccttctactaggcgacaggttctgctcaactccacagctgaaactgtttatgttaaaaataacacttaagctgtaatggatgtcaaaataatacctgatccaatgaaaatgagcaaacctttataataataagcaaataaataaatatgtctgcaaggagaggtgtgcatgaattaaatattaatttcaaacaaatattaattctaaaaatgtctatattaatgttttctcaaatagaaaaacttataccagttaataagcacactatatccactctgatgcttttaagtgttaaaaaatatcatattcagtaaaaaatgttttctttaaagaattccttattctctttctgcaccacttatcaaatatcttatttttttgtatttcattttaagatatagtcgagttatttatttgactatataaagtaatattgaatcttctactctcattagtaacctaattcttcaatttctctgatttttcttgaacggtatgtcatcaaagtgactatcattttagctaaatacattgtcatatatgagcaaaattgcatattgatagaatttctgaaatttcttttactttatttgacatattttacactaaaaaaaatcaatgtaactgataggacttcttaaattgcctattttaaaaaaatgtattacccctacaattgtaagtaatttggaagccctggtacaacctatacagtgtttttgaatttgattctgagtggacagctgtaggagggagaattactgagtcacaaaatgaaacagatcacagcactgattgggccctacttcttatcaaaagaggctcttcatacacttaactcagcaagtcactgttgagcactggaaatcgtggagctaggtccatcctcactcccctccctgtccaaatgagaggaggaaatgcccaaactattatctttccaaacctgagccgtctttttgtcgcctccatcacatgatcagattttttgtgtgctcactgtactcattcttccccctttttctatcatggatacatcccagccttttacatcagaaatgtgctcagtttttttccctccccaatcttctaccaccctttgctttcatttattccttaaacgactatcccttttcttttccctcgttcatcaacaacgttttgagaaagtccaacgtgaacttcaaagcccaactgattataaatgcttccctctctcaatgcttccctggccaccattcagaatcggtgcgccacctaggaaactatcttttagacagtcgttactgagggattgtttttgaagttagtaaaataaaatacactccctggttctcctgataatcacggaaatcgtttgctataaagctatttcaataaagcaataatagaaaaacaaacatcaggaaggaacaatgagctctgagaggacctaggaacattaggggtaggaagatgaatttaaactatgcctcgaggacaaataaggatgttgctgacggtgccaaaggtggggagaaaaggacaataagacaaacagcatgagcaaaggcattaaaatacgacatccatgactcactcagtgtatttaaagataaaatgtttaaatgtattttccaggtgttacatggtccttaatgatttttcaaatccttcagtatataacatgcaggctcatttggttttcatttacacactgtctctgtaattctgtcatacttgcctcaagtgactttaccgtggaagaggacctgcagggaagcacatagcacaggttgcaggacagcttcgtggctcttggctaattcgagaatgtatgagtggcagaattccatatagttattctcatcctaacatactacatggaagcaagattgtaaagaaggaacacttgcctacctttaaatacaaaaggtgaccaatatttaccaaaaagaatcttgcagttgttgtgaacaaccaaattcatgtagaacagtttgcaataacagctattaagaaaacaaatggtctgttattcagaccagaactcctgttgctctttagatgacaaatgcatgacgctttaaatgtatgtacgaaaaataaatcttttagaagactttcaaaaatacttctaatttagagtttctgactcagcctctcaactttcattccttcataattcactcatccataataatatttattagaatctacctctgtataaggccctttctaggagtcagggatgaagtggggaataaggtagaccaggtccctgccctcatagcaaccatattctagggaagcaaaaaagatttgcttttcaagcactccaaggttgctaattattttcctggtttcccacatggttgttgagaaaccaaacaaaacttgtctttggcgtatattctttctattctttgaaaattttgtacattagcaaaacacattcactaaagcaaataatttttcttggttaagtaatttggttattcttaccaaagatatagagaccttccttcaataaactataaacattttcagcaaataactaatcagagtttatgtgagttttttccaaatatgcacaacttatagtagcaaaatatttgcaaactcagtaatcataagttaaaccataatgatgatgacatattttgaaacatttctttgtttagtaccttgaatatgccacacactatcctaaaagaaaaaaagtgaagattcaaaagcagtgagagaaaatttccctgtacagtacacaaagttgtatgtacttcagtggggttggtgtttttctccaggagcgtctaccagcacagctttgatcccttcatcaacaatatcctaaaattcaacgcttttatggttacaatactgcctttccaaaggcatgtcagctagatctagcatacagtttttggcacaatttatttccttccttccttccttccttccttccttccttccttccttccttccttccttccgcctgccctccctccctccctctctctccctttctttcttttcttttcttttctttctttctctttctctctctctctttctttctttcttttctaggatggagttttgctcttgttggccaggctggagtgcaatagtgtgatcttggctcaccgaaacctccacctcccaggttcaagcgattctcctgcctcagcctcccgagtagctgggattacaggcatgcatcaccacgcccagctaattttgtatttttagtaaagacggggtttctccacgttggccaggctggtctcgaacttccgacctcaggtgatctgcccaccttggcctcccaaagtgctgggattacaggtgtgagctaccgcacctggcctctctatttttaactgtgcaacaaaagatattccacaagaaggtaacttcagttccaattgtttgttctgtgagaacttggtttagagatagggttggtaaattgttaaaggtgtgtggtatttttagtcatttcccaatttgctaaattacaaaggactagctttttgatagattactgggtggccaatctgattgataggaagctcaaagacaagtctgatcctcaattacacatttttaatcctcgaagccagagggttagtcttttctttaacttcctttttaattaattttattaatctgttgcagatgttcttctgatatatccatgttcgtcaaggaagatggacatgaaagctaatgtcttggcacaagattacgtctaaagcccacaacttaaaatgagatgggctaaacttcacataaactgcatacaccttggtatcactcctcctcaaactaccgtctcactacttacagacattccagcttcagaatccacgccttatataaggtgactgccacctcctgctctctcaaaatacttccctacttttaggtgtcaaaggagcagtaaagggtctaatcctataaaaattcatttctgccaatatgctagcccctcaggaaacagtcttaaatcattatacaatttgcatttcttaacattttaggtgccatttaggtcagtggggggaaatctctttgggccagcctttcgattttggtgtcacagattgtttaacaaagatgacagcagttccaaccaccagcgccaaggggctacttccctcaacacgtcagaatgcacaggattaaaagaagagtttcccaaaaacattgtatctggtgaacttagattaggtcgaatcttctaacccaagcaaaaaggcattatcttgcttccatccttattaaaatcttggtgtttgttttacagttttggtctttaagctcacaaaacccaaaggatttttgaataattcccagtagttttaccatgtataaaaactgccttcaattttataagcttctttgatctctgctaggccaacatgctggggggataaatatcaaaatttaaaaagaaattctcagccagtaagaaaagataaagattaattcactatgttactgtacattcaacaattcacacagctctattatcactttaagataccatccgctgaccatcattcttccttctagagaggctttagtggtaagaaattaactaaaagagaaaaggaacttttaacctgtcctcacagagatgatgggtgggaaagaagataaagaaatttattactgaaaaatataaattggatcaacattagtcacactaaacagattaatgcttgttttcccaaagtattttttggtatttagagttgcatccctgttctctgctcaccctgaggtaggcccagcctctggggttgtggtttgagcaggatcagcgctccactagccacctagtttctttgagtcttgagcatcctgtttttcccaggcagccagagtcccctgatttcttttctgcttttttttgttgttgttgttttctaatttagaaacagggttgcactgtgtcacccaggctggagcacagtggcacaatcatggctcactgcagcctggacttcctgtgctcaaacagtcctcctgcctcagccttctgaggagctaggactacaggtgcacaccaccatgcctggctaatttactaactttttgtggagatggggtcttgctttgttgcccaggctggtctcaagctcctggcacaagtgatccacctgcctcagcctcccaaagctctaggattacaggtgtgagccaccacaccgggcccagagtccctgatttctggggcttcttttcaagtcgcaataacagatgactgtgacaagatggatatgtaatcacctgatttatcccttaaccctgctccctggagcagagtcagctggagaattcagagccgcagcgcccaggtttcttaggtaggcaggctcagcttccccctttgtatgtggttgttcttttccctcatggcatgattccttgcttgtggtaagctcctaaactaatataaggttttagaaatcatttcaccaaagtggttgctttggtagaggagagagagggatatatctggaagagacacgagagtgctgaaaatgtgctatttcttagccttcttaggccaagagttacactgtaacatcgtagttacaatgatgtgcctactttgtgacagattcatagaaatgtgcagttatgatttgtgtgcttctgtgtcttatttccattttaaaatcttaacagtaaaagagtggcatgcccctgtaatcccagctactagggaggctgaggcaggagaatcacttgaacctgggaggcggaggttgcaatgagccgagatcatgccgctacactccagcctgggcaacagagcgagacttcacctcaaaaataaataaataaataaaaataaataagagaaagctacagaatggtatctctgtgttatcctctgtgatttgcaaaatgttttctctgtatacttttaaacatacagaatatttctggaaaaacaaacaagaacttagtattaatggtcatcaatagtgggaggtcagggaataatcatgggatcttagtagaaacctaacattttttgtgtaaacttttatgtactctttaaatttctcaacatttgtatgtgtatattttcaaataaatcaacatttacaaaataaataaactagaaccgaactgaactgaaaaaagtgggcactgtattaagggacagtttgtttggtgtggacgaaatattcagaaatgtagtgatggacgtatgcagcaaagcaaggagcagattgcaggaggtccagcacgcccaacaaaggactagactgtatatttcccaaactgacactgagcctgtctttccccgccagactccttctccagtcttccccttctcagtatttttcatcacaaaccacccagttgtatagactgcacatggattacgcaaccacaacctctccttcttccccgccatcatagtcgtcactaaatcctttgcagtctaactcgaatgtctatttttaatactaatttttctattttttttttactaatttactaccttccttgatgtccacagatcctaccctcggccaaatcaccacctcctctccctgacatattatagtattcttctgacttgctttctacttgccccgttctgtgcctaaagaaagcacttcagtgggtttacactgcgtgttgataccccctgaacctaaaataaaagttgaaaaaaaaatgaagctgtgattgtcgtggtcaacaacaccccaggggatgtagtcctgcctccctctcagcctcacttggaagcagtccttcgctcttccgtgttccagccgctctgctcttctcagtaccttgaacttaactcactctttcctgacttggaacctttgagatgttccgtctgcctggaactcaattccaaaccatccttgtgtggttggctccttctgtttctttaagtcttgatttaaaagttccttccaaaaaagagacttgctctgattacattcagtgttcctgcctcccaatcgtctgtaccacggctccatggtcacggcattcctcttccttctgtctcacatattacaggctgctgcgggggtgcaggggggaagctactgcaaaatccatgggatcagctgggcgtggtggcggtggctcatgcctgtaatcccagcactttgggaggccgaggagggtggatcacgaggtcagggtggatcaagaggtcaggagatcgagaccatcctggccaacacagtgaaaccccgtctctactaaaaatacaaaaaattagccaggcgtggtggtgggcacctgtagtcccagctacttgggagggctgaggcaggagaatggcacgaactcgggcggcagtacttctagttaaatctggtaaatttaacacatatcttcctctgcattctctgctcactaaaataatgaaaaaacaatttttaaaggcatagtgaaagacatcaacaacatttttgaagttggaaagtgaatggacttattaaggcagagacatgactctgcaagaaggaaagtaacaagaagtaagccaacatgtgacagaaccctaaaaagttaaaacatttggggcacaatgaatttctggaggatggtgtgtggagtggggctgggacaaagtttataaactaagtgcaggcaccttatatcccaaacacaagccaaaaaagagtggcttaatttctgaagaggctcaaccatagtaggtctggccttggagggataccagtctccgctgagggtctgttaaaatgatgtcctgaaaacagggatgttaggtagacatctgcataccaaatggagaggtcttccacccccagctcacttctcctacttggctcttagaatactggtcttaggcttctaacatacctccacccaccccacctctgcaacagcaacaggaaactgggagactcctcttgagaaaactgaggagctcaagaaaaaaagacatttagatgctcccaatggaaaagtcagcatgccagatttccagtgttcccctaaattcattctctcttctgcaccctcttctctgccctaggaatctgagctgtaaaggctacataagtgatcctcattgccctctggctttttacttggttcaactactagggagcccagcaatagatgtaagggtagaaggagaatatgtcatgagcacttatgcactggttcccctacatacaggattgctttctgctgactgagctgttgatcaggcatcttggtttctcttccaagactctcattttctaagctctggtaatcacttcttccctccatccctttgagcccaggagtggcaataaactcagagtaattcccaattccttgcgtgttttcaacactctataaatgcccaacaggttctttttgcctgctgcacagaaaaagccaactcactgagacaacagtattgcagtagagaaagagcttaatgctcacagggctagacaagtggtatgatgggagttaactacccaagtcagcctccctgagaactcagagactaggatttttatggatactttggcaggcagggagctagggaatgggtgctgctgattggttggggaggaaaccataggggtgtagaaaatgctcctcgtgggcagagtcagcctccaggtgggggtcacaggaccagctgagtcatgagtcatgggtctggttggggtcagtctgttaccagaatgcaaaagtctaaaaaacatctcaaaacaccaattgtaggttctacaatagtgatgttatttacaggagtaactggagaagtcacaaatcttgtgacctctggccacatgactactgagcagcaagatatcataggaaagaaatctaggggacaatggctggatatcatttaactacacctacatcttagaagagttcaggcccctcccatcatcctaatcttgtggccattcctttatcttacaatggtggcttcagttctcagacagtggcctttcattagtcttacaaaggcagtttcagtccccaaataaggagggagtcagttttaggggggaactgttatcatccttgctttaaagttaaaccagaaactaaattcctcccatagttattgtattagtccatttgcatgctgctgataaagacatacccaagactgggcaatttacaaaagaaagaggtttaattggactcacagttccacagggctggggaggcctcacaatcatggcagaaggtaaggagggacaagtcacatcttatgtggatggcggcaggcaaagagagcttgtgcagggaaactctcccttaaaatactgtcagatctcgtgagattttatttgctatcacaagaacagcaggggaaagatctgcccccgtgattcaatcatctcacatcagaccctcccacaacacgtgggaatcatgggagctacaagatgagatttgagtagggacacagagctaaaccatatcagttatcttggcccatgcctaggaataagtgaggacagccagcctgtggggctagaagcaagatggaatcagccatgctagacttaccttgctgtcataatccttgcaaaggtagtttcaattctgtctacatcattgtaagttgtcatttcactcaattttcctaaaaattgtcctaatttaaacactgcctttttttcccccaggactctgacactaccagttcactatattgtggccttctcaatgaaatcctcaagccctcaaattcagctcttacctacagagcatccaaccagctttttagtggttcattttcaaccatgaatggacagccaaggatcaatcaccagacacgtgaaaaatcttccagcatgaaagatagaccaaaacgaagaggaaaaagatacaatgagatcacatgagaagaaaagaagaagacagccaatatctctccaataggaaatttaaagataagaaaagggaagaaaaaataatcaaagaaaaagttcaagaaaaagttcccaaagtgaaggacctcattgtaaaaacgtaaaaatagagagatgctgctaaaaacttccataaagaaaaacaagtcacatcacaaatcaggaggatggccaccttctcaacaactttggagaaattccttacatttatgaagaaaaatgacttgcaacctagaattttataattaacccaactattaatccaatgtgagaatgggattataacattcatagacaggtaaatactcaaaaatctactgcagtagacagcttctaagatgaccccaaatgtcccgacctcctagcattgatgcccttataggatctcctcccactgagtatgagttggacttagtgacttacgtctaatgaatggagtattggaggagttatgggacactgctctaatgttaggctataagaagactgtggcctccatcgcgggcactctctgatgttctcttttggtctccttcctgtgggggaggtcggcagccacgccatgaggcagtttctctgaagagacccacagagaaagggctcgatgcttgccaacaaccgtgtgagtatgcttggaggagtcctagtatatatgtttaacatgacatagtttctcagtttattataacacttgtaaccataataggtctgttgcccaactcacacagcaagtcaacatactgagatatggggctgcagcagagaaaggggtttcatcatagggctgctgaatgaggagatgagaggaaaccccaaattcatctccctggggagtaggagggtggggtttttaaagaattttggagtaggctgaagtgtgaagatcatggattggtcaaagagtgcagggtgaaatactgggacaagaagatgaagaaacagcattcccacgttgatttggctcctctgtggggtcttcaaactggtggcatcaactattctcctggaattcagaatctgcttaagcacttcttaaacacaagccttatgattctaaggtcagaaatcctccctataggaacagtgcggacgtgagtgctcagtgccgggtgcaacagccctttcagttacaaggaagtgggtcaaagcgcagcctgattattgcttaattacaacaacatttctgtccagaattcttgttaacactgtcaggacagccttattgtattaagtataataatcacattgaaaattatttaggctttcctcaaaaagacaaaccacagatcagcagaccatttgcaaagcatctaattaatagagggataatgttcaggatttgtaagagtttgaaaaatatattaaaaagataactgaacagaaaaattctcaaagaaaacaaataggcaaatcacagaaaaaaaacacaagtggccagtgaagagataccaaaacttcactaataacccgggaaataaaaagttaaactaaagctgacaccattttcacccatccattttgtacacattatgaaacctgttttcaccaacctgatgctaaaaaagaaaaaaattataaagtctaacattatcaagtattgtgaaaattttgaaaaatggaaatactcatccgtcattagtgtgggtataaacttgaaaaaccatcctgaaagtattttgattatgtctatgaaagctaccccccaaaagtacaagttctacaaaagagcaattttacttgttacgtgcattatattaataccttacacatctgcagtgagacatgtaaaataatattttaaggacaaataaagattaaaagtgggcctggcacagtggttcacgcctgtaatcccagcactttgggaggccgaggcgggcagatcatgaggtcagcagttcgagaccagcctggccaacatggtgaaactctgtctctactaaaaatacaaaaattagccaggcgtggtggtgggtgcctgtaattccagctacttgggaggctgaggcaggagaattgcttgaacctggcaggcggaggttgcagtgagctgagaccacgccattgcactccagcctgggtgacagagcaagattccatctcaaaaaaaataaaataaaataaaataaaataaaaaataaaaataaaaataaaaaagattaaaaatgatagccgaattcttccgtttgaaaataaggtaagaaacttctccctctctcttttcttagaacatttactttagaagatttgtaattgtaagttccttttctgtctctaaatctttttccaagcccaataagcctcttgccagctttacgacccaggaatggctttctcaagcacctggaaatcacctctttgtaaacatcgagtgagacagtgcctctgtggcccagtttctgggggagagtaagagcctgtctttgggggatgccttgctcctagttgcaaaactacctcttgtcataaaaataaatgtttatttttccctcatttaaaagtgattaccaggtgaatttaggatgaactgtgtgtaataaatggtgctatcacattctctcacttgaggactagttattatataccttgagagcatgtatgtaatgaattgtatctgcttggttatacgaaggggtgagatttctttctgtctttgcaatctctttgtgggttgtctgtgatatatagcacattctgatttaatgcctattcaatttttaaaaactgttttctttctctgctacctttgtgaagaggttttctaggttgggagaagattttggtttaaattaaatttccccagcaatgttcattatagcattgtttgtaatagtgaaaaatataagtactttaaatatccatttgtagaagaatgaattatcataaaataatacaatgcactaatatacagcagttaaataaataaattagcacactatgtgtcaaaatgagtaatctcaaaaacataatattcaatgaaaacatagttgcagataatagaagtatgattttgttttcataaaattgaagatactaaatatattatgtatggttatatgtaaaaatagtaaatatataaaaataacaatagggccagcatgatggctcatgtctgtaatcccagtgctttaggacactaaggtgggaggatcacttgagtccaggagttcgagaccagcctgagaaatgcacggagaccttgtccctaaaaaaaaaaaaaaaaaaaaaaatagctgattgtgtgtgcctgatgtctcagctactcaggaagctgaggtgggaagatcccaggagttcaagactgcagtgagctgtgattgccccactgaactctagctggagcaacagagtgacactccatctctaaaaaaaaaaaaataaaaataaaaacaaataacaataggaagcatatccaccagtgtgcaattaccattacctgtggtgcagaagggaaggtaatcattttgggaataagaaaaaggagagtttgactgtatctgtaatattttatttatatgaagcaacatatagctagattgcaacatataggtagtaatctggcttttagatacagaaaataatatgacttagattggtgggtgttcatcatattattctctctacgttttaaagttttcatgacaataatattctcataaacaaaaacagagttcctggatcaaagaaaaaccattttagaagacgttttcttccaaaagtttgaccagtgagtggaaagtatttcaaacatattctctacacacaaaatctgcagacctaactctctttaccgaggaggaaagctatctctcattctcagtttggcagggcaatctcgtgatgggaaacatttcctgtgggttttcaggggccagtgaagaagtagaacaaagtacttgctacctgggttacctgttaagaccacagatcccgccagagcatatcctggtccctgtgacgccatggaacccagtagtcagcctggggcaccattcctgttaccggaagggggtcccgagccagactccaagagagggttcttagaccttgcccaggaaagaattgggagtgagtccatagaggaaagtgaatgtaagtttgttaggaaagtaaaggaataaagagaccaaggtgggcagatcatcgggtcaggagttcgagaccagcctgaccaacatagcgaaaccccatctctactaaaaatacaaaaattagctgggcgtggcagcgcacgcctgtaatcccagctactcgagaggctgaggcacgagaatggcttgaacctgggaggcagaggttgtagtgagccgagattgtaccactgcactccagcctgggagacagagtgagactccgtctcaaaaaaaaaaaaaaaaaaaaagaatgaagaacgtctccttcataggcagagcagcagcatgcgcagctccactgggtatacttacagttatttcttgaccatatgctaaacaagaggtggattattcatgagttttcctggaaataggtggggatttgccccagaactgagggtccctcccctctttgaccttataaggtaacttccagacattgccatggcatttgtaaacagtctggcgccggtggcaatgtcttttagcatgctaactcattacaattagcatatactgaggatgactgagatgactttcttggtttttagttttcattgtaggtttgggggtacatgtgaaggtttgttacacagataagcacgtgacatgggggtctgttgtgcataatattacatcactcaggtattaagctgagtgcccagtagttaccttttccgctccgctccctcgtccctccctccccccacaagtagatcctggtgtctgctgtttccttctgtgtgttcataagttcttttttttattattattacataagttcttatcacttagctccatttacaagtgacaacatgcagtgtttggtttctgttcctgtgttagtttgctaagaatgatagcctccagttccaaagacatcatctcaatccggaggtcactttcattgccatcttggttttggtgggttgtggctggcttctttactgtgtcctgttttatcagctggatctttgtaacctgtatcttgtgtcgacctcccctctcatcctgtgactattcctcctgggaatgcagcccagaagatctcagccttattttacccagctcctgttcaagatggagtcgctctggttccaatgcttctgacattcccatctttgttattactgtgaatacttttttcaaagtataatatatttatgatatcagttattaaggagccctgacactgagataaaccttgttagcatctgctgctcactctggatgcctgccctagtgggagagcccttatgactcccatcctactctgcttttctattgttctgcaacacattgaggaatccaaagagatcctagagataacccatcctcagtcaacacattttcctctctccttttcttctcttctcttctttctttctctctctctctctctctctctctctctctctctttctttctgacagggtctcactccgtcaccctggctaaagtgcagtggtacaatctcagctcactgcagcctcaacctcttgggctcaagtgctcctcccacctctgcctcccaggtagctgggactacaggtgtgcaccaccacgtctggctaatttttttgtatttgcagagacaaggttttgccatgttgcccaggctggtcttgaactcctgggctcaagcgatccacatacctcagattcccaaagtgctgggactacaggcatgagccactacagccagactcctcttttcaaaggttgtcctgaaatgttctcgaaaataaaatagctatcaacagctgcagtcttaacccctatttcttgcagctggaaggtatcagaatatgccatcccaaaatatgcctcattggcatgtggatgatattgagccaaaggcaactgagaaccaacagaggaaggaaaggccctttaccttctcccaactgcctgaaaacagagtatacatttcccccttttgtaacagaaatttccatttataaaggacatttttgtctctaaaagtgtcgctgtatcaggaagagagtttcttcctattacctggaaacaacacttatctgcacagcaagaccgcactaatttaccatgaatttcctctctttaccttccagaattcctcctcccacccctccaaagccccatattctttttttaagcctaaaatggtatagaaacctcagtcatctgaccacttccttaagtgtcaattttttgtgaaactcccgtgcccacatatataattaaaccttttttctcttgttgatatgtcatttttcagtttaatttcctgggccccagccagagtacctaggagagcagagggaaatggtttgctcctcccctacactgccccaagatattaacaggacgtaaaagcatattctcaagccctcatgatataggatttttcttctcggtcactttgccagccgaggatccccagcaggcaacgctccagctcacctgtgttatagcttgtacctgcgtttggcagttcccgagctcttgtattgtgctcgagaaaaatgaggatatgctggacactgaagtgcaaggagggcggagaagaattttattgagtgatggagcagctctcagcagagaggggacgcgggagtcgtccccgacccccacagtcgggtagttcttctgtggctgggtccagagctttgtatggactcagaataggggagtgcatgctgattggtttgtgagtatgcaaaaaaggttaaagcaaagacatcactcaaaggtgggcgtgacagtgcagagaaccaattaggaaagggtaggtatatgtaaaataggtaaagggtggggattaatcagaggaaagtatgccaaatgggaagacaagttctcagtccggtttgaagattgaacttgtgcttggcttttaggctttaaactgtcttcagcttggaggtgaggtttcaccgggacctgcccctattggctaggcatgtgactgcctcctgctgctatcactcatatggaactattttcttcaatgtttaaatgtttttcatttctacttggcagcttttcctttatctggtgtttattgttttagtagttctttcaaaacaaattgattgtgaccaacttttagaaacattaggggaagagtggggcatatctttgtctatggtccttaatataatactgtttgtgtaagggcttcatggaaactgaaaaacgaagatatttatcatgaatttagatataaaagttcatcaaaactttgtcctaatgagtacagtacttctgaaaaacattctccattcttcaagcaagcttgtactgggcatgcactgttctcagggctgccagtataaagtgtaggggagaaaaacattctctgactttctacccatcttagtttcatgggttagggactgccaattagacagacaaaagatagattagcaagagataaacaaacagaaattcattaacgagtgcattgcccatacacacaggagtactcggtaacgaataggtcaaacaggtggctagaacctgggtttatattttaccatcttaacaaaagaacaagaattttgtagagaagtagcaacacaagggaaaggggccttcagttctaaggccagcaaattgtggaaaggtaaatcgatgaaggaaaacaagggaagacaagggctattagtatggttcattctgtagattcctctcttacacagattctctgggctgggaagggtctctagagagttacctctggccattgagagttatcctgcccttcccggtagagagggggaggtcagagagtttttcttgcatctgttctttttaattgctttcagctcaaaataatcctatttcaaagtggcatattttggggtggcacattctgaactccttcaaagcaagggagaaaaacataatccctgactccgggtgtaaagtacaatgaaataattcatattcaaaaggaatttgatccctttgataatcagacttgggtttccaccagaaactgatacagctatttgtcaagaactggttgcctggacttataggaaatgactcttgaatactcaggcaagaaatttcagattctctgaaaaggtgactaccacaatgttccatttagagttcaaccatttggagatgtacatgactgacttctgtgcactctcaatttttgcaaatatatgaagaaccaccccccactgagtttttcctctgtagagtgtgaaggtaaaccctcaccccaaaatatggctccctgatatcacaagtattttgaattaaaggccctcagagatcaacagacattggaagaggcttttctcccatctatatcaagaccagatgaacctaccaacaagagcatttttttttaacctctcctcctgctatctcattatctatcgcagaaaagattaagaatgaaaccacacctgaactgactccataagctattatctgtctcttgggtttattcagcttccaaagggaaccatttacaggttaatctccattgcccaatccattcattcttccaggtaatcatttattgcccctcaacagtcacgtatattccctatccacccgtcccctgaaatgaggccatacaggtatctggactccagtgggatattgggcagtcatcctgtgaatctcccctgtgcacatgttaataaactggtatgccatttttccagttaatcttccctttgtcaattgattttccagggaaccttaagaggacaaaggggaaattttgtcttatcccctgcaagtgggaagggtgaatattcacagccagctaacttaatgaaaaatctcacagaaaacatgactggctgaagcctaaagcaaaataaaatcttcaaggggtctcagagctacagaaagtagtaggaacatggtgatctctctcctgacaagcgtacggcctcatcatttttctatgaggatgtcacaagaggctccctgaggatttgatcagcactgttgtcgggcaccaagttcaactgagtgttcctgatgaattaacatgttaataaagttaatataagggtggcattaataaaagggtgcttgccgggcgcggtggctcacgcccataatcccaggcgggtggatcatctgaggtcagaagttggagaccagcctggccaatgtggtgaaaccctgtctctactaaaaatacaaaaattagccaagcatggtggtgggcacctgtaatcccagcttgggaggctgaggtaggataattgcttgaacccaggaggcggaggttgcagtgagctgagattgtgccattgcactccagcctgggcgacaagagtgaaactctgtctcaaaaaataaataaaaaaaattaaaaaaaagttaaaagggtgctcttacctaaaggcaactctcattagcatagacagacaccaaaaatagttctatatggtcaagagatgtttatatttgcctgttatctatataattgttggtctacttagacataaatttccccttcatttaggtgcattaaaattataaagaaaaatttatcttggagatttccattgaaagggagaaaaaaacctttattcctctactcccctaaattctctggctggacctgcaaatcaaactgacagattaataaaagaaaaacaaagttttagttacacacatatgtatggatgtttcacaaagaaatgaactcaaggaggtggtcagataattgaggcttacgtacactttaggccaaacaaagcaaaagaggtttggggcttctgagtgagggaaggcaagttatggaaaagagaatgaggaaatgcaggtaaatgcggcctgtcttgctatgcaggtgagagtctgaggtggaaagagttgtctctgtggccaggtgcagtggctatgccagtaatccagcctttgggaggccaaggcgggaggactgcttgagcctaggagtgcaagaccagcctggataacagtgacaaactgtcgctacaagaaagaaaaaaattagccagatgtggtggtgtgtgcctgtagtcccagctactcaggaggctaaggcaggaagaccaccagagaccaggaattggaggttacagtgagctaggagggtgccactcctctccactctttagtaacagaggaagatcttctcactaaaaataaaaatataaataaataaaaattatttgtaattccagcactttaggaggctgaagcaggaagattacttgagcctaggaatttgagaccagcctgggcaacataaacagattctgtctctacaaaaattaaaattaaaaaattagccaggcgtggtgacgtgctcctgtagtctcagctactccagaggctgaggtgggaggatcacttgatcccaggaggccaaagctgcagtgagctgagattgcaccactacactccagactgggcaacagagcaagaccctgtctttaagaaaaaggaggggggttttctccaggagtagctgtcttccaggtacagaggcccctctcccaatggaagttaccttcgtaagtgtaaatttcctttataaaaggggaggttgatttttcacgcagacagggaaggtaaagagcttttccttcatctgctggctctcaattacttagtcaaaagaatccctatgcctaagaagtgtattttggggtggcatattctggtacctttctccaccctccctttcagagccccatatccctttgggcaacagctcttgaccattaggatctgctcttggttccttacttgagaccagtcagtcattcgctattatgaatgtttcatggggaaccttttctctaatgatggaatgaaagacaagttatagaattctaaatgttaacaggcagctttgtcttggtaccacggagatgctacacaatccagtgtgtggcttactgatatccaattcattcatttggtaaaaatcaattatcttaattaacactccataagtattgccagtatctactaaatctaacttaggttttatttatgagtttgaatggaagtaattcacctcaacatgtcccagaatttcaatttttctgcatgacatcagagagagtatgatagaatttattctttattgcattaagtctggcagaacatcattggaaagtcattcctccagaaatatttattgaagattctcgatatgccaaaatttttatgcatggaagataggagaaaagctgcatgagggtctataaaatcttttgaaagttagttatttcactgggaaatgaaccatgggaccatgttaattagctcagatgacattctttaatggtagagtcagtgctgataaaaagcaaaagactggaaaatgtaaacacagcatttaaaatctaattccatgtcagtgctttgggactccttttcgttaggctctctctctaggggaagtctttaataagtctttatcaagtgcattctgaggggccacattttctacatttgcattaggagattgaaagcaggtttataacttttaaagatcaaattacttctatgcattttatgtgccccaatttcaagtgtaaagggcacatacaaaactatgaagagggacagatggcaactggactttacataatgcttgaaatagacacactgatgatcctaaacacatttttagatatctaaagacaaaaatcatcattgaaatagaatttaagtgaaacaagaaaattttaaattaaatatatattatatatatttagtacacatatatttaaaatcatcttgtttcacttaaattctatttcaatgatgatttttgtctttagatatctaaaaatgtgtttaggatcatcggtgtgtctatttcaagcattatgtaaagtccagttgccatctgtccctcttcatagttttgtatgtgccctttacacttgaaattggggcacataaaatgcatagaagtaatttgatctttaaaagttataaacctactttcagtctcctaatgcaaatgtagaaaatgtggcccctcagaatgtacttgataaagacttattaaagacttcccctagagagagaggaatatatatatgtaggtgttttggtagagacagggccttgttttgttgcccaggctggtcttgaactcctgggctcaggcgatcctcttgcctcagcctccgaaagtgctgggattataggtatgagccactgtgcctagccagacagtttttttaaaagaaattcatcttcacattgtgactatcaatgtatcatactaatatctgaaaagctcatacagattcagagttcaaccacctcactcccctaaccgcacccccctccccccacccgccaaaaaaaagaataaaaaaagaacagtggtctcttctgttaaagaaaagaaaaacaaacctaggagaaaccaagtttggagacaacagatgatctgttgctactggaggccatctcttcataaggaaagagagcatcgccactgcctcgggctccagtcatgcaggtggccctatgtataagtcactcagtctacctgaagcaaactgctcctcccagaacagtgagaagagggcctggtaaccaaattacaccttgctgctttttctgctctcactcttttcttctggttcacatgagaagaggggattctgaatcataaactagatctagaagacatactggctatagtttttggttagtgaaacataaacagaaatctattttgatttgtattctcattcttaaatcaactttctcagacatatcaacaccttttttttggccaaagtacaatatggcaaatataatttactatttcttatcaaattaagattgtgatctatctcaaggtcacaattaaacatgacgtgtgctttttaaagaataattttagttacaaatatataaataaggccacctgtaatcccagaactttgggaggccaaggctggcagatcacttgaggtcaggagttcgagactagcctgggcaacatggcaaaaccccatctctattaaaaatacaaaaattagccaggcacggtggcacgtgcctgtaattccagctactcaggaggctgaggcaggaggatcacttgaacctgggaggtggaagttgcagtgaaccaagatggtgccactgcactccagcctgagtgacagagtaagcctccatctcaaaaacaaacaaacaaaaaaagaaattacaaatatataaataaaagaaacagaactagtgaagctcagctcgtttcctaaaaagtaacagtgaaactggaaaagggaatcccagattcaccccaagcactcattcccacagctgctgggagggtcaacgggttcagttctgcttcctccagcctctctcaggtgcaagagaggaaaaatatcttccatctacccttgtaagttctcagctgggaaccccttcacaaaagacagattaataagagaaaaagcatagaaatttaattaatataagttttacatggcatggagatgtccatgagaaaatgaagacacaaagaaagggttaaactggggtgtgtttctgctgtttgatgaagagtggaaagtcctggggaaatgtgacaggacagaatatgggctaagagcacgggctaagagtatgggctaagaggggtaaacggggggacacttggcagggctcatttgttctaattactctcaatacccctctgtctttggagataagaatgttgtcctccaggtctaggaaggcacctctcacatgagggtcttatcgcctgcttcaggaaagaaggacagaggcaggttggagagaccttcttgccatttctcgaattccttcagcttaacatattcactatgccaaggtgccatattttggggttgccctgaaccccatcaaaggcattgatttctagcgcactctcccataaactttctgtacccaaatctcagtctccaagactgctttctaagaaaactgttttgtgtctgtgtacatgtaagtcagtaaatataaacatcagtgaagggcaacgcatcacaatgctgaaacatctttcaaagaagtaagattaaggcgatgaacttgaaaatgattttgtaattgtcttacaaaatacacatccatgttatccttgcaattttgttttccatgtaaaacatgtcacatgactgaaaaggttctcattaacctattaagaactaaaaaccaccattgagctcaaccaggtgttcttattctcatggtctgacatgtcttcctctccttccccactctccttcttccccaatagtcttcagacattcagttaactatggtatgtgctctttttctcaaggccaagtatttccaagtctcctcttatatgatgtcttatataaataaatgtttaaagtatatcaatataaaattgagataatggaaatatttactgttcctatcacttcatcttttcaaagccaactttaacagcaaacactattggcctcgcaaggcaggagatctgaagacggatatattaaataaataattttgatatgtaccttgagccaagataataatataagattgtgaacactcgctgggaaaaataacgatctggtgtagaaaatgacaggatatttgagaaaatataggtatttttctggacaaaagtaaacattaatgtatttatgagatgtttctcactgagaagtaaactctgaccttttttctctcttgcccatattcctatctaaggggcctgcggagtcacgactacaaaccacgactacaaaccaaaacatctcatcaggtgggctttatttcaccctatataatgtggctcactttccaacccaacactggcataacatcacatgaaagataaagaaagaaatcaaaatattttaccccaaaaaatatgtagggcttttcgccatattttaaaatggccctgcagagtcttttgtgggggaaatttttgtccgtgaagaatctctgttaacacaactaaatcttccccttccaggccctcccaatcctgaagagattaattgagaatctatttctatttctattttttatttttatttttatgtttgtgttttttgagacaggatctcactctgtcactccacaggctggagtccagtggagggatctcagctcactgcaacctgtgcatcctgggctcaagcaatcaagagtccagcaccttttaaaggtttgaagaggagacattcaccatctattgtatctaagggcagccacctataagatttcataagaacctcagtgtccacagccccttatgttaacccagacactcctttctattgcctctattattctatttagataataactcttttaaccaattgccaatcagaaaatccttgactccatctacaacctggaagctccctcttggagttgttctgccttttcggactaaacctcatgtgtattgtatatgtctccccaaaacatataaaaccaagctgcagcccaaccaccttggacacacgttctcaggatctcttgaggccacgcctccggccatggtcactcatatttggctcaaaataaaactcttcaaatacagagtttggctgtttttgttgacactgtagggataaaaaagctattacataatatttgactgtactgactgagttataatttacaaaggacagaattcaaataaataagaaggaaattctagagaggcagccttgttgactgaccatcttgctatctgaaatgttcaattgtgggaagtggaaatggactcttttcctacaccatagacgaggctaagagtaggcaacaaccggccatgtactacacgcagatggatggcagagacagccaggacctggataaccttgataccctagaaagagacacactacctgtgaagtatatgtacccaaaagacaaaaattatctgaatctaatcaaggacttggatctaataactggtttcaaaaaataccaatgagagctgggtgcagtagcccatgtctgtagtctcagctactctggaagctgaggtgggaagatggctacaatcacgcctgtgtacagtcactgcactccagcctgggcaacacagtgagagctcgtctggtaaaaaatacacatgtaggtgatgaaggaaaatgatgccatggggacataatcaacaaaatctagaattggaaatttctagatgtaaattattaggtttcttcaacaaatagcaaggaaaaaagaagacggagggaaatcacagattaaagaaaggtgatacatatgaagccaatgtgatatgtggtccttgtttagatcccaatgcaaacaaaccaaatataaaacaaacatttctgagaattgagaaaatctgcacactcaccagatactggattatattaacattattgtcgattttagggctattaataatattgtgtttatgttaaagaaagaatccttatgttttagaaatatatgttggagtgtttctggatgaaatgatatgatgtctggaatttcctttaaataatttgggaggtgggagggtgggtggaaaagaaacagatgaaataacagcagacaaacggcagtgattgttgaaggtgggtgatggctgtgcagggtgggtgaactgaagaaaatgatggaggtgattttttttttcttttttttttttttgagacggagtctctctctgttgcccaggctggagtatagtggcctgatcttggcttactgcaacctctgcctctgggttcaagtgattctcctgccttggcctcctgagtagttgggactacaggcgtgtgccaccacgtccagctaatttttgtatttttagtagagacagggtttcaccatgttggccaagatgaatctcttgacctcatgatctgcccacctcagcctctcaaagtgctgggattacaggcgtgagccaccgcgcctggcctgacggaggtgattttaatccatttagaggtttattttgccaaggttgaggaagcacctggcaaacagagacacaagccactgtaggatctgtggcaccccctttttctgaagaggattttgagggctacaatatgaaaaggggaaaaggaggcaggaggggaaaagaaggaaaaggagagggagggctggtcacgttctttagaatccacatgaaaaggagcgggtagatgaaccgtcaattctgcattcatctcctgctcagtacatctgtactctacataagataaggtgaacttcagtagaggaagcaactgaatatgcattcgtctcagggtgcgcagcgggacaatttctaggctcctctcgtcccgtactcttgaagataaactgttaatttacatggtcagagtgagggaggcccctgtggaaacatgtggccttctatctgtagctattagtttaggagcaaaaggaaaggcagggttttttggttttttcatgactcagttttcaagcttaacttttccattttggcatagcgaatttgggctcccaagattttgtcttcctttcataggagaaaaaataatttcttttctcaatccttgtaagttcattagtgggacagattcctgttagcagaagacagattaacaagagagagaaaaaaaagcatttttatttacgtgtgtgtctatcccatggggagaaagctgagttcaaaagtaaggtggcttagggccctggcttacatagcacatctagcaaagaacaatatattcagaagtgacaggacaaaggaccaagcagctccaggctcccaaaagtgggacaactatggaaaggtaataaagcctgctcccagattcctctggccctgctggcgccagcccctgcactgataagtgaaccactacttacatctctgtcttcaggcagataggggaggcagaagcttctccgcattttttcacagcaatttttatggcctgccttaggtaagaaagggcagctcagacagccctttcctgtaactttactttccacttgccaaagaagcatatttcggggtgaaatattctggtgttcttcagatgtatggggattcataagattattttctctcctgctgtctaaaattccacaatgaagaagttaaaaaatctctactgtaattaaaagtaaactgaaaaatattacagttatagtgaattaaataattgaagttttcatataaaaatgcaagtttttagaatctatgcatctgaaggatttttttaatctaaaaattgaatataaaatatgtaaattatgttcttttctaacctaggatgctacttattaaaaacctaaattattgctataaagaaaataatagagatattttagttcatcttaattatatattttatagtttggttttttgttttggggtgttttggtttttattcattttatttatttatttatttatttattttgagacagggtcttgctctgtctagagtgcagtggtgcaatcatggctctctgcagcctcaacctcctgggctcaagtgatcctcccacctcggccctcaagtagctagaactacaggtgctcgccaccacacctggctagtttttgtgtgtttgttttttttgtttttttggtagagatgtggttttgccatgttgcccaggctttaattatatattacatagggactatcaaagacactgtcagtgtaaacatgctagaagccaatataagccactccaaacaagcagtgtacctacatgacagcttttcaatctaagtcgtgaggcttggtcagagttgtgcctgaaattattgaattttatttcatttcttatgcactgttatagcattagtaaatgtattatgcactattacagcattataattcttatgaaataaaacatactctgtatgataaaacagatgctgagttctacagaaactcttcaatttatattaccccagcaaaatatcagcaataatggctaacaagtatggagtactttccgtagtgtctaatatattactgcattacatcagtggagtggtattattagtgcttctctttcttctcaggctgaggaaccagcagatgagagggttcatgaaggaaccactagttccagaagtgctggatcctgccttaatcatcattccaaagactctccttatgatgataacaattagttgaactcactttctagaatccaaaattgcaatggttctccaaattaatacattgtatcatgaagtaaattcaccttatttattactgttttgctttcatccaccagtagagggagtacaaattcacctataactgagtccaaatcccaaaaacagatttagggaatgacaggatcaggcaggagtttaactcctgtatttttatgcgttaaggaatccgaggtgacagaggttgggtgagttaatgcagttacatggttggccaatggtggggccagatgaacaattcgcaccccctggcttccagaacaggctggttttaccaccggtgaggctggtcctttcagtggatatcaggtttccttcctagcccactgggtggtcatgtggaatatttcagaaagccaagctcagtttccctcaagaaacgttagtgaccactagtttaagataaatttttatttggctatggtgaaacagctgatcatataattcccccaaatgaacattaatttagcaaattaatatactgcacaaataagtatacaaaagcaaaattgagagctaaatgaagacaaaattcctctctgggtctttcaaaaacacaatttatcagttgagaactaattgactgtttacaactggaggtgagaagggtgtattcacagatgtctgcctgagaccattggataaaggggatgagttccagttaaattttgaaaaaaaaaaaaggggaaatagcagggcacggtggctcacatctgtaatcccagccctctgggaggccgggacaggcagatcgcttgaggtcaggagtttgagaccagcctggccaacatggcaaaaccccttctctactaaaaatacaaaaattagccaggcatgggcagctgtagtcccagctactcgggaggctgaggcaggagaattgcttgaacctgggaggcggagtttgcagtgagcggagatcgtgccactgcactccagcctgggcgacagagtgagaccccgtctcaaaaaaaaaaaaaggtgtgtgtgggggaggaggggaacaaaacaaaaagctgaccctgaaagtctccttactactcagtttgagagacaaaaactccagctcgcctgttgtttatgctcatgcctggctctccttccactgcctgccgtacactttgctggggcggggctgactctgtctccttaggggcaggactgtctataacactgtcttaagttccacctcttctatgcctgggaggacacacctgtttcgtgttcatttgcattcccaacttatctttcttcttctcctggtggccacaggaggtgctttgtcggctggcaggtccattttgggtattctaatccaggcttctgactaggtttggtagctattctcattctcattttacttcttattcattctaactctcattctactattttttacttagacgtagttttcttggtaagaaaggccatggtaagcagacgtagtgtgcacagaaatatgcagcccttctgggtgcctggaccccagtagcaccatagtcacccgtaatagccacataatagccacgcctagttctaagagtgagtagagttggaccaagttgtgaaacttcaagtttgcttttgtttttagtcgaggcctaacctaggcttggctgggcacttttttcagggtgctagtgttgtagaacctctgagagcagcgaaaggtttataagatttggccaaggccagagggcgggagacaaaatctcgcaattctgacctgcctttggacataattgaggctttatgaggaaggtggggatgcgggagtggcgatcccatgaccaaagctgcttgcctccctcggtcccttggccagatgaaacttctggatgccttcaaggatgtctatctgaccaaaggatcttgttctttaaagataaacaaagccgggcgtggtggcttatgcctgtaatcccaacatttcgggaggccaaggcaggcagatcacttgaagtcaggagattgagaccagcctggctaacatagagaaaccccatctctactaaaaatacaaaaattagccaggtgcggtggcatgcgcctgtaatttcagctacttgggaggctgcggcaggagaatcgcttgaacccgggaggcagaggttgcagtgagctgggattgcgccactgcactccagccttggccacagagtgagactccaaaaaaaagaaagaaagaaagaaggaaggaaggaaggaaggaaggaaggaaggaaggaaggaaggaaggaaggaaggaaaagagagagaaaagaaaggaagaaagaaagaaggaaggaaggaaggaaaagaaagagagagagaaagaaagcaagcaagcaagcaagaaagaaagaaaggaaaaagaaagaaagaaaaagaaagaaagaaagaaagaaaggaaggaaggaaggaaggaaggaaggaaggaaaacaagttcatcaatctcgcaggcagaccctggagggttaggatatgaaggtaatcaattattagcaactcccctccaccagaatgacttcatgccagcaagtgtgcacagggagaggagaggacaaagagagaggaaaataagcaaaacagagagaggaaaataagcaaagcaaacaccttagggtttttgtttgtttgtttgtttttgtttttttgagacggagcttcactcttgttgcccaggctggagtgcaatggtgcgatcttggctcactgcaacctccgcccgcgccctccccaccccacccccaggttcaagtgattctcctgtctcagcctcctgagtagctgggattacaggcatgcaccaccacgcccagctaattttgtatttttggtagagacagggtttctacatgttggtcaggctggtcttgaactcccaacctcaggtgatccgtccaccttggcctcccaaagtgctgggattacaggcttgagccaccgcgcccggcctagggtttttatactataggctcagtcgcactagcctggtctccttttgcctccaggaagccgtgtgcaccacctacatgctgtaaagatcaaagaatgcacttatctaggccactgctgtcatgtctccatttcttttttgttttttgctttttctttttttttttttttgagatggagtctcgctggagtgcagtggtgcaatctcggctcacggcaacctctgcctcctgggtttaagcaattctcttgtctcagcctctggagtagctgggactacaggcgcatgccaccacacccagctaattttttgtatttttagtaaagaaggggttttacttcattagccaggaaggtctcaatctcctgacctcgtgatctgcctgcctcggcctcccaaagtgctgggattacaggcatgagccacagcgccctgtgccatgtcttcatttctgcaaccaacacctccatgctcaggtcttccagtcttccagctgtgatctttctcaaaactgacactgggagtgaagcaagccttggaaggagtgacaaatacacccatcccctgcagcccccgcagaccccattcatcgatcacagctctccttccaccactcattgatcacagctctccttccaccactcatcgatcacagctctccttccaccattcatcgatcacagctctccttccaccattcagtgatcacagctctccttccaccattcagtgatcacagctctccttccaccattcagtgatcacagctctccttccaccattcagtgatcacagctctccttccaccattcagtgatcacagctctccttcccccattcagtgatcacagctctccttcttccattcattgatcacagctctccttctcccattcatcgatcacagctctccttccaccattcatcgatcacagctctccttcccccattcatcgatcaaagctctccttccaccattcattgatcacagctctccttccaccatgcagtgatcacagctctccttcccccatgcagtgatcacagctctccttcccccattcatcgatcacagctctccttccaccactcattgatcacagctctccttccaccactcattgatcacagctctccttccaccattcagtgatcacagctctccttcccccactcattgatcacagctctccttccaccattcagtgatcacagctctccttccaccattcagtgatcacagctctccttccaccattcagtgatcacagctctccttcccccattcattgatcacagctctccttccaccattcagtgatcacagctctccttcccccattcattgatcacagctctccttccaccactcagtgatcacagctctccttccaccattcagtgatcacagctctccttcccccattcagtgatcacagctctccttccaccattcagtgatcacagctctccttcccccattcattgatcacagctctccttccaccattcattgatcacagctctccttccaccattcattgatcacagctctccttcccccattcattgatcacagctctccttccaccattcagtgatcacagctctccttcccccattcatcgatcacagctctccttccaccattcagtgatcacagctctccttccaccattcagtgatcacagctctccttccaccatgcagtgatcacagctctccttccaccattcagtgatcacagctctccttcccccattcattgatcacagctctccttcccccattcatcgatcacagctctccttccaccattcagtgatcacagctctccttcccccattcatcgatcacagctctccttccaccattcagtgatcacagctctccttccaccattcagtgatcacagctctccttccaccattcagtgatcacagctctccttccaccattcagtgatcacagctctccttcccccattcattgatcacagctctccttcttccattcattgatcacagctctccttctcccattcattgatcacagctctccttcccccattcatcgatcacagctgtccttcccccattcatcgatcacagctctccttccaccattcattgatcacagctctccttccaccatgcagtgatcacagctctccttcccccattcattgatcacagctctccttccaccattcatcgatcacagctgtccttcccccattcattgatcacagctctccttccaccattcatcgatcacagctctccttccaccattcatcgatcacagctgtccttcccccattcattgatcacagctctccttccaccattcagtgatcacagctctccttcccccattcatcgatcacagctctccttccaccattcagtgatcacagctctccttccaccattcagtgatcacagctctccttcccccattcatcgatcacagctctccttccaccattcagtgatcacagctctccttccaccattcattgatcacagctctccttccaccattcattgatcacagctctccttccaccattcagtgatcacagctctccttccaccattcagtgatcacagctctcattccaccattcatcgatcacagctctccttccaccattcagtgatcacagctctccttccaccattcagtgatcacagctctccttcccccattcagtgatcacagctctccttctcccattcattgatcacagctctccttccaccattcattgatcacagctctccttcccccattcattgatcacagctctccttccaccattcagtgatcacagctctccttccaccgttcatcgattacagttctccttccaccattcattgatcacagctctccttccaccattcattgatcacagctctccttcctgctgagcttgggtgtagtctcagagtccttctcaacatagcattccagacaaccaccaccaaatgtggcttgacactcaagtaacacacatttaccattactgcctgtcaatgagaattagaactggacaccagttaaagtggtggagctgaattttagggagaaactaaactgctgtaataggggaaaagagacttcagcacagaactgagctcaatttgaatacaaggataagtgggaatttatcactaaacagcaggatgggggcatcagtgggtggacagtcactaagaggaaacatcaagggtagtaggttcttgagaaactgactcaacagggtccttgctgagagcaggccggcaggatgggatatcaagagttgggaattcttttgtaggggaggaaaaatatcttttctcctacccttcagagtttgtggctggggaccccgtaataaaagacagattaacaagagaaaagcatagaaatgtatttaatataagtttcacaagacacaggagccttcataagaaaacaaagatccaaagaaacggttaaaccttagtgtttttatgctagaatggatgaagagtggagagttctgaaaaaatgtctgaggacagagcgggagctccatatagtcaactggggaaaatttagcaagtctcattcactcagattcctctcagcatccctccatctttttttttgagatggagtttcactcatgttgcccaggctggagtgcaatggcatgatcttggctcactgcaacctccaactactgggttcaagcgattctcctgcctcagcctcccaagtagctgggattacaggcatgcaccaccacgcccggctaattttgtatttttagtagagacggggtttttccatgttggtcaggctggtctcgaactcctgacctcaggtggtctacccgcctcggcctcccaaagtgttgggattgcaagtgcgaggtactgcacctgaccccctccatctttaaagtcaaggacactccttccctctgggtataaagagatcaccccttacataagggttggataatccgcttcaggggaaggtcagaaaatcatttcaccaattccttcagctaaaatattcaatataccaagtcagtgtgtcctgaactccaccactctaaactgacatagcagaatttgtgataaaactgaactcagcaaagatgaacacggaagaccacggaggacacctgatgaagaagagggctcagaggagcatggccacagtccagttaaggagaaagtctttgtcacgccccagagttagagtacacagccctccctagctaagaaactgtaaataactctacagcaatccatctgcagctccaggtagacaacgtcacctgcaccatcagccgcttttgacaccaggcaattctaggcacctcggcatgctgagtgttttgagcagaaggaggttgagagggtcacagaagcaggttgagagggtcacagaagcaagaaggtctctccaatcttctcctgccctcctttctcctaatcccctttgccctctaaagcaggttgtagaatctagaattcacctcccctgaagcaagccatcaaactcaggaacatcactctctgagctcctcactactccactgaagaccctcatgtggcaggtattgtgtcctacacctggggcgggggaatgaattcatagacacaaaaagaatcggaacaaacaggcctaaaggagttcccccaagtttattatcattagatcacactccctttcatccagtcatgattctctacaactatctactttttttcatcagacttagcataaaaatacacagttttccctggttcttgggccttcattcctgaaggctcttgtgacatgtgaagctttcattaaatatatttgttcaggttttctcctgttaatctgtcccatgttacggaagtgtcagccacgaactgaatgggtgaaaaaaagagattactttttctcctctacagggctcaaggctcagaaaggtatttttcaaaaaagaacttgagtcgtatagctctatttcattttttcctcagagactatatacacaaaattgaacaagcattttataacttgttcaagaaggcaaaaatataggtcactgaaaacatagtcttcttgaattacttttttttccaaactttaatttaatccttgtaatagtcacatcaagaaaagctttttctatccattttcttaccagttgaacactcttttgaaagtggactttcagtcacacagctctgtgtttcagctaataacctactttgcagctgacatacaggaatacaacggctatacaagaaagaaatgttatttttcttttctatggaattgggtccagaaaaatgcctgtgagaaaggctttttgcatggacatttgtcctggcactttttccttattaaaaatttaatggcgtgggccacatattcatattcagatcaactctgggtacttatcccagtagctatgataattaagattttacttttatgacagtctagcagagcacaggttttatattcaatattctgccacttgacaattctttagccagcttttcccaacttcccttctcataagaccccactccagatactgattcaacacggctgacatgcaggctggagtcctggtatttacaaagaaccaaagaaccgcaagtgatgtttataaccagaaaggtttggaaagcaccactccaggcaaatagtcagttttaggggttttaaaagattttcaaaacaaagctaaagattttagttcatttttatttttattttttcaagacagggtccggccctgtcacccaggctggagggtggtagcatgatcatagctcactgcaacctcaaactcctgggcttaagccatcctctctcctcagcctcccaagtagatgggactataggcgcataccactacgcccagctagttttgttttcaaattttttgtagagatggggtcttgctgtgttgcccagcctggtcttgaactcctgctctcaaaggatcttcctgcctcagcctcccaaagtactgggattgcaggtgtgagcctctgtgcctcaccaaaactcaagacttttcaatacagcacacacaccacaaaggacagccatgacagtcaccctggtgaagaggtgaaagcacctgccagctgccgctgcctcagcctgccccaaccccgtgcagccctgctccttctctcattagaagtggcaagggaaggcacggcggggagaggggtagggacgctgtgagcatcctcagaaaccatcgcagtgcctcctgcccagctgcagtggaactgctgcactccaccaaggcagccgagggctctgaggaccagaacagaatacacttccatatgcatttcttccacaattctttgagtgaagcaccaccctctgtacagaatcattataattattcttggatcactcttttgtctctctacagtggctttggtaacagcagggattccagaaacaaggacaaaagcatctggcttgagcaaggaggctgctggcaagactgagggtggcagagctaggaggatgaatgtgtgaggagtggacaggcgacaggaagagaagggaagagagaaggaacagaccggggagagcccctcagtggccagtagtgaactttccccaaatctgtcctcctggcagaaccctctctcccagctcctggaggcggagccaaccccaggcaggaggctacagcaagcagatgtcctggtcactgcctgcacctcccatggtggctttcacagcttcctgccagctccaagccgaccctaaacctccgaaaagcatctgaggaggcagcttacatttgggattaaaacaccagtgttacccctgtcagaaaaatttgcattattcgtgtggcgaacgaaaaataaaatcttaaggcccccactgatcagaccccctcttggccaagggaactccagagaaagcctaaaactgagttccaggccatcactggaagggaggtcaggcacgtctcctcatacccgctttcttttggagcttagacacgacaactgaccagcattcctgtaaaaacaaagatcaggaggctaacaaaacagactctctgtcgtaacaggaagccaaattctaggccgggagcggtggctcatgcctgtaatcccagcactttgggaagctgaggtgggtggatcacaaagtcaggagatcgagaccatcctggccaacatggtgaaaccccatctctactaaaaatacaaaaaattagctgggcgtggtggtgggtgcttgtagtcccagctacttgggaagctgaggcaggaggattgcttgaacccgggaggcggaggctgcagtgagccgagatcacaccattgcactccagcctgggcaacagcgcgagactccatctcaaaaaaaaaaaaaaaaaaaaaaagacagatcttaaacaggatgtaaagccggcagtcttgctgaacaggtcatattgtggctgactctgacacagcatccttatctttttttcctttttttatgctccacagggcaagtcctaagcatccctatcttaacttcaacagtccattctgctaactccaaatttttagacaaagttttgttcctttcaccaactacacattaaagaatctcggaatccacctgtgacctgtaagcccccatttcaagatgtcctgcgcttcctggccgggccaatgcataccttccaggtacggatttgtgttttgccttctcaaaatgtgtaagaccacactgtgacccagccacctcagcagcactaagaccacactgtgacccggccacgtcaggagcactaagaccaccccgtaacgcggccacctcaggagcactaggaccaccccgtaaccgagtcacctcagcagcactaagaacaccacgtaacgcggccacctcaggagcactaggaccaccccgtaacgcggccacctcaggagcactaggaccacccagtaacgcggccacctcaggagcactaggaccacaacgtaatccagccacctgaggagcacttgctcaggaccccttgagactgtttccctgggctgtggtcactcatattggctcagaataaactctttaaaatattttacagagtttggtttttcccactagcaatgtcaacctaaaaggaagaagctgaaacaaaattaatgtagtagagagtttatttgggctaagcttgaggactgcaatctgggagcatagattcaagttgccctgaatatacatcccaattagcagatgttgtaagtggattttttttttttttgacagaatctcgctctgttgccagggtggagtgcaatggcacaatctcagctcactgcaacctccgcctcccgggttcaagcaattctcctgcctcagcctcccaagtagctgggattacaggcatgcgccaccacagttggctaatttttgtaattttagtagagatggggtttcaccatgttggccaggatggtctagatctcctgacctcatgatccacctgccttggcctcccaaagtgcaaggattacagatgtgagccaccgcgcccagttgattttttcttttttttttacagggtctggctctgtcccccaggctggagtgcagcctcaaactcctaagcttaagtgatcctcctgcctcagcctcacgggtagctaggaccacagacacatgccaccgtgcctagctgattttttgtatttttttatgtttttgtagagacagggtatcactattttgcccagggtggtctcaaacgcctggccttaagtgatactcctcagcctcccaaagtgtcgggattataagcatgagccactgtgccctgcataggtggatttttttttttcgaagtctcgttctgctgccaggctggagtgtagtggtgccatcttggctcactgcaacctccgacttcctggttcaagtgattctcctgcctcagcctcccaagtagctgggattataggcacacaccaccacgcccagctaatttttgtatttttagtagagacggggtttcaccatgttggccaggatggtctcgatctcctgactttgtgatccacccacctcagcttcccaaagtgctgggattacaggcgtgagccaccgcgcccggccgggtggatttttaaaggtgataaagggggacggagagcgtgctgacagggggacggagagcgtgctgacacgaagtggctcctcaggaatcctcactggtctacagaaataacattgattatggtgggtcatagtgtccgggcatggcatccttaggtacatgtatagcttctgtggcaacagcaagcagtttcgagagatgaattgcgagatcaaaaggggcagcaggctgcagttgccatctcattttaccatctctctgagtctgacaattcaaaggacttgcattcctcagacaaaagttcccctcccctcccctcccttccccccgttccctccccctcccctcttttcttttctcccttcccctccattcccctcccctcccatctgtcttctcccctcccctcccctcctctcccttctccttcccttccgcttcctttcctttcttcccctttcccctttcccctttcctttcttttcttttcttgaggagactccgggaaagcgaaagacagaattgtggcaactttctggagcagaaagttctgaggcaaggaaaagcccttatgtgcgatgcgagggaggctgcacagacctgggtggctgcccacagcttctggagcctggccgcagcgcctctgaaggcaatgtcacatagggaacgagtcacgaggaagccagacaggcacaagcacatggacgctttccaccttgaagatccagggccaccttcctgccccctgggggcacagcggtctccagtccctggagaagctccagctggggatactgtcaacccggtaaccagcacggcgctcctgggcagcccgggaccagctgtaaagtggtgatggcaggagaaaccctacagggactggctcacacacacacagggactggctcacacacacacacacacacacacacacacagggactggctcacacacacacacacacacacacacacacagggactggctcacacacacacacacacacacacagggactggctcacaggttttaagtgaaaggaagaaatcaggagttctttccttttttagcaatttgaaactctaagaaaaaggctacagtgttgtattaatgtctcaccactcccacccccttttcaagtgaaataaagaatacaagggaagccagaaaaatgctgaagattttggcaatgaagggtctgaccacaaagaaagccaatgtgccacttgtgtggatttttgcagaaagagtaaacagccttcctgcaagacacaggctgcagagggttccgttttcatggctggctgccacagaattggcttaggctggatggactgagcagagcatggggtctgagccgagtggcgtgagccaggggtccagagcagacacggggggcgtgcacgccatctccagagtcgcacagggctgtgcgtaggcggccactagggtaggtcacgcataaaagttgctttgtatctgcagcacgaacaagacttaaagaaagatctgttttataaagacgaagcagtgctcagtatgtcatttaggatgaagaagaaggcagggaaagcgttcattttagaagtgctgtgaggatggtgcaggacgcagtggggcggggggagggtgcattccgcccggatcttccctcccctcacttctgtgctgccctgcctgcatgccctcacgcccaggctagtttccactctgccacaggcagtgaagattggatccgctgatggcagcatcttggaaacaggaaactgacaggcctctgaatatgccatcctaaaatatgactgtctgagaccagactataccaccccaaaatatgactgtctgagaccacactataccaccccaaaatacgactcagagatcagactatatcaccccaaaatgcgactgtcagagaccagattataccaccccaaaatatgactgtcagagaccagactatactaccccaaaatacgactcagagaccagactatatcaccccaaaatatgactgtcagagactagactataacaccccaaaatatgactcagagaccagactatatcaccccaaaatatgactgtcagagaccagattataccaccccaaaatatgactgtcagagaccagactataacaccccaaaatacgactcagagaccagactatatcaccccaaaatacgactgtcagagaccagattataccaccccaaaatatgactgccagagaccagactatatcaccccaaaatatgactgtcagagaccagactataccaccccaaaatacgactgtcagagaccagactataccaccccaaaatatgactcagagaccagactatatcaccccaaaatatgactgtcagagactaaccagaccatgcctcccacacatgcctctttgtcttaaggatcatttggagctggttattttgagaaactgcagatgcaggagaacctttaaaaacagaaacttaccattttgtaaaggaaatgtccgtcaataaaggaactgtccatttgtaagggtgccttcctctctgcaccagagagagaagaacgactagatctctagactcctgaaccatggagaaggtttctaagcctgaagtttaaactacctgtttgagatcaactccagagacatactcagttctctgggtgcctcccaagtgcacacgagctacacatactaataaacttctgtttgtttttctcttcttactcggtctttgttacagggagtctcagctaagaaggttggagggcagagagaaaactcgtgttctgcccctaccggagcaagtgtgtgttcctctgcactgatgaatgtgcctgtctccagaaagggcagcccgtaggtactgagagcagaggtggagcttctaagagagcagtgacagcctcactcctcctccctggcccaccctcaccccgtcccctgcacctggagccactggaagacggaggagccatcctttaagaatctcctggaggactcatcgaccccacggggacatggtacaaggctggagagcagctctgtgttgaaggggaggagagaagataatctcatttcctcccagtctaaagaatgagcattcccagtggaaggagaaagcagatccttggccacacacaatcctcggagaagagtcaacaggattgtgactagaagtggcttctacatcagcccaaagttgactttcagcaaaaggtaggtttttgcaatttaaagcagtgacaattgatttagacaaggttagccttaagtgatttaaaaaatgcttttatgtaagatctcatttaatcttcattgcggttcttgtagaaaggaatcagaatttaaggcaccagcgcgaggttggagagctattatattatggagctaggattctgacctagttggcttaacaaggaggggcttaataaagacaagtgatctccaagcccaaatacaagcaaagccagctcataaaagatctgctttcagattttaatccttgatgaagggaaatgtttaaaaatttcctaaaagcaaaattgacaagacaaatccaaagaaaaccctgtcttatccagtgtggcctcaaggcccaaccgcatcccctgaacagaaaaccctgtcttacccagtgtggccttgaggtccaaccgcatcccctgaacctggtacattcgcctttgggtacgttcagtaaagaagccagggtctcagaatatatggagtggtatttttgttgggagcaggggtggagaagttgccttgaaatatatacagattaaaaatgtatatatttcaaatgtatttaacaaaatttatagctaagcaaatattccctacgatctaccaaaaaaatgtagaaattatccacaaagaatttagggcttcatctatttttagaggaagaagctgttagcatgctgtgttcagaataaatacattcaattaagttaataaattaatcatgtaatctttgattaagattatcaccaatgaaatatagctacacaaacagtaatgattcaactatagctttgcttattgcaatgaaaaggatgatctggacatctagataccctcccgaaaaccttgtgaaacctgtgactacctcttcatgtaagtccctctccccacccccgactggggaagtcaatgatttaccaaacacagcacacagctggtccatggcaaaggcagcaggaacccagcactatctgcctaaagatggtgacctgcttatgggtggccgtggtccgcaagtcattagtagctttggcacacgggtctatcttctggaatgaccaggcctccctacgtaggccagagtcttcctgcacaggccctgggccctaaggctgcacaggtgcccgaggtccagtcagcagatatgttgggatcaaggcatcgcgtgtccttctgctaaggcagtgtttcccataccactggcaggcatcaagatcacttagagagcttgtaattcctcaggaaatgaccttcaggcctctcacaaaaagtgtcaaagaactgaaactagatcaccacaccagatgcctgacccctcattcaccatgatcgcttccttgccccaggctggagtgcagtggtgcgatctcagctcactgcgacctctgcctcccgggttcaagtgatgcttctgtctcagcctcgtgagtagctgggactacaggtgcacgccaccacgcccagctaatttttgtatttttagtagagacgggatttcttagccagactggtctcaaactcctgaccttgttatctgcccacctctgcctcccaaaatgctgagattacaggtgtaagccaccgcaaccagcctgagccaccgcgcctggccctgttttcttatacattgttatatttcttgcctgctatataaactcctggttttgatcagtcagggagatggatttgagactcagctgcagcaccctattaaagccttcttccttggcaatactcatcatctcagcgattggctttctgtgcggtgagcagcaggactgagatcaaacccctggtgtttcagtaaccattttcctactgtttttcttttctttttttttttctgtagagccaatgtcgtgccatgttgcccaggctggtttcaaactcctgggatcaggtgatccccctacctcagcctcccaaagtgctgggattacaggtatgaaccaccacgcctggccccctagtgaaatctaaaattgcaacgctcttttttctcacagttttctcatgtcattaattctctcttctacttctctaaaaactttaatctactccactgtccctgacattttagtttttgtctgactacactgtcttgcctaccccatatttgaaccactttttcactactgcccccagcccctattgccctaacaggcctcccaggcttctcagacccgcgcaatggagatgaagcctggagttactgactgtgctgcgcaaagcaggccaggagcccacagctgtcctgaaagcccttctgtttgtggtgttcaccttggacaggccttcgcccccgacttcgttcatctgttcttgctcagcttatatcttctcttaacccaccgcaacattcatggctgagaccccctaacaaaagactgattagcaaaagaaaatcatgcaaatttatctaacgaaagttttacatgacccaggagccttcagacatgaaggcccaaagaaacagggaacactgtatttttatgcttaggatggataaagagtggacagtcctgtaggatggttggacaaagggaagatgagctaatgagaataacctggggagaacttagcaaggccaatttgttcagattccgcttggcatcgctgggtcttcattcctcttctctaggtacagggaggaggaacctctggaatgagcgtctaatgacctactttagagggaggccaaataattattttaggacctgctttggaggagaacactgggagaaggtcagagagatcttcccgctgctgccctgcgttctccttcccctcctttgtctccacggtccccgcccttgtttaccctcccgtgctcttaccaccctccaggatcatactcaatgcattaaccctttccctcgtctcttctggcttgttcgccccaggcctccccataaacctttcttaataaatccttctttctccatcctgtgtctacgtctacttccaaccattttttctccttaaatatttaattcaccatctttacctacatgcttattttatgcattatcacaaaattatattttcagcccccatattttcctgaagctcttttgcaactgttgtaaataatcttctggcagccaaacccctttttcgttccctcattaaggagggtttatacttaggaagcagccaccacttccaccactgagctggcattggcgatacgacaatgaacaagatacaaatggcctttacccttatggagcacgcagtccgtggtaaagaaagcaagaagataatcaattacagaccaacctggataacacagggagatctcatcgctgcaaaataaaaaaaattagccaggcgtggtggcgcatgcctgtggtccagctatttgggaggcttaaacaggaggatcatttgagctggggagtttgaggttgcagtgagccatgatcacgctactgcactccagcctgggcgacagagtgagacctgcagtgagccatgatcacgctactgcactccagcctgggcgacagagtgagaccttgtctataaaatgataataataagaataaccaattgaattacagcataacaaatgccaggatggagaaataatgggaaactgggtgcagaggagggaggtctttaaggcagatcaactctccttggcatttagttctaaatactgtcctcccatgtggcttgtaggacccacactcccctgagactcctcctgccactcctacttggttttattctttgtcactcctccatttccccaactatctttgaaatattcgtgttccacaggactttgtcatttacacactcttcccttctctttctagaggcttccttgagcatgctcactgcttgaaaacctgatgaaactgacatccgtctctagcctggagacgttctcttgcacactcagctctatgacgggctcctcaaactcaaaaggctcgggaactgagctcattatgtttcctcccagtccttctcctattatctgtcctactctagttaatgaaattttcacctccctatttggagcaagtccaaaaactgagagtcaacctatatttctccattttacttattctctgccttcactggaggctgtaccacttacaagcacatactctaaagccagatggtgtggactgaatcacaattctactatttgctagaagagtgccttaggtaaattactgcatagctctgtgactccatttcctcatctgggaagtgtattattaagaatgtggctggcctttgtccccaggttttgggaagtaacctctaaacccctgccatttcccgtgctctaggggtatctttgttattcacagggggctccttggaccacacttggtagtctatgtgaacatatgacttggaatggaggctggtcaagacggaaagacccaccatgtgattagggagtcgagggctttgaaccatattttagtggcctgactctgaggaggagaggggccaaagactgagacacatgggcaatgattcgatgaatcatgcctatgtaatgaaaccccaataaaactcacaaggactcaggggagcttccctggttggcaatttcctctgtgcgttgccatacactgaagtgccggaagggtagcacgtcctgaggacaagggcagcttcgcagctagaaccctcatagatccccttctgtgcatctctccctttcactgcttctgaattacatccttttactgcaataaaactgccatcataagtatagtgccttcctgagttctgtgagctgttctagaaaattgttgaacctcagggagtctgtagggacccctgaattggtagccagctggttagaagttagggtggctccggaggcctccaaacttgcagctggtgtctgccgtgaaggaagtcttgtaaagaactgtgcccttaacctgcggtttggcctaaatccagacagggaattgaagacaataacgcctaatccatatggttactgtgagaattaaatgagctaatacagataaagcctttgaatagtaactatcataagtacaaaatgaatatcacctatttttatttgtattgatttatttttatagacagggtcttgctctgttgcccaggctggaatgcagtggcaccatcgatcattgctcattgcagcctcaacctcctgggctcaagtgatcctcccacttcagcctcccaagtagctaggactacaggtgcacaccatcatgcccaactaacctgtttaattttgtagagacgaggtctcactctgttgcaggctggcctcaagctcctgacgtcaaacaatcctcttcagcttcccaaagtgctggggttgatgttacccacctttagaattgttgccttgcattagtgtgaacagagcccatatacatgaggagtctgcattcccagggtcttcccaatgggcctccactggatgcccatagagaagaatggtacacagcagaaaagcagagagagagagcttcatgtggcagcacacagacatagatccccacctcctttctgggcctttccttcacacaacacaaaagcatgaggccactgtggatgggcaggtaatccttttgtcccccaaggcttgtggaaagatcttctgttgtttgtttgtttgttagtggtagggtggttaaaagcaaaagccatctgcccctggatcatgccccatataaaaccgaggtctgctaccagtgagccaggagcaggaagctttctccaaagaaccccacagatacaagcagagtttgactatgagacaaaggcagaaatactgagaaaaccccatacatgaggtccaggctaacagggatagcctaagattgaggctggaccaggagaattaaaaaatgccccttccacaccttaagtctttcatgggaaaataagcaacaacagttgtttactcttgggagggaggaatcaaatgaaaagagagacatcttttgtgtacaggcattcagggtctaccaaaagatgaaggtgaaacagtaacattgacaaaaactctccagcacaccaggtccttcactaatacaaggtatcagagcccacgactggaagaacttaaagtttgaactaactgtgattatagcagcaacaaaacccaaacccaactcaaaccagacttccacacaagtggcctggcagaagaagtatgcccatttctggacataaaatattttaaaagtccctttattactattgttcttctacacacaatgtctgatggtcaatttttagaaatacatatacgtatgatgtgtaaagcaagaaaacatccaacttactatcaagggataaagcaatcaacagaataaggcccagagatgaacaagatgctaaaacaatcaaacaggaattttaaaataaccatgattagcacaggacaaaaagatcaactctcatcacttctatgtaaaatgtatttaaaatcttaaacagtgaaataaggcaagagccagaaaaaaaaaggcacacagacttaaaaaaacaaaactacattcattacctgactgcataaaaattccaaataatcttttttaaatgctattggagtaagtgaatctaacaaggttgtggaagttaaggccaatatataaaaatcaaatgtctttttatatactagcaatgaacaattggaaattcaaattttaggaaacatcatttaccctagtatcaaaagcatgaaatatttggagataaatctaacaaaaatgtgtaagaaatactgtgaaaattacagaatattgatgatggaaattaaagcacacataaaaaataaagcaaactaccatgtcatgaataggaagactcagtatggttaaacttttaattcttcccaaagtgagctataggttcaatggaaatccaatgaaaatccaagtaaggctttttttggtagaaaatagcaaaggtgattccaaagtctacacggactttacctgcactatatccaaaatttagttcaaaatagacgccaggcataatatcacacctaaaactataaaatcttctagaatgaaaaaagaaaaatctttgttaagcaaaacgaggtgtaaaatgatgtaataatttgggggagcaaaataagcagtttattattaggttaaaaatactcttaccacacaagccagatagatactccttttctaagtatttcccccccccaacccaaaatgaaaacatatccataaaactaaactgcaaatgaatgacacaagatttacctgcacagtgtcatggcactatggggctggcaaggtagtagcatagccatggtgccaaggcaaacttctcaaatctctctgtgcttcagtccctagaaggaactcagctacaggcgatgcccgatcaggttgaggtttggaatgggccctggatactggcatttttaaaactcttcccaggtggccgggcatggtggctcttgtaatcccagcactttgggaggctgaaatgggaggatggctggaggccaggagtttgagaacagcctgagcaacatagcaagatctcgtctcaataaataaataaatattcttccaaggcaattttgctgtgctgctgggtttaaagcactagcaggacaagacagtcattgtttctagtatatatgtgaacacattgcaggagggaataacatatacaaattagcgcttaaaaacattcaggaaggaacatacaaaggagcaaagaattatatattcaacacatgttttgtgctctagaagaaattaaacagaacatggaatcaaacaaaaattaaagataaaataggtcaaaagagaaattggagagaaaataaagcaaaggaaggacaaaacaccattagaaacacccaggaacagaatgatcagctgccagcaagtcagtgtcagcaagggaagatctgaaatgctagcaaagaggaagaagaaaaagattaaagacattgaaaggaaaagatatggaggacagacaagatacaaaataaagcaaaacataacattgctctcaaatttgaaacacgtgacaggaaagtgttaatttagagaggtaaaattcaacagaaaattaaaaggcatgaaaatggctaattaatatgtggaaggattctgtgtaaatttagaaaaatgaaaacaatgtattcagttggtgcaaaagtaattgtggtttttgccgttaaaacctctttgcagatcacatcatcgaaaactgaaaagattgatgtgtgggcaaaggtgtaaaactagaaacttgaatataatgttgaataaaactatcattttcaattcaaataccactttacttcagcacatttatcttacatatacactcgcaactaggaaaggaatatggacaagcaaagtcactgtgtcatttttagtcattgtaaaaaccagaaaaaatctaaagttttgtttgtaaaggattggtttaaaatcatggaatatccatacaatgaaaaaggtaggtgttcactgggaaatacagtagctgtctatgttgatagggaaagaccttcaagattgctcaagtgacacaacggatatctaacaatacgtatgaatgcataccctcctgttagggaaacaggagcctaggagagtcagggtgacaccactttaaaatcaactccatcttaaacctaatgaggcacattccttgccagttaccacctgtattagcctcttctcatgctgttaataaagacatattctagactggataattcataaaagaaagaggtttaattgactcccagttccgcagggatggggagggctcagaaaatgtagaatcatggcagaaggggaagcaaacacgtccttctgcacatggtggcagcaaggagaagtacagcaaggagaagtgtgaagtgggggaaaaccccttataaagccatcagatctcgtgagaactcacgcattatcacaaggatagcatggaggttaccgcccccacgattcgattacctcccactgggtctctcccatgacacgtggtgattatgggaactacagttcaagatgagatttgggtgggggatacatgggtgggacacagccaaaccatgtcaccacccatggtcatagaatgttaatagctgagaaaaacgcctaatgcctgcaaggacaaactcttatgacagcaaaatgtcccaatgtcccaatatcacatagcaatatatgcttttaaagataattatagtcatgctgtggtgtgtttgtgcactaaagtgccaaggacagctttctttaaaccaacgaggaataaattttgtcacaccgtcagcccactggcgtgtagacataatgtagcttagcttttacatagataagacccctatataagaaaaacttaagacaaagatgaggggttcctcctcttgctttctgaggatgccctactttgtatctgggtaggtttcagtaaactctctctcctcactgcactctgcaactcaccttgaattctttcctgcacaagatccaagaactcttacttggggtctggattggaacaccttttcctggcaacactcctattacacttgaaatttcaatcgtatgcctgtatttcttctgtttcaaatgttaaaaatttatatgtt

SEQ ID NO: 523 - DNA, 22216 bp, Homo sapiens
tttactatcttaaacaaggtcatctgaaaatcacttgaagattgttaccaaattccttcataaatattttctacaaacataaatgtccaccagaaatttcagataaagtactatttctcctgtgtcaattctttgtatttaaaatttatctcatatacctaggttttaaaacacgtttttaaattttcagaactcatttcatgctgaacatgttaagtgctaggatattcttactttgtcttccgagtttaggatctctgcgggggtgtggggggtgtgtctgtagaaagcataattttgattgttatccaccaattggaagaaatccctactttaatctcttttaccttccaagtgtacatggtcccaaatttgtcagtcttagaatttcttgaaacaatgcaattaaactgcaacatatttcctaacattcttaattaagacagtgactgaaaaatgtagattaacagaagttactgtttttatcaacatattttctctctctttcccgccaccatcacatccccctccccctaccccttcttgctttaaatgtctgatgtcagtttcatccacatgtacattatgcacatggcactgaagaaacaaagtaaaaaattctcttttaattctgagctgcatgcccagcgccacatgcactgtctgttacatgtcgcttcttatgaggttcatgctgggaagtttctttttaaaggcgaagtgtttctgaaggaaagagttcaggttgggcagattgtgttagaaaaatctcactgtctccgagtggaattaatatactgattattctgtgcaggctcaaactggcagcgtgtgcaaaagttcaagagtgtctgggaattgaaatatggaggagaaagcgggagagtgagcagagacaaagaattggaagtagggctcagaagtgaaactaaacggtaactttgtaaagagaggaagggaattcaagtctgaacaactgtcatgaagcagtacttactgaaaatatttttatggaatcaggaagctccattttccatggcactttttaggaggggtcttacaaatgagtttggttattggaggagagttgccggcgggggggggggggggggccgggggagtacttctttgagttctcaagatccttgccagtttcaattaagtcacatgagaagcttaatcactaacatagaaatgtaaacgggttgcagtatttctttggcctattagccaagattttttttttcctgtttattaaaatttgagtccttcatgatcactgacaaacaatgattcattggtttacaaataaggaattaaaaggtaagaaaagcaaatgcaatcacgcagcacctttcccatcgcggggaaatcaacctttttactcattgcctctcaggggaaagaacttgggacgtgagcatggagttaatgaagctttcacccatctcctcctctcaaccgtcatcccggtttaatcctctccttctgccaaagtccagaggccctgcgagcccccgtggagtcgcctgagccagatgctccgcacccagcctccccaagccccggccggctgccctccaggtgcgggctccaggccctctcgcgcggcttcgggactcggccgagcccgggcctagtatccagagtcgaagcagccgccgggaggtctgggtgggcagggaggccgagaggacggtgcaccgcccggcagcgctgagacctggccgcctaggccaccctgcccggcgagggagaggggtgtctcctgcctggagcgctccgcggtggcccgagagcaggtgctggcgtgcgggaggcgcacgtggagccctgcggtctgttccacctgcagaggcacaattgcccagcgtggggtggaaggcaggctgggagctcccgggacgcggcgtggcagcgcagggctcggctagatgcgctcctcctcggactggttgagtaagggaggaggctcgtcctgaacgtgcacagccgctcctaactccgtcaacggaatttcactcaactccgagactgaagcattttattggcagcatttagaatcggggaaaaatctaccttctgtttagcagttgctcttttctgaagcagaaaattatctctagggatgacttagtaatagggtaccccattgccatgtgggtcagggattgggggaatgtccggatcctgccaatgcacctctgtaaaaggtggcattcagcctgggaggagaggagctggcagggcaggccgcccccagacacgcacaggcccaagctctgtcctgcagcccctcccggacacgcacaggccctgagccctgtcctacagcccctctcctgttgtcatttgctatcagggcagttctaccgccgccactaagctttgcttctcccaacacaaccaagagacggacatatagcagtgaatactgtctggatggtttagcatgtctggggcgggggtctttctattgcctgcaggggtttccgagtctacccagcaggtgctcaccaggagtgggggctgtgactgggacccatggcctgtggtgtgaggggtgaggggccactgtgtactgtaaccgggagcagcctggaagaaggcccctgctcccccttccctccggcgcctcttactcaggaaatcttaatgtgggaaggatgtgtatggggctccataagcaacactgacccagtcctggggagagacaaacccctcgtccgctctcagatcatcctcagagatcctctggggcctctgagttgaatcccaggctctcccctgctttcgcgaggacccaaggcttatgcacacagagggtttctggttggaacacctaaaagttgattgatgacagagagatggtgctaaactggcatattgcaaagcaatcttggtatttgttctttgtcaccttcctcaaggctcaaggtgctttttgggctaaaatggggcattctgtgaacgtgtgctacttttgaaaaatagaggaaggggtgttggaagcctagactggttctcttgccactcctcaaaaagcaaaattttgcagcccaaatattaaaaattgactccgcgtattccttctcccccacagtggcacacaactgggcaggctccatctcgtctgctgctggaacccactagaaaccaaatgagccctccagcaggcctaatcactctgatctgtcatggaccttctagctggaagagttatgccatcatattatcccaacactcatcagtgtgtggaggacccccttttactgaatgatttattgctctttgcagaattcctttggctgcagattttatttctgagtcactctgttcagctcaattggtcgccttcagttaccgtggcaaccagcagatggggttctttgacaagggtcagcggggaggctgccttggtttggacagaagaggagctaaataaaaagctttcagcattgacggttccgtagcggacggccaggagttgttatcaaattacttgcattaaaacctaattaagatgtgtgccaataagtgggctgtagtgattgaatctggttacttagctgctgtgggcccaatcttatgccatcacacctctgtggctagtttgactatcccaagaatggtcaaatatgaaggaaattgaggaagacctcaccacagtgtggaacgtgacatactctgggaccacaccaggagggttttagtctctgggagcaccagaaagtccccattcaaacagaaacttcctgaaaacacagcagtgtgccccccaaacccaagatggcaactgaacaggacctccatgcgtctgatagttccatgtcttccgttaagactattggtaattcagttgcaaatagcattcaacaaaataaaactggcttgtaatcactctgggttaaagaagtctaaatagagacatgccaactaagtatgaaggatcttttctggagtgggaagaaaggaacattattgggccagtcaacaagattagaatccaattcagtaggttagatgaagctattagatcaatatgaaattgactgtagttggtaatatactgtggttctgtaagagaatgcctttatccttaggaaatacacactgtagcatataagataaaagggcaatggtgcatgcagcttactgtcaactggttctgtacacacacacacacacacacacacacacacacacagagagaaaggcaggagagcgtaatcaatcagatggggcaaaattattacagtaggtgaatttgaataaagggtatgttggtattctctgtaatattcttgcaactttttataagtttgacattatttccaaataaacccatttttaaggacggctttagggtgaggtagggtacagtgtgcgtggcagtgtgggttttcctgctggtgcttctgtatggccttgagccacatgcagcatagatactactctgcaaagattctgattttcaacaatttccattcctctgtcccatttcctttgcacagtggggctatcctcaccattagtctgttcttgcttgagacaaagctgattaaggtaactcttacttcaggcagatggtcttctaggttcttcaaagtctaagattcataacgtgtcaactcctgtttcatggtgtcaggatcctttattcatgcccagtcttccaaaggtattacaaactcagccttggttcgatagcacttgtattttaagaaggttacaaggtagtgattcaacagatctaattgccctaagatgaagctgtgcctcctttttggtagaagcactgtttgaagaagttggtctttgaagagcctcggtgatattgtcagaggctttaggttcctgtcagaggcagctgtgctggagcttgaagagctgaaagtgtccccttggccatgggcccattcactgggggccagtgtggcactgtgggcttcccaacatggtcttccaagcttctggcctcttttgcatcctttgtgccaacaccagtctgtggatgagatcaatgtggctcagagtgtggtttccagagtacggtcctcaaactgttactggtctgggatgaggcaagaactgaaattgagtcagaaattttcaaaacaatcaaacactgcttcctcctttttattgtactccacaaaaccattagtctacaatagattggaaattttaaaagaattaaaatcaagtctggttctcctcactgagctcattggggaatccctggcctagggatttccctcttctcccgcccccaggcctcggaaaatgaactggtgtcagctgctgcccagaaggttacccagcgtgttctctctctcagggtccttcccttaaattctcaagtttgacatggaatagaagaatgtcgggcgtttcaaaaaaggattttgagatgctgcaaagctcactggatttagagtcaagagatgtgggctctagcgccagatttactacagacaggctgcctgaccttgggcaagtcacttatactttcttggcttcaccataatgggctgaactgaatgttctctaaggtgcctctcagccctaacataatatgattcttttcatgagaagagcaggacttgatccccccatcacttgggggcatccccaaggagccccctgttcttcctctgcaggcagccaaggctaattaggaatctgagagaatgagccaggaaaggggcagtacaggacatacattctcttcattgaaggtggtaccccctccccactgcacgatcctcaggaagaattcctttattgaaaccattattgaatagggtagatttaggcacgggaaatgtaaacagcaaaccagccactaaaagtgcgttaatgtcacgcctgtaatcccagcactttgggaagctgaggtgggcggatcatgagatcaagagatcgagaccatcctggccaacgtggttaaaccccaactccactgaaaataaaaaaaattagctgagcgtggtggtgtgtgcctgtagtcccagctactcgggaggctgaggcaggagaatcatttgaacccgggaggcggaggttgcagtgggccgaggttgtgccactgcactccagcctggccacagagtgagactctgtctcaaaaaaaaaaaaaaaaaaaaagaaagtgccttaatgttctgagcaaggataatgggctagagcgtgttccggaagcctcagcacactgcttgttctcactgataggacctcgttcacgagatggaattatgtaaaatgccgcagcaatggttaagtgttggaacaaagtaatacagctttacattaacatggtttattcactagaattaatgacctagagcagtaattgcattttcaaaacttcagcttgctgactaggtgtattgctatgtaaatagctagcgatatttgaagataggaacacagtaaaatctgtaaagtaataggattgtagaaatatggagctggaggagaatgtagtcatcttctagccccgaggctggcaaactttaaaaggtcaggtaataaatattgtaggctccatggccatatgttctctgtcgcagctactcggccgttatggtgcaaaagcagccatagacaaaacgtgaatgaatgggcatggctgggtttcaatgaaagtttatttaggggcgctgcaagttgaatttcatgcagtgttcacatattatactccttttgatttttaaaaatcattttaaaatgtaaaaatcactctcaattggcagatcatacagaaacaggcagtggcctgtagtctgaagtttgccgacctcacttctagttttctcctctcatttcacatgtgaggaaactgagattcaaagtgatcacaggatttacttaagttctcatgactgacgccagagtattttaggagcagactaggagagttttcatgtagacagttggttgttttgatgatgaaaattgaagccacacaaaaattattctccagaagaactcatttcgtatgtgtgattaatactgtgaattagaatgtaccagtggttctcatgcttaagaattcatcagagtcatccaggggccttattaaaacacatgctgctgggccccaccctcagagttgatggttcaggtctggagatcttattttctccattttacaaatggagaacctgaggttgagagagatactcagtctcaggcttaaggtaaaatagctagcttgtgatgtcccccatttccaagttcagcactcataggattaggattagagctataagtaatcatcaagcagagaggcagggctgcagttttgtttagagagatccttctagtctagctgttgcggggagtatggattccagggggccgtgtggaagcacacaactctatgagaaggctgtgcaggaacctggatgtgaagtgctggcagctggacttcaagagtgaaggtcatggaatggatgggtggatggatgagtgggatggatggatgggtgggatggatggatggataggtgggatggatgggtgggtgggatggatggatgggtggatggatggatggataggtgggatggatgggtgggtgggatgggtggatgggtggatgggtgggatggatgaatgggggatggatggatggatggatggatggatggatgggtgggatggatggatggataggtgggatgggtgggatggatggatggatgggtggatggatggatggataggtgggatggatgggtgggtgggatggatgggtggatgggtgggatggatggatggatgggtggtatggatggatgggtgtgatggatggatggatgggtgggatggatggatggatgggtgggatggatggatgggtgggatggatggatggatggatgggtgggatggatgaatgggggatggatggatgggggatggatggatggatgggtgggatggatggatgggtgggatggatggatggatggatgggtgggatggatggatggatggatggatgggtggggtggatggatgggtggatggatggatgggtgggatggatggatgggtgggtgggatgggatgggatgggagaggttcagaaggcctagagggctcatctgtggaaccaggagactgagctgtggggatggtgactaggggtggtcccacccactgagagggtcacagagagaggagcattagaaggtgactccagtgtgtcaggtggtgagtttgaggtgggcttggaaatgcaagagagaggcccgaggctgagatcaagtgctcaggatccttggcctctccacttggagtcatgagtgtagattttaaaaatcatgcaggcggaacatttccagtcaggagagcactgagcccagccctgggtcacaccagcatttgaaggtctgatggaggaggaagagggaccaaaggggagtgagagacctgtacagagtctaagaaggagagtgatgagtcgcactgtgggccttgctctgtggccttggtggcttaggtaatcctggctctgccttaccttgtgtgcgcttgggcaaatgatcgcttctctgcaccttgcttctctcatgcataaaatgcagatgataaagtaacgtgtagtattgttatgaggattaaattagggaatgtaaaatgcttacaatgttgggcatttagtaaatgctcagtaaacattagaggaggccactgggaggagtagaaaagtgagtgcatattttacagttcatgtatttgcacctttgaaatccatatgttgtttgaaaaatgttcttcatttccatgaggaagacgccgctcccagggaaatagtgagtctaagcactttgagaacacttatctaagaggaaggacaatcttagctgtagtcagagtgaccacagggaggaggctctggtctgaaaacatttcagaacaaaggattttaccactaccaccaaaaccaaacccaaaacaaaaccccaaaacaacaactaaaaccttccactgtagtccgtaggtagctcccagggggaattgtccagtgaagcaaaaaactctcattgaaaaacatacacgcataaggatataggccccctctggggaaggaaggggctggcctggagaagaaatccattggtagtggccctgtggagctggtgctaggttcacaagtgttcatttggttattatacctcatgacttatgtatacattgcatatattttgtatgtatcacatacaacataaaaaaatttaaatctatgtattcacttgctttcacagtattcatagcaaatgagtgtctgaagcataggaccagagctggcagcttgcaccgcttctgttttgcataagatattttccccagcccactcagctctataaagttgttttgtatttcaccacttgctccatcttatcttgaagccttgcatatttttttaaatgctggttctgatcatgcttgcagggtgtggctcagaggatcgctgttggaccaatggagatctgcctgggcccagcactcttatgagtcccctgtgatttcatcagcatctgcctttagaaacccgggcgtgtttgttcccatggtaactgctgcccctgacacgcctgaaattcctgggatgcccttgcgtggaaggggagcccgtgctgcccattctacccctgcatggggcagctgcttttctccctcagggtccccagtcctacccaggcaggggtggcagttgttcatctgcagatcctgaaggacatggaccctgtgcctgagattaggacggccgcaccagcctgggtgcaggctccctcaagtgtccttcctcatggacccgcggaccctacgctgtgctgtgagggccggggagcacaggggcttcctgggaggaggactggcttcctgcccctgatggggcctggccacagctcccagggctccatgacagcacagtgaagatagcaaccacatcctgggggccctggatgcaatccctgcctgttgcaaagatgagataaaggcgcgggaaagaagggtctgaattaggggttgagctctgaaatcggacgattctgtgtttcctgccgcatggagggcgtgtgtggttcgcaggctgtggggggcttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttgggaagtccgccgtcctctgccgtgaagattgcccctctctcctccagtgcctcctccccagcggcttcggtggctcccaccctccgcaccccgtctcgcgacctccccgccagcccagcccctcaccagaagaggctttctcttccagcccctgaaatctggcttctgccccagccaggaggctccgcagggcgctccgccaccaggtggcatttcccacaaaccggccactccgccctgacccctctcctccctggacctccgtctcccagttttcctccctccaggatcccactctcagtgtcttgccggattccagtccactgccagccattgaaggcggaggttccttaacccctatcctggggcgagcccttccctctcactgcagaagagcttctcagctaggggggtcgtgcgggcccggagagctgcatttttaacaaactccccacactgacaatctttgccaacccttcccaggcaaatcttgcccccacgttcatggtctcgcctcccagcaggtttggcccacccagctagagctccagctcggcccttcctaagccccaagttgcatagctgcctggtgggtgcgtgttccacaggtacctcggactcgccctgaccccagaacgtctcttctacgccaggccgatccctcctgccatcctctgtctgttaaatggcactgccattgcctgcaggacgaagtccatatttgctggtttggctacagagtccagcgtcgccttcctctgagcagcctgcagcctctggtgcagccacactgcacagcttgcagtttccagacacgcattggcctttgcagtgcggccccgaagtgggaaggccccgcccctggccctggccagaaaagcacccactcatcctttcccatcccagcttgcccgctgagtgactttgaatcaatgattcatgttgtctgtgcctcagtttccttaaccttaaagtggcataataattagttcctgcctcatggaattgtgagtgctaaataaacagtaagtctagtgcccgacataaaagtgctcagcatacgacgatcatgagccatgtctaagcaggcgcaagccctcccaggcttctcatctgcaatattggccatttctcttcatgcctcagtgtcctgtttgagttgagcatgttttttttacaagtgagtctctcctccattggccgggaaccgcccgagagccgggagcatttgtcattcttgatggacccccaggtcttaaatcagtacttgacccttaagaggtgttggccgggcgcggtggctcacgcctgtaatcccagcactttgggaggccaaggcgggcagatcacgaggtcaggagttagagaccagcctggccaacatcgtgaaaccccatctctactaaaaatacaaaaattagacaggtgtggtggtgcgcgcctatagtcccagctacctgggaggctgaggcaggagaatttcttgaacccaggaggcagaggttgcagtgagccaagattatgccactgcactccagcctgggcaacagagcaagactccatctcaaaaaaaaaaaaagaagaagaagcagaagaagagaggtgtttagcaaggcttggttcgtttggtgaattaactcagtgagttaaccaccattaacgatggttaaggacacttgggcgctggctcgatttgactccgagctttaccgattacttgtgtgactttgtgcaagttaattaacatctcagcttgttttctcatctgtgaaatggggatgatactagcatgtacctcctaggactatagtgaacttttaattaagataattattgaatttaacaggtagtttattaatgaaatttacataggtaattgtggcgcagtgagcccaggggctcaaggtgttagcagtcatcaacagtgctatttgaaactgtgggtggatgaagaggtgaactcaacaccacaaatatgacagagcagtaaccaccatggaaaagaaaagagagcttatgtgtctaggacaccccaagaaatctcttctgaatgaatgatggcaatgaaatagccattaacagagggtaggctggtttgtgcagggttggaggcttttccaaaaataaataactttcaaaaaatctcagccaggcgcggtggctcatgcctgtaatcccagcactttgggaggctgaggtgggtgaatcatgaggtcaggagttcaagacaagcctggccaagatggtgaaaccctgtctctacgaaaaatataaaaattagctgggcacggtggcaggagcctataatcccagctacggcaggagaatcgcttgaacccaggaggcggaggttgcagtgagctgacatagcaccgctgcaccctagcctgggcaacaaagcaagacttcgtatcaagaaaaaaaaaaaaatcaatctcgggccgggcgtggtggctcacgcctgtaatcccagcactttgggaggctgaggcgagtggatcacttgaggtcaggagtttgagaccagcctgaccaacatggagaaaccccgtctctactaaaaatacaaaattagccgccgttgtggcacatgcctgtaattccagctactctactcgggaggctgagacaggagaattgtttgaacccggaggcggaggttgcggtgagccgagatcgcaccattgtactccagcctgggcaacaagagcaaaactctgcctccaaaaaaaaaaaaaaaaaaaaaaaaaaaatctcttttcccaatatttgtaatactgggagtgttcaagttgatttaaaaattgagtcaattggaatccatcctcagctcttagctgtgaagggagagctgccccttcttagggatctcacttctcacagcaggggtgcttctgtgtgtggacatcctggtcagctggtcccctgctgtcttgtggggctcacacccaggcacttgattcagcggggtctgggtggtgtctccttcctccttcccaccccagtaatcgctatagccttcccaggcccccaggttgcaaagcactctggactaaacctcctccaggttctgagggctccataggaggaaggtctaggccagaaccggccccatcgctgaaggtggagccagggtggccggccgtgaccggtgtttatgctgtgagagcggctttggccctgcccattgccctggatgggctgccatcccttttcaggagttcaaaaccacatactgagcccatcggtccaaaggaccatcatctcatttgatccaagcacagggcaagggaccacatggacaatggctgctcgtggcaccttcttgccatgcagccatgtcatggtgtcacttgtcacgtttcctggcaccttcttgccatgcagcaatgtcatgatgtcatttgtcacgtttctgttccattcttttcgagcaagcaggaagccacggggctacctcagttgctcttagccagtagctctctccacaggtaggccttcatcggaggggaaaagccaccttagggttccagagctcaagggcgaatgatgctttccacccactaatttaaatacggaagcatcagattgtctgcttctcaaggaaaagagctgttaccatctctgtctcttcaatgggacccactcctgggccccacagcagggcaggtgctcagatgaatggtggccgcctgcctgtgtcagagggtcggcctaggcaggttccccagtccgctggcccgggacgtcctcctctctcccggccgctcactgttcaggacagcccgggcccccccctggggccttgcaggagagcttctgtgatccactgggtggctttgagggtagctcccaggaaaggctgcctcagccccagcgtgatggggacgggtaggggccgatgaggcttcccagagcagcgatggccttaggtattgccagaaggaaacctacttttcctccaagatcagagggaaggatgaggtggggtgttggagcatcaccatatatatacatcacacacacagggaaacactcctacttggatggaggatctttgctgttctgttgaggccagcctgatcctggaggcagggcagggcctggctgttgcccaggctccaaagaggcgccagggcgtcccttagtccttacactttctccagaacctgcgggcagcaggaggcccttgtcgggacaggcaaggggggcggtggtgcggaattgtgggcgtggcagtcggaggtgccaagcccggggaggcggggcttcctgggagcatgcgtagtgccggctctgcctgggcggggtcctaggctgctgctcccgcctcccccggcacaggtagggcgccccgcagacccggacaacgctgggtgtggctgaaaacagggagtcatggtgcgttctggggaagggtcagggctgggggctcgggcccctggaccaaagactctagccaaatccatcggaggctgagcagggcgatggggcagggccgggggagccgtggggaaatgggagggtgtgggccgagcagcgccggaggcaggtaccgaccatcgccgggtttcccagagggcagtggtacctgtgcccacatgtgcggccttttttgtaaaggaacctatcccaacccgaaggcccaaacgtgtggccgtgtaagtttagttgtgcccggagtcccaggagagcccggactgagggcagccagaggccggtgtccgcagaacggcccacgaggccttcggctcagtagcctggagtttgaaatgcaccttgagctttaatggccttttccttgtgagaattcgagttaacgtgcctgctggtgcttttgatgggtgaggacggtgaggcaggccacacatctcgcttctttccagaacacttctgggtagtcgttcaattccacatttaatccaaagccaacagttccatgggtgactgtgctgctggctgtaggaagccgactgtggacagatgaggataatggtctgagtgaattagcaagtctggagaggagcgcccatcagcagaatgacaaatttaggatctttaaagacatctggtcagcgatgccggagctcgtgattgactgagtgattaataatggaaaacccttacttcagtgtttccacggccctcacccacttccccagccggggcggccgtctgctcagcctgccagagacctttccagctgaacaatggcggcatttaggcccctcatctttgacctctgcttgggagttcaaagcttccttttccttctacttaccccacttatctgcgtgttttctaattgatagtgtactgagatggctcccagttcccacgcacatttgctagaatgttaccttcacacagtgcgtaccaaggacctagtgccagccagagcctggcacctcagggtcaccctaggcgtcctgctcatggttccctatcaggggcttccctcagatacacacagcccctgggcctgttgaaaggctgacgttatccctctttaattctgcggtggatttttctccaggctaaggcagctggataagcacagccaggccacagcccagcagctggtgcagctcctcagcaagcagaaccagcttctcctggagaggcagagcctgtcggaagaggtggaccggctgcggacccaggtactgtgcagaacgcggcgcaggtgggagtccttgggcgggcgtctacaggtggatcttttatgcacctcaacaggccggctttctcacggatcacatcggttagcagtaagctgggagggaggtcccgaagactgtgctgggcacagtgcaggacccagagaagcggagccatgggcccgtcctggtgagggagttaaagtccgtgcaggtgaacagaccccggcccgcgaatcaacgaaccacaccgagtgccaagttgcgccgtgcaggctgcggagggtgcgagagcagggagaagcgggaggacggccgtgggcggcagaacaggctttttggaggatggtggccttgagctgcctctgaaggtcgtgtatggtttgaattggttgaggaaagaggtgttcccaattagcaaagtcgtcttgaatggaaggcaggcatctcatcctaaattagctgactgattactgggctaatatctggagtgcttgcagagcacccggcagtgttacacacagaacatgcattaattccctttacccttgaacaagcaggcgatgctgactttattgtcttcatggtttagatagggaaactaaggcccagacaagcattacagctggcaagtagggacaccgcaaacggaggctaagcctgactccacagcccaggctttccccattcaggttagatccggggccaccagcagggaaaagggaggaaggaaagtgtcccggtgaatttggaacacagtatgaaacctcgtttgctaaatcgcttctcttcctgtcagagaggctgtgcattttgccccgtcaagcagtttgttaggataatgaggtggtccgtgggctgaccaaggcctccgcctttaattaggattgcacccaggtgctctgtgagtgccctggggacttcaggcagtaagtgcttggaatgattaatatgaaaaatgcatctggaaatgaaaacgaagaggagtctcattctcctcacaaaatgaccctgtgctcaaggaacctgtaagtactgacttttcccactcggtccaaaatccctctgccaaacatgtgttcacagacagtaaatgagcacacccaggcgccacggagctaaggcctggaggtggaaatgcctctactgtccccatgcttctgagactgctcccagggactgtgggggagcgggccgctcaaagtccgagccacagccgcactgccacagctaatctaggaggcgaggcctcacctggcacgctccatggcagggccctggaacctgaattttgccaagctgttgggatgattctggacgacactacattttgaaaacctctgaagtgtttggagctggaaagaacagagaattattccaggttgtgtcactgtgctgaatcccctgcccccgcttcggacaagtaacttaagcctttttccagcctcagtttctcctctgcacagtgggcatggtgcacgcctggcttcacgggctactgggagtgctgagtgcaggcgggatgccccacgggcccttgggcacacaggctgaggacgtgtgagggtgtttcctttctccctcatcttcagagggtcctgggagaggttcagggaaggcagaggcctgcagagcagcagctgtgggaccagtgccactcccctcccctctgctttcaggatgaccccctcatcctccaccagacccagcccagaacccagccctgtgggcaggtccccagggagggccccagcagcacctgctttaggcctggccagccaaagatcaggaccactggagccactaggtctcctggcaggtgactaggctcttgtcacataggagggagggaccgtgactcctggcatgagtgaatcttcagcctctaaagccaagaactctgtcagacctcaggttgtggggagtcttccgtggaagctggagcacacggcagcttcctttgggctctggactagatcaggagaacgtgggctttgccttttaactccccatctgcctgctttacagcacacttagatcttaacatggatcaccgatgcttagaagcttcttccagggctttaaaaatctggctattgccaaatgagttgcaaaattttcacaaaacgcattaaaaaaaccccaaacctcaaaaaatcctcagaaaaactagcaggtctttctttcttcttttgcctgaagcaacagcaatgatttgcccattcctgtgctatctgatactggcccatctggctcatctctaaagcggcctttcagattcaaatattacacttggagttattttaatatgaacatgacaaaagaaatttggtagagggaatgttggctttcagttgcaaatactagtggtcagagaggaggcagggatccaggtttgcaagctctctgctgaatatctaaacccagagcctgctttttctggctaagcctggccttcacctctaggtaggggctgtcagtgggcttcagcctctgcgatgccttcttgtcatggaatcagcttgagttgtgagttaggcttctgctgagccatgatgtgggcgaggctgctgtaggttcgagcaggtattttggatgcggtgccgcctgagggctccggagtgctcagccaccctctctgttttcctggagtggcctgtgggtccagatcttgggcagctgagggttagagctgtcctcatgtccgggttagagatggtttaactaaaggcttccgttttctcagcctggatgagttaagcttaacttaattttgcatgtcaaactctaaacatctctgtccacttaatacccagaagagaatgggtcgggcaatggttccaaagcaaagtccacccctttccttccctccctgtcctgggtcctgagccccgctgcccctggtggtggggctcaggctggcctgtggcctccaacaggaagtgtctagcctgttggcaggcttcattattctaattgtttctgcttgaattctgaaacactcacaacaacatggctggcagagggagcccctggtagtggtagctgccacatggatgcttttggccacgagaacccccatcctccccgctccccggcgctgtctgcggtgggcaggactcagggcactggctcaagctctcggctcgtttcttggcttttttttttttttttttttttttgagacggagtcttgctccgtcacccggactggagtacagtggtgcaatctctgctcactgcaacctccgcctcccggcttcaagtgattctcctgcctcaggctcccaagtagctgggattacaggcacccaccaccacacctagctaatttttttgtatttttaatagaaacggggtttcgccatgttggccaggctggtcttgaactcctgacctcaaatgatccgcccaccttagcctcctaaagtgctgggattacaggcgtgagccactgcgcccagctgtttttttttttttttttttttttgatgagttttgttcttgtcgcccaggctggagtacaatggcatggtcttggcctactgcaacctctgcctcctgggttcaagcaattctcctgcctcagcctcccaagtagctgggattacaggtgcctgccaccacgcctggctaattttgtatttttagtagagactgggtttctccacgtaggccaggctggtctcgaactcctgacctcaggtgatctgcccaccttggcctcccaaagtgctggcattacaggcatgagctttgcccggcctcttggcttgttcttagtttagggtgactacaaataatggcattattgatctcctgcctcacctgggttcggaaacaacttcaagaaaatagcttttaaatgtcatgaaatggctcttacttgtccttgtggagaaacagacactgaagcactagcccagctttgcctagatgcagttccccacactctgtattccgggagggtcagggcctccagacacacaccctggcctgtcttttgtttgagactgggctgggtagtcgcactctcgccctcttgagaggcaggccctggctgggggaggctgaaaccttggtggtgggggtggggggagggggattcggggtgagggtggtgggtctcaggggagtttgggcagggcctgacagcttggagcagggtcaggggtctgcggcccagagcctgggggctctaacatctggctaggaaggttggagccagctggtgaggaaacatgagtcttggggagaatggcatctgggacaggggaaaacagaaattatctgtccacttagaggatggtctcaaccatcaagatgattttctgtgtctgctttcttatttggtaatgaatacggttttggctgacttgcattttctggtagccgtcgtatcctgagcaggctgcttggttctgtctgcagtgttcaatctggggagtgattcccttttagtcccctcatatgaatcacttacagtttagaaaacagagtcggaaactgacttgtcagtggttaatcagttggccctatgacttttaagcattcttggcagtgaatttactttctaatttgatttaaacttgtgcatggatccagcagccatatgtgattatattcaagatcatcgacattatctcattataccaaaggactcatagaagagagccgaaaacaagcaggggacacagagacacagaagatgatgaagggaggaaaggcccattgcaactggaagcaaagggagaagggaggttctagaaaagtgacagctctcagggagcaagactccctgccgagggaggcctggctgcaaggcggagctgctgcaggctgcccatgttaggccttggaggtgtcacctaatttactgtggtccttccaggagccctgggggcctcgcccagctgacttaggagctaccacaaagttagctacctgtaagacagatggcgcttgaatagaacagcaaatacattgaataaaataaattaaaaagcctcctcctgaaccaagattttttggaaagaattctaaatagatgaaaacaaacaatttgatttcaaccaaattgttgtttttttgtttttatcctgattttcacccgaattgtcagtctcaaaaataaacactgatacattcccagaaaatatttttcaaataaaaactgactctgttaaagtttgccctgattctttcaaaactgtgtacaagacactgtcaaccaaagtgacttgcatatttttttaaataaacttgaacatatgcagctaaaatgtcattaactccctgctgcctgagtgtttttaaaaaatgacacaagaccctgggtgctgcatgtctaacataagcatctcgcgaccttcggagaaacttccccaaacacctccaacagcagacagttaaactttttgttttttgactgagcgccccgtgtataattaatattgaaaagcgcatagggcttcattttagccagacttgctcttccgttaacagttcactttgtccaagagtgagtactttcagaataagaatcatgggagaaaagtcaattgaattttatattccttcagatacattcactctacttattgcttcctgagtcagacattacatttcacaatataaattcacaatcaagattttaaagggagctaaatattttaatccaattagacaagtgaacaaaacactgaatattgcatgtagtgtagataagtggttcttgcctttaaaagactgtaattccgtcacattacaaccccaaatgtcagtgttgtctttatttttaacactttcaaacatgaggcagccagaggctccactctctgctgttggtgacactgtctgtcctttgggaattcttaaaatctatttaccatggaaacatggttcat

SEQ ID NO: 524 - DNA, 124278 bp, Homo sapiens
ctcactcaaaaatgcacagctacatggaaactgaacaacctgctcctgaatgactactgggtaaataacgaaatgaaggcagaaataagttctttgaaaccaatgagaacaaagacacaacgtaccagaatctctgggatacagccaaagcagtgtttagagggaaatttatagcactaaatgcccacaagagaaagcaagaaagatcaaaaatccacatcctaacatcacaattaaaagaactagagaagcaagagcaaacaaattcaaaagctagcagaagacaagaaataactaagatcagagcagaactgaaggagatacagacatgaaaaacccttcaaaaaatcaatgaatccaggggtttgttttttgaaaagatcaaccaaatagatagaccactagccagactaataaagaagaaaagagagaagaatcaagtagacacaataaaaaatgataaaggggagatcaccactgatcccacagaaatacaaactaccatcagagaatactataaacacctctatgcaaataaaccagaaaatctagaagaaatggataaattcctggacacatacaccctcccaagtctaaaccaggaagaagttgaatccctgaatagaccaatagcaagttctgaaattgaggcagtaattaatagcctaccaaccaaaaaagtccaggaccaaacggattcacagcctaattctaccagaggtacaaaaaggagctggtaccattccttctgaaactaatccaaacaatagaaaaagagggaatcctctctaactcgttttatgaggccagcatcatcctaataccaaaacctggcagagacacaacaaagaaagaaaatttcaggccactacccctgatgaacattgatgtgaaaatcctcaataaaatactggcaaactgaatccagcagcacatcaaaaagcttatccaaccaccatcaagttggcttcatctctgggatgcaaggctggttcaacatacgcaaatcaataaacataatccatcacataaacagaaccaatgacaaaaaccacatgattatctcaatagatgcagaaaaggcctttgataaaattcaacactccttcatgctaaaaactctcaataaactaggtattgagggaacgtatctcaaaataatgtgaactatttatgacaaacccacagccaataccatactgaatggcaaaaagctggaagcattccctttgaaaactggcacaagacaaggatgccctctctcaccactcctattcaacatagtattggaagttctgtccacggcaatcaggcaagagaaagaaataaatggtattcacataggaagagagaaagtcagattgcctctgtttgcagatgacatgattgtatatttagaaaaccccactgtctcagctcaaaacctccttaagctgataagcaacttcagcaaagtctcaggatacaaaaatcaatgtgccaaaatcacaagcattcctatacaccaatagtagacaaagaaccaaatcatgagcgaactcccattcacaattgctacaaaaagaataaaacacctaggaatacaacttacaagggatatgaaggacctcttcaagaagaactgcaaaccactgctcaaggaaataagagaggacacaaacaaatggaaaaacattccatgctcatggataggaagaatcaatatcatgaaaatggccatactgcccaaagtgatttacagattcaatgctatccccatcaagctaacattgactttcttcacagaattagaaaaaactactttaaatttcatatggaaccaaaaaaagagcctgtatagctaagacaatcctaagccaaaagaacaaaactggaggcatcacgctacctgacttcaaactatactacaaggctacagcaaccaaaacagcatggtactggtactggtaccacagcagatatatacaccaatggaacagaacagagacatcagaagtaacaccacacatctacaaccatctgatctttgacaaacctaacaaaaacaagccatggggaaaggatttcctatttaataaatgatgttgggaaaagtggctagctatatgcagaaaactgaaactggaccccttttcttacagcttatacaaaaattaacacaagatggattaaagacttaaacataagatttaaaccataaaaaccctagaagaaaacctaggcaataccattcaggacataggcatggccaaagacttcatgactaaaacaccaaaagcaatggcaacaaaagccaaaattgacaaacggaatctaattaaactaaagagcttctgcacagcaaaagaaactatcatcagagcgaacaggcgacctacagaatgagagagaaactctgaaatctatccatctgacaaagggctaatatccagaatctacaaagaactgaaacaatcttacaagaaaaaaacaaccccattaaaaagtgggcaaacgatatgaacagacatttctcaaaagacatttatgcagccaacaaacatataaaaaaagctcatcatcactggtcattagagaaatgaaaatcaaaaccacaatgagatacctccaatgccagttagaatggtgatcattaaaaagtcaggaaacaacgatgctggagaggatgtggagaaataaaaacacttttacactgttggtgggagtgtaaactagttcaaccgctgtcgaagacagtgtggtgattcctcaaggatctagaactagaaataccatttgacctagcaatcctattactgggtttatacccaaaggattataaatcattctactataaagacacatgcacacatatgattattgcagcactgttcacaatagcaaagacttggaaccaacccaaatgcccatcagtgacagactggataaagaaaatgtggcacatatacaccatggaatactatgcagccataaaaatgaatgagttcatgtcctttgcagggacatggatgaagctggaaaccatcattctcagcaaactaacacaagaacagaaaaccaaacaccacatgttctcactcataggtgggagttgaacaatgagaacacacagacacaaggaggggaacacacactgggagcctgttgggggttagggggataggggagggatagcattaggaaaaatacctaatgtagatgatgtgttgatgggtgtagcaaaccaccatagcacgtgtatacctatgtaaccaacctgcacgttctgcacatgtatcccagaacttaaagtataataaaaataaataaatatttttaaaagtataaaaattagccgggcgtggtggcacgtgcctgtagtcccagctttgtgttagaaacattccaatttcactcttttagttactctgaaatatgtaataaatgattgttaactatagtcactattatgctatgaacactagatattattccttctagctgtatatttgtacccattagccaatccctctttatccctcctccccaccacactttccagactctggtaaccatcattctactctttcttttctttttttttttttttttaatacagggtctcactctgttgcctaagttggagtacagtggcatgatcttggctcactgtagtctcaacctctcgggctccagtgatcctcccacctcaccctcctgagtagctgggactacaggcacacaccacctcactggctaatttttttatattttttgtagagatggggtttcaccatgttacccaggctggtcttaaactcctgggctcaagcaatctgcctgccttggcctcccaaagtgctgggattataagcgtgcaccaccgtgcctggcctctactccctatctctatgagtttatttttagctttctgtgtctggctcatttcacttaacgtcatgtcctacagttccacccatgttgttacaaatgacaggacttcattccttttatggctgaataatattccattgtgtatatgtatcacattttctttatccattcatccattgatggacactcaggttgattccatatcttggctattaagaatagtgctgcaataaacatgggagtacagatatcttctgtttgatatactgatttcctttatttcggatatacatccaacgctgggattgatggatcatgtggtagttctatttttagttttttgaggaatcatcatatcatactatttttgagacagtctcatgctgtcacccaggctggagtgcaatggtgtgatcttggcttactgcaacctccacctcccaggttcaagtgattctcctgcctttgcctcccaagtagctggaattacaggtgcctgccaccacacccggctaatttttttgtatttttagtagagacggggtttcaccatgttggacagactggtctcaaactcctgacctctggtgatctgcctgagcacttggcctcccaaagtgctgagattacaggcgtcatccactgtgccaggcccgtcatactgtgttctatagtagctgtactactttacattctcactaacagtgtatgagggttcccctttccccacaacctctccagcatttgttattgcctgtttttttggaggaaagccctttaaactggagtaagatgatatcccattgtagttttaatttgcattattttgatgactagtggagaattttttcatatacctgttagccatttgtatgtcttcttttcagaaatgtctattcagctgttttgcccatttttaataggattgtttgtttgctattatttgacctcctaacattctagttattaatctctcatcagatgggtagtttgcaaatcgttgtttcctttgatacgaagaaccattttagcttgatgcaatcccatttgtccatttttgttttggtttcctctgctttttaggtcttactcaaaatctttgccagactaatgccctggagtgtttcccaatgttttcttctagtagtttcatagtctcaggttttaaggttaagtctttaatccatttggagttgatttttgtatatggcaagagataggagtctagtttcattcttctgtatgtggatatccagttctgttagcacctcttactgaagagtctgtcccttccccagtgtaggtccttgacacctttgtcaaaaatgagttgaccgtaaatgcatgatttatttccggattccctattctgttcgtctgtctcattttatgccagtactgtgcggttttggttattcttgctttgtactataatttgaaatcaggtaatgtgatgcctccagctttgttctttttgctcaagagtacttaaatggctatcagtatttacttctgggtggtaggattctgtttaattttatttttactatctatgattttttttcaaatttttacttcaagcaattttattttatacttagaaaagtctaactttacttaataaaggaataaaggaaataaaaaaggtaggttgtgggtcctattgtaatctatcattagacaaacaattactgaacatctataagtattaggaactgttctaagtgcccaggatacataggtctctgcctcattgattttacattccaatttgtgtgtgggagtattagacaataactaataactgtaataaataagttaatgatttaatatattagagggtgatatttgctatgggaaaaaaaaactgagctgggtaaagaagaaagagaatgtgatatagggggatcagagcactgcagcttataattgtaactagggtggtcagggcagaccttattgaaacataggatatggacatgtagatgaggtcttggggatactggcgcatatctggtgaaagacccccaaagacagagccatgcccatacttaagagccagcaaggaggccagccaggtgaaaaaggtgttgagcaggaagagcccagcaggaatctcaggaggtttgttgattttttgacacaggtgtctgtaacatacaggagcctgccaagagtccccaagcctgttgaccactacccactgtcactgacccttatggagagagacaatacagcacaaagaaatttgggggtgtatctcagatggctgtgaaatcaaaaacaaaatgccaaacagccatccacttacgatccactgagggtcattttatctcatattccagttgaaagtaacgaccttaatactgaaagggaagtgcgcacttcataaacaagttgaaaaacaggtttgattttcctggaccatggcttacaataatagagaaatgggttcttgccaagagacagaacaggaagagagagtttgacaggaggttcattaactgatcaagagggctttacattaacatttgatgaggagagaggaaaagatttagataaaactaatagctagttatgatggagaatcttgggtgttgaaacagaaagaataacaataatggtgaatgtctccagctgatcgctggagaaaataagaaaggtttggtagcaaaacatgatttcagatatgggctaagcatggataaagaaatgaatgtgatacttcatgtaaaaataaaagggccgggcacggtggctcacgcctttaatctcagcactttgggaggccgagacgggcggatcacgcggtcaggagattgagaccgttctagctaacacggtgaaaccccgtctctattaaaaatacataaaaattagccgggcgtagtggcgggtgcctgtagtcccagctactcaggaggctgaggcaggagaatggcatgaacccgggaggcggagcttgcagtgagcccagatcgcgccactgctctccagcctgggcgactgagcgagactccgtctcaaaaataagtaaataaataagtaaaataaataaaaaaattttggctgggcacagtgactcatgcctataatcccagcactttgggaggccaaggcaggcagatcacttgagcctaggagttccagaccagcctgggtaacatggtgaaaccccatctcttctaaaattaccaaaattagccaggtatggtggcatatgcctgtggtcccagctactcaggagcctgaggtgggaagatcacttgagcctgagaggccaagattgtagtgagccaagatcacggcagtgcactccagcctggggaatagagcgagactcaagtctcaaaataaataaataaaaataaataaaataacaatagcttacacttattgagcacttaacatgtttgatcacagtaataaatactttaaataattataaaagctaacatttattgagtactcactatgtgcagagaattaccttttttaatcctcccaattctatgaaactatccacattttacagatgaggaaaccgagggttaaagaggttacatagctagtgataaagaacccaaaagcccaacctagatttatctgactccaacgctcacttcttaactaggcatcttgagagcggtgaagggtagccatgctgttttaaagaccatatattaggttgatgcaaaagtaattgcggggttttttttgcaccagcctagtagttaagaaagagaattccaggaagtactagtcacatattcaactttagaaaagtggatttcataaaaaataaaccaaaaatgaatgatcctgtggccaataactccaaaagataagatatctcaaggggcttagaagattgtaaaaattaatgttttgttaatataaacataaataattcaatcttctttgtgtgtatgtgtgtgtgtacatgcagaaaataatatggagaaattaacaatttggctgtccagggcactcggattttaaaagaaagcacaagagatacaacaaagacctccaaataacggtttcagaaaaagctgagatttgtaaaaatcctaaggacaacaaagataattgtttcggttgtgttcagagcaggaagtctaagaaaaaggccaggctaagtgcttgaggcagatggtgtaatattacaaacaggcaccacaatgctagaaaccagctggagatcattaagagcaattgccatcaagcctctattttcttttttgatggaattaccaaacaggtaatgtagcatagctggatctgagcaaaacatttttcccaagctctcacagtagtctcatgggcaagatgtgggaacacaggtggcttcctaactcactaagcagctaagcccaaagaggcttaagtgtactatgctagactgaaggcgagttgtgcctgtgtcctgtcctcttcaatacttgcatatcaaatttgttctgagagtgcatgttatcactcacagatgacacaaaactgggagaggtgcctaatgtgttaagtgacagactcaagtggcagaagtatctggcaggctgaagctagcaagacaaaatttgatgcatatttatgtaaatgtcagtattcacctgaaaagaacctgggaatattaactcacagaaaaacaaggaatcaaggacagggcctgccaaagggtctttgcagtctttagctgtattcatacaagtatggtatccaaattaaggaagaacacatgtatatccataccagggaatactattcagcgagaaacagaacaacttcaatgaatctccagagaattgggaaattatgcagagtaaaaaaaaaaaaatcaattccaaaacatcacgtgatgtatgattctgctaatgcaatattcctgaaatgacaaaattatagaaatagaaaacaaattagtggttgccagggatcagggatggagtggtgagaggggaggtggaggtgggtataaaagggcaatatgaggtatctttgtagtgatggaaatgttctgtatcttttcttctttcttttttttttttttgaaacgaagtcttgccgtgtcacccagcctgggtgcagtggtgcaatcatggctcactgcagcctcgacctcctgggctcaagccatcctcccacctcagcctcccaaagtgccaggattacaggcatgagccactgtgcctggcctgttctgtatcttgactgtgccaatgtcaatatcctggttgtgatattattctataattttgcaagatgttaccacgggaggaaactggataagtgatacaaaggatctctctataatatttcttacatctgcacattaattggcaattatctaaaataaaaattcagttaaaaaaattttttttgtaaattgggagcgtgggtggaggatacaggtaggggagtaggaggagagtgaataatctagataagcttcccatgaaacattcatcctaaagaagaaagcaggcacggtaccatcgacctctcagactgaagcatccaaggcagcaggaactgtgcccatcttcttcgtcactggattgcgagtgcttcaaactacactgatgtatcggggattaagacaagagttcctctctacccaaatagtagcattaagagattaaggaacaatgagttgtcccactctgcttgattcctcagttttgagcaacaaagaattcatccaaaatatgcacttgactccatttggttcctgagttgactaagaaactgacagagactgagagggtaggaataaagccccagaggaaagatactgagtggaactttacagaattgcatggctgttaaatgcatccatcccaagccctccccctggagagataaaaactgacctaggtgtctgagttaacctctctcacattggaatcatgttaacactgctctgggagcctctaacaaagtgtaattccatgaagagagagccactctctcctgttctgccatagaccaccaaataaccttgacatcccggggaatggaagtgaatgctaccagaaaaagggtggggcctgtggctacaggaaagaggactgctctagggaggtgatggccacatagtggggtctgggcagtgatccagggcagtatgacattcatcagggccccagaaccagggaagccatcggaagggaaacttattcctgagcacacacgtgaaatacctcttggggactccgaggaccaatcaagagggaatttgcaggagactgagcaggcagaaaccagaatcaggtaattgggacattagagtttttttttaaattgatgttgctatatacaatattgctcctaattttcactggagatttagatttgggatcagaagaccccaaccccaagcttcaggctttttgtcttttacactggcatggtaatgtctgctctgcctacttcgcaaggctgttactttttttttttttttttttttttaagatacagggtcctgccgtgttgcccaggctggagtgcagtggctattcatagcacaccacagcctagaacttctgggctcaaatgatcttcctacttcagcctcccaagtagctgggactttaggagcatgtcacagcacccagctttagactattactttgagaattacatgaaataatataggtgagaaagcttttgaaatcagcaaatactatttgaatgtgatttttgatatcattatcttacaaatgcttcattatctccactgttacttccctcctatcatcttttcttctgaaggcttaataatttctaagccccctttttgtgccctctataaaacactgtggtatttgaggtcctgtgtgtcctgaaactattttgaggtgcacatatgtggtggtctttacctttctgaaatcatttaacagttgtcctgggaccagaatcttctgcaattccttggccccatgcccagggctctgctaagggtctgaacatgggcatggggctaaatgtggagagaggagccagttacccaggggctagaaattagaaaatgtgctcaaggtttaggctccttgtattagtccgttttataactgctataaagagctgtccaagactgggtaatttataaagaaaagaggtttaacagactcacagttcagcatggctcgggaggcctcacagaaaacatgcaatcatagcggaagacgaaggagaagaaatgtaccttcttcaccagactgcagaaaggagagcaatggaggaagatccccttataaaaccatcagatctcgtgagaactcactcactatcacgagaacaacatgggggaaaccacccatatgattcaattacctccacctggtctctcccttgacacctggggattatgggaattctaattcaagctgagatttgggtgggtacataaaacctaaccacatcactcctgatggtccaattcataaaattttacaagaccattacctggaaattagggggtggtagcaaaccctgaaaatgagggagctgagaggcaagaaatcagaggccctacatctggaaccacctcctccacaggaccctgcttctacttccagagctgatgccacaggttgggacttcctgctccaggttccagccagggaaacagagccagctcctcacacatgcttcaggtaggcagaggaagagcaaaaaagagacccccataccttttattccagcagctctggggaaaggtttactttcaaggaaaatagggaaatgcactaattcagagtcatcaattaactccgtcacttacaagatgtgggactctggcttcaacctactcctctgaaacaggaatagtgtgcctattcaaaatatcttgcaggcagcagatcaaacaatcggttgtatctttttttaaaaaatcagttgagagttaaaaaacaaaacaactaaaaattgttttgtaaatttcaagcatacaaatgcaaaggatatgtatttcctatagcctaggatctccaggtccctaataagggaggccagctatgattgtttgctgggatgcatgtttcatttagagatgcagctgaataagtcttggtttttttttggtttgtttgtttgtttgttttttcagtattaaaagacctttcaggccaggcgtggtggctcaaacctgtaatcccagcactttgggagcccgaggcaggtggatcatgatgtcaggggttcaagactagcctggccaagatggtgaaaccccgtctctactaaaaatacagaaattagttgggcatggtggtgggcgcctgtaatcccagcaactcgggaggctgaggcaggcaattgcttgaacccgggaagcagaggttgcactgaaccgagatcgtgccactgcactccagcctgggtgacagagcaagactccttctcaaaacaaacaaacaaacaaacaaacaaacaaacaaaaaacctttcagaaacacattggtactcctaagcttttacatatgttcataagcctttaaattagggtggaggaaaaattatctcaattcctgaaaagatagacattaaaaggaaccaccaaataaaggcaaacccattttccaggtgctagaaaagggtgaggagtggtacaatctatgcaaggccaggtgtgtgagaaaaccatggtacctgaaagcctgggtaaaagagctgagaataggatacaaagggttcagccccccaggtagccaaatgccgctgcaggctagggctccctccctccctccctccctccctgcttcgctttctccctccctctctcctttttccctttctttcttccttctgtggagttcctaaatcatggtttcttgagaaacaggatattggagcttcaaggcagaggtccccaacatcttaaggagcctggaggtcatgattccttgccaaggtgggaatcacactccatcttggacttccgaggctaggcagagttaggcattttctcatctgggctccataggcctgggcccacagtttttttcagcatctctctcactgcactgtagccatttattcaccagaatgcatccttcctgacctgcgagctcttccagagcatgaacagaggagtataatggtttggcaccccgcctttggtgccagagaaacctaggttcacactctgattagacccttcaggggctgtgtgatttttctgggagaatgaaattagataccatctataaaaatctggacttatggtataaccaatatgtggcagctgctattactttaacttgttcttctgtatacaaataataatagctttatctgttaggattcagtgcaggaaacagaaattgcttcacttacattgagtaggaagggatttagtcaagggataatgtgcttgcaaaacggttagaagggctgaaggagcaggttctaggctggggctcacaaagcagtatagaaattaaccaccacctctagggcacctctggagctgtgctggaatccagaagtgactgctgcctctgctacaattcctgcctctcgatacccaagaagctggagaatggactctggaactctgatgcagaaaaacctcctatttccccagctttgctggccagcaaaatggctacaaaggggtgcagcttctgctttgcacatcttgcactgagtgcctctacttggcagaagacagcttgcttctagaaccccgactgcaaaggagccttggaatcatggtgctcagctttccaacttcacccagcaagaggcaggaatgaaggttgagtgaccatccacaccacagctggcactttcagctgtcattggcctcacagcaccacagttaggtaagtgcccatttcacaaatgaggaagcagagccttcaggaagttaccttgtctgccccgggtcacagaggaaggggtgaagaagcaatgtaaacaggttctatcttaatcaaagtctatgcccttaactaccattttttctaatcctccctgcatcttgaatgcctaactctgcatgtggccacacctactgaatgaatgttagagttcattcatcatgagtttaaacagaaaattacaccaacttagaatgctgtggcctagagaaagtgtctttacctcctgagtgcgacccaagtcaggaggcaggaggctgactgagggacacggaggaggtatgcacactcacagcatgaggcagagctgtgtgcacacatcaagcaaggaaatggggccggaatatggggcaaaggcctacggattgaatggtggatttggatgtgggccacttcttccagcccctgaaagaggaccaggcaatgtggctatgaatgggcctaatgagaattgattgattcgctcgagatgttttctttttcttcctaaaatagaaaatgacataccccatgattcatgcactccggtgcccgtgataatggcctcttcagtgcactgactctgctgataaccacaggcactcatcctccgcagaggggttgtgtgccacaccctaggcacatagcaaccctgcaggctgtcagacacctgccgcagagagtgctttccacacgctctctgggacatgaggcacagttcccaggagtgcctgagaaatctcagttgcctggcatagatgctaaggcctgagagaagagcccagagtctaggcctgaggggctgcagtctgcacacaggagttaactcatacacatatacaacccacaaagccacacacatacatagcacaaatacacacacagatagacacagcacacacagacacatacatcacacacacacagacacaaacatgcacactacacacatgcacagcccacataaacacccacagagttgcaaatatacacagcacaaatacacacacaaatagaccacacgcagagagacacatcacacatacacacagatacaaatatacacaccacacacaaacacagagagacacacacaccacacatacaacacacacaaacatacacactacacacatacacaacccaataaacacccacagagccacaaacatatgtaacacaaatacacagagagacacaccatgcaaagacccagagaaacaccatataccacacatatgcacacacaaacgtgcacacccaacacatcaccacgtgcaacacatacaccatacacggaaacacatgaagacacttacgtacaccacacacacatatacacacacagacacaaacatacgcagcgcacacacaccacacacatacgcaggctcatgcacatactctacaaaaagtgcctcactacaggacagccatatcctaaaaggcttaaaataatggttatatggcctacaaacgcagaaggtgtgtatacaaaccagtaaaagaaatgaaagaaagcatcaaaaatggtaaatacacgaagataaaatccctgttgaaatgcacgcatgatatttattgggattggaggacaattcaggcaacacaaataattgatatttagtaatctttggattgttccttgtgaacttattcagttgaacagcacattttttcaagtggctgccctttagcccctgtacactcactgtgtggccactgacttacacccactgggcatctgccaagtccctacctcatctccctcccttccaaatgtacctgtctggggacagccctgcagagcccctgcagcgcctgtttgatgatagagcttgccacccagtccctctcattcttccaagctcctttcctgcccaagtcaggaaagtcccacagttcttgtctcatagtacacacagggaagttcagggatttggtgctaactttagttagaccccggcttcccagagccctgatttcttccagggctatagcagtttatctctgtgtgcccagggggtgctcaggcccaggaattgtgaatattagatgttccctttagtatttctaagatcctatagggaagagtgggaaattgaagttaagggacaactagcaggtgagaatgacagctggggattattgaccaagaaggaaaggatgggctggttgtaaatataccttcaagacccattatcttactgaacttgaaagctagaggggaatgtacagagaccatcagctataaccccttcatcttccagatgtagaatctgaggccagaagagtgaaacaatatgtctaaagtcaaaaccaattaattagaagcgactctgtgatcgcaaatgtagaattcttccctaatggagcactggttaccattttctattttctgattctatggtattatttcaccgacttgatgtatggaccaagatattattctggatttgagattttattagagaagctaacaaagtaaacatactttatttaggactttccattttattagatgaatattatattcctcttttcctaaagcaggagatgcttatgttggacaaccaacttttatataatataatatagaatatatataattttatatataacataatatagaatattattatttcatttaacatttaaatagtcctgccaggtggatactacacattttataatcaagagaggaacagtagttctgggaacgtgattaaagatgaatgaagatcaacccactcaagttggtctggcttccatgtcatggaatttctgcattgccactctgctttgcaagcttaggagacacctgctgtggtttgaatgttcatcccctcaaaactcttgttagcctgagtagagggcaccctgcactcactctcctgccaccacagttggcaacttttaggagcatattcttgctctactgtggttgatttgtattttgtttttccttctttgtttttcctttcctataatataatataatataatataatataatataatataatatagaatattatataaaaggcacaacacaagttggttgtccaacacaaacatctcctgctttaagaaagttcaaaatagaaaaataataaaagtatgattgcctcattacaaaatatattttatagtagggtttttgttttttgaaaagatgttcccactacatatttcaactctgaagttttcagggataactcaagaaaaaatggtataagtcaagaaaaataatgaatgtatatgtacttttggcaaactaataattcacaggtaagtatgtgtttttactagatttataaaacagtaagaaacaggaaagatgtgtggattagtaatgtgaaaacagaggtctactttacatttgccataattccaggcttacatgaatcccttaaactttgtaagcctctatgtcctcctccagaaaatttgttattttctgggtttttttgttattttttattttctgttattttctggaggaggacattgactgggaccaaatgagttctatgggtttgctgtaatctattttctgttgcttataacagaatacctgaaactgggttatttataaagaaaagagatttatttcttataattctgaaggctgagaagtctaagggtatggctcaggattccacaagggccctcttgctggagaggatccctctaaagagtcccagcctggtgtagagcatcacatgctgaggggactgagtgtgcttgctcaggtctctctttctccactttttatttttttaattttaaagtttttatttgtagagatggggtctttctatgttgcccaggctggtatcaacctcctgacctcaagcaatcctcccgcctcagtcccccaaaatgctgagattacaagagtcagccacagcacctggcctatttctcctcttctaaagccactagtgccactcccatgataacccattattccattaatccatacatggattaattcattcatgagtggagagccatcattacccaatcacctcttaaaggcttcacctctcaatactgctaaattggggactaagtttcaacaggagttttgaggggatgaacattcaaaccataacaggggtctcctaagcttgcaaagcagagtggcactgcagaaattccacgacatggaagccagaccaacttaagtgggttgatcttcattcatttttagtcaccttcccagaactactgttcctctcttgattataaaatgtgtagtatccacctggcaggactatttaaatgttaaatgaaataatggccacaaagtgcctagccattgcctgcctcaacattgatgttcagtaattttagtttcatatccacctccaactttgccattctactcattgataaacatatcaaatgtataaagaactcacagcatccatctgactcagtgagccatttggagattcagtaatgaaagacaatgtcatccttccacgacgtgccttttgctttcaatgtgggagggatggaagctagcctgagtggagggcaccctgcactcactctcctgccaccacagttggcaacttttaggagcatattcttgccctactggggttgatttgtattttgttttcccttcttttcactgagttttgcctacttgcttcttactgatgatttcatttcattgagattcatatacacaaacacacgcacgcacacacacaacacatatatttgtctgcctctcccttcagtcatggatcatttcctgcttaaatcatttccccaggctcccctctccttcatctggctaacccttcagctttcctcatggaaacttttctgacccttcaccattcttcctatttgctttcatagcaccctatgttcttccttcctaacacttaccatgatcaaaattgcataatttatttgtgtcatattagtctgactccctttccaggctgcaggctccaagaagacagcaagcttgtctattttgttcactgacctgtccctaagacttgcagtgcttagcatttagtaggggctccagaaatatgtgtggagtggatggatgggcaaataaatgaaaggtgaatgaatgaataaggcccagaagctggctttcatccataagaatgggctagctctgcggtggcaggtctgcccctttcctcatttcatatagagcttcatcttcactcttgccattggcaggattcctccacagcttctcctacactctcttaaaatgaaattgatgaaattgatttactagtaacatgaacagttcagccagaaagttttcatagatcatgattctacagaaatgcaatcttgctcaaactgtggcttaaacacacatccataataccctctgtgtcttctaatagggtaccagaatctactttgggatagcccacatggttattaagagaagtaggatggttaaaggatcttacaaacaacaggacccattttagattccacggtgacaacttttctagcccaacagttcaccactaaagattctgcatgcatcatttggggtcccttacttttgcctcttggatttcctaccctctttgtgcccccagttaatcaaatgagcaggtgagcaggaaagagctccttaaaagtaaggtgtgggtttaaatcaaatcagtcttttttcctattgacgactgcccacagagcataaagagtacttgagacttggagagaaaagtcaaggagggagcagaaagtgaggcagaaccatggatttttttctctttatgtttctgtccttaataaaatagcaacacgaaggcttctcagatgatgagtggttttcctcttccagtccagtctaagaatcaggttgaacaactgcaggcagctatgtaagaaatagtttccaaaataattttccatagctctgctgtgtttgggtcaaccctcaggcttcctgacaatagatttgttcttgtttcctcctgatacctggtgcagtgctttggtgattgtgctgagaggacatgagtacccgcctctcaaactcccagaggtaaactggcattatgaaggaacaatagcccaagtttatgtttggagggaatatattgaaggatgctatgtttaatttcactgcttccgtgaatggtcttcaagatgaatagcttcaagattcctatgatttctcatttcttttttctttaaatagcatatcagggcccccagttcagcctaaatagcgttcatttcagcaattcagacctgtctgcgtgtgtgtcacagaaaggcggggcaagggtcactttggaaggggattttggtggtgggagtctataccctggagtggagccggcttgggtacttcagacatcagcgggctcctcccttggctccaggtaaaaagaaactgtacactgaagctgcaatagccagttttcagaagctaggggagatgtgaacagcacaatctgatgccgggggagaaaaggtagctaaagtgggaaggagcaatattctgtctgcttctgtgctaatcctgcagcatttgggggatcttgaattcttctgagactgtaactatctatatctttggggacatggtggcagcagcgttggcagacatcagcaccctcatggggcagagtccatgcgggatcatgtgggcacatgcaaaagattcctgaggattcctgatgaaacctaaaggagagatctcacagagagggtggaggatgcaggagcccatcggacagcaatgatcattgttaatgtgaccctgtttggaaacttaagtgtagaacagggaaagcacacattacaggagaattataaaatgtcagtgctgggaaggatcttagagattatctagtcaaatatccctcatgatacaggtgatgatagcaaggcccaaacaggataggctacccacccttgcttgatgaccagttcacaacataaccagggtagaacatagttctctggaggctcagcccatgacacatgatggactcctgacattcttcacatgtttgtagggcactgaggacttctgttgtctatggggagaaagtgtcttctaagcacatactactttgagggaagtccagggtgccttaagtcaaatggaacttgggctatgggctggggtattctgtccagggtactcttttgggaagcctgttaggtggagctttgctggtatttgctctaagaaggtgcagcttcaactctggctaggtaaggtcagaaagggaaaggaggagcctcctagaaacagcatcggctggatcttgggaattcagtctgcttacctgcctctgctcatatcttcacagatttttttccctctcaaaaaactggattcacccacagagtctgccagcactggagcagtaaaagacacaatgtatgtgtctgtgagttttgttttgttttaaccaaaattctctctgctgctatttcagctcatttattcttgatttggcctgagcaaatctgaagccatgtgttattgttatttatatttcttcatgaaattcggtcatcccttagcctgcccaaggtgaaagagcccaagttcttcaaccattggctcttaggaagttggaaccaaagtaatggttgtaataatcttgtaatagaatgttccagaaactcaggagaggatacaaccttccaaacctcaagcattcattttcagctattcacccttattactgtactaataaaaacctactaaatttattctaccctagagtactcaggatatgaacttagcaaagattcatattacatttaaaaattgattttaaaaatacacacacacacacatttagctttaaaaacacatatacaatacattgaaaatacactcaacaaaactatagccttttcctttggaaggtcactgattggatggggaaattctgatgtagaataaattaacagtcatctgaccccatttcaggttcatgcagacacccccacctctctgcactttgctgcattcttgtgaatgggcccaaactcacccagatgacatctttcatattctttctttcccactcactccctgcccccctccaaactttaccccctcacattccttctgcatttggcttcacaagtgaccatgacaataggctgagggtgtttttaattgtttctggtgatgctctccagcatggcctcacgggaaatcttgcacctgcaaagccagagcagtctgccacagaggccatgctgaccacgtgggagacagaccatgggccagaatttcactctgcagtgaccctgggtaggggttagggaggggataagtctttaccaggcttctggtcaagctccatccccaacggatgcccatgacgctctgggatctgctcaaaggcaaagcattctcttgtgtctgtctatccatttgcactcctggactcctgccctatctccctctaaacagagtcaatatgaagaatgtctcattcttttccccaaaaccctcaagagaaagtttgctataatagaattaccagacaccagtacctggaacacacaggatgagatgaagtcagcaaaatgaaattcaacagagtttggaaaaatgtccagagatttaaaaaagttatgtggcaaagctatcatcaaaggattaaggttcaagcattgtgatgaaggcagatgaggcgttatctgcccctgtggtctcacaatgagttgtgtgacttctcacaccacctcatgtccttccagagagatcactgtctgcagcagggcctaacacagttatgtcactaatccagttccacaagactcaggtgacccaacggacatgccccatggccatttgctactctatgctaatccaaagagacagcttgtggcttgggggcagtacagatttatggatctcttacctctgacttcctaccctgaccctgaagaactgaggtttagtcctgtatacagttgttttggtcagagatgtatcagccagtaacaggcaggtggagtggttctctgaagaaaaatctccactgttagaggaagaagtttccaacgccaagcataaggaatctacaagatgtggaagaagcactgagcaatgtagaagtttccagaattgagaaagtgaaggttcaagcaaggggtaagaccgccattgtgaagagacagtacagccactgagaagaaagttgtgggactaggctgggtgcagtggtttgtgcctataatcccagcactttggaaggccaaggcaggaacattgcttgagcccaggagtttgaggccagtcttgacaacatgtgaaatcttgtctctacaaaacataaacaaaattagccgggtgtggtggtacgcacctgtggtcccagcttcttgggagcctgagtgggaggacagcttgagccccagatgttgagattgcatgcagtgagcctagaaggagccactgcgctccagcctgagcatgagataaagaccccggctctacaaaaaaaaacaaaaaagagagagaagaacaagaaaagctgtggcacttgaggaaacactactcctgctttggagaataagtgcctaatttgttatctcacttctagactcagagctcttgacatcaggaacctatgctaccattaatatgtaaatgttgggcgaatgtctggaacatagtaggtactcaataaatgtttgctaagctgattagaatcaaaataagcaaatcaaacttaaaaactagtcagtataaaaatcagggttctctgtaggaactcagattgctgaccaccaaaatttctcttacttccctcttgaattagtctgacacttgttcaggttctctgaacaagtaatgttgtctaataaactagcttctagacagatgtggctatttaagttaattaaaattaaatgaaattgaaaattcagttcctcagtcacactggccacctttcaaatgcacaataccctcatgtggctagtggctaccacactgaacagcagcaattctagaacattcccatcactgcacaacgttctattgggcagcactggtctagagtgtcgaagagagccttcacatctgattcagccttctgaagaaagacattttggatttaggagcacatgaagagaatggggagtttttagggcattcaggcaggttttataaacttcttccgctgaagctcaactccttcctggaaaaagaggaatgagaaggaaatggaaaaaggacagagctgacaaacattttctataaagaatcagataatagctgggcacggtggctcaggcctgtaatcccagcactttgggaggccaaggtgggtggatcacctgaggtcaggagttcgagaccagcctggccaaaatggtgaaaccccttctctagtatttttataaaaatacaaaattagccagctgtggtggcacatgcctgtagtcccagctactctggaggctgagacaggagaattgcttgaacccaggaggcagaggttgcaatgagctgagatcacaccactgcactccagcctgggcgagacacagcgagactccatctcaaaaaaaaaaaaaaaaaaaaaagaatcagataataaatattttaggccttaaaggctaagaaacaaaatcaaggcaaggtgtggtggctcacgcctgtaattccagcactttgggaggtcgaggcgggcagatcacctgagatcgggagttcgagaacagcctaaccaacatggagaaaccccatctctactaaaaatacatgcatagtggcacatgcctataatcccagctacttggaaggctgaggcaggagaatcgcttgaacccaggaggcggaggttgcggtgagccgagatcgtgccattgcactctagcctgggcaacaagagtggaaactccgtctcaaaaaaaaaaaaaaaaaaaagaaaagaaacaaactcaaagagattctttaaatacttatatagcaaaggagaaaagaaatttccacaaacttttattgatgacattcaaaactttaggaacactgaaatttgaatttatataattttcacatcattaaatactatagttgttttgattattttcaaccatttcaaaaggtaaaaaccattcaaagctcatgggttgcatcataacaggcagtgggccagatttggcctgcaggtatagcttgctacttggcatgctagaccatgcagaaaaaacaccacgcaacatgactggctggcttcttttaggagccaattttcaggagtgatatgcaaatcggatgggaagcttgtgcagagtatattgaaagtctccctcgagaagcaggaatgaggccgggcacggtggctcacacctgtaatcccaacagtttgggaggctgaggagggagaatcacttgaggtcaggagtttgagactagcctggccaacacggtgaaaccctgtctctactaaaaatacaaaaattagctgggcatggtggcacacacctgtaatcccagctactctggaggctgaggcacaagaattgcttgaacccgggaggcataggttgtagtgagccgagatagcgccattgcactccagcctgggcaacagagccagactctgatgaaaaaaaaaggaagaagaaggaatgacatcaagtcccctctagagtcgggaatggtcactcaagatagagatgattctgctttctcaatccaatgtaagttctttagagagaggagccactgagacctaaagaaacaaaagaatcgtcccctcagtcattcaaacctgctactgaagctatgggacttctcagaagaatcctcaaagataagaccagcgtgggatggccataggcccccacaagctgtgatgctagagagagtgactattttccctgatttcacagccagccacctgcttagcctgaaaggaatacccagagggagtcaaaggaaggtgatggagttgggagaaagaaggcagaacttgggccacatctgcatggggaaaaaaaagagaggaagctgggcatagcagctcatacctataatcccaaaactttgggaggccgaggtgggaggatcacttgagccaggagttgagacaacttgagaccagcctgggcaacatagtgagacccatctctacaaaacaacaaaaacaaattagctgaacatagtgacacacacctgtagttccagctacccaagaggctgaggtgggaggatcacttgagctcaggagtttgaggctgcagtgagtcatgatcatgccactgcactccagcctgagtgacagagcaagactgtctcaaaaaaaaaaaaaaaaaaaaaaaaattcccggagaagggtgatatacaaatgtgagagagagaagaggtgaagaagttaaggcaacttttaggcaggtgcaagaattgaggagcactgtttaaagagcattcgctaggagttaggctgccaagatgttctttgtcttgaccctatatatagttcacatcattttagtaccatctttccccatatttaaaaaagagataatgatacttcttatatttgcaaaaaaaaaaaaaaaaaaacaagtgaacttctttggaaggttaataaatctttcacattggtttagtttgtaacccaattttttccatttttcccactcctgttcccctatgaagtcatttaaatcttcacaccaaaatggaattgcagctgccttctctgagcactcggggtaactgcatgtacttttcttcttaagttttattttaggttcaggggtacatgtgaaggtttgttatataactaaactcgtggcatgggggtttgttgtacaggttatttcaccacccagtattaaaccctgtacccgatagttatcttttccgctcctctccctcctcccaccctccaccctctagtagaccccagtgtctattgttcccctctttgcgttcatgaattctcatcatttagctcctaattattagtgagaacatgaggtgtttggttttctgttcctgcgttagtttgctatttccagtgcttttctgtgtctgccttccccacaaaactggaaactcccccagggtggccacggcatctcattcctccccgcaaccccgggcccttgctgggttaggttctgggatttagtaagcagtgaaatgtttgctaaaggaatgaatgaacccctgggcattccatttattacctcaaggtatcccctcactaaagctttgagttagataatactttgggaaaacaacagggagtgaatgatgaggactgtctgaatatatgtcctgcttaaagcattttttttttaaatcttaaaatacaactgtaaacaaaatttcaacctatgaacttctaggttataacttctgaaaggtaggtactgtcattcccatttaccaagcgagaaacctaagactaactttcttgcagtcacattgaaagtttctgactcagaacaagcatcctggcttttagtcttagctcacagatttcctctcaaaagtgtggctcttttatgagcgcttagctgtgagagaatgagcagtcagtcggtggtaagaacaagtaattcatgaacctttccagaggatcagtaaacagaccttcgccgccgcccctgccttcctgcactccgccctttgacaatgtttgcgtcccatcctaaggtctccagggtggaacctgcccagatggtgtgagaggaggagcttagttaagcaagaggcatgtataatgaagcttcgagtgaactagctaagaagaaacatgcaggccaggcccggtggctcacgcctgtaatcccaaaactttgggaagccgaggcgggaggatcactcggtcaggagatcgagaccatcctggccaacatggtgaaaccctgtctctactaaaaatacaaaaaattagccaggcgtggtggcacatgcctgtaatctcagctactatggagcctgaggcaggagaattgctagaacccgggaggcggaggttgcaatgagccaagatcgcaccactgcactccagcctggtgacagagcaagactccagctcaaaaaaaaaaaaaaaaatagtaacatgcagaagaaaacccaatgaagactgctatagaagttgtttggcatttcctaggttggagagggatggggtggagacctagaactatcatcgtcatagctggtcagtccttggcttcactccacaggatttatcctttttactgaggctgtcctatctccttggtacacctattagtctagtggggaccagtagttcatgttcctacatatttatgcaggattagcaaactggtgtgtgtcattgtcattaacatcatcatctccatcatcaccaccaccaccattgccaccatgcccagcacctcatagtttaccaagtgttttcgtattcaccttctcactctgtgctgacaacagccctttgtggacagctctgttgttgtgatcatgtgtactaaaatcactggcttttccttgggccttcaaatgagtattttcatagtatgagagtagagatagggtcagaaaaagtactattaaataacctaggagagaagaaccctttataatactttgcctttgtgagtcacttggtgggggtcacctatttagcacttctgctagttttttgctactaaggatgctaaccaaaataaaaataaggacattaagaagatagattataataaccagagtaatttcccaaattctccttttgaaaaacaagactaaggcccactgagtcaagtcatatgtggaatgaaaatgtaatgaaataatagtaaataataatagtactatatataaatgtttagctctttgaaaagtgcttttgtctaatttggcctcacaactactttcaagttattaaaataatcattatctccattttaaagataaaaaagaatttcagttaaataactcattgatgtaagaaacagaacaaagctctaataggaaattttcttgcccatttaagaaactcaaatcaaagaaatttttaaaacaatatccttacttttacagtctattaataaacaatttgacattaatgcttgaaatgtggattttatacaatagtgtgtgttgaaaggttcacaggatctttgttgaatatagagactcacggggtatcattgaaaatatgccttcatttatctggtttctgtagagcctgtttctggtggtttttgtatctttgcctcccacctcatccccagtcacaacaagtgtattttcttctatggggacaggaatcacctagtaataggtaaaggtctggttcagtggtttcccacctagactgcacattaaattttctgtgggctttttaaaaagacagaaaccttctagtaaccagaacagcatggtcctggcataaaaacagacacatagaccaatggaacagaatagagaacccagaaataaatccatgcacttacagccaactcatttttgacaaaaaccccaagaacattggagaaagaatggcctcattaataaatggttttgggaaaactggatatccatatgcagaataatgaaactagatcctcatttttaccatatacaaaaatcaactcaaaatggattaaagacttaagtgtaagaccttaaactataaaacaactaaaagaaaaacactggggagatggtacaggacatcggtttgagcaaagatttatctgcataaggcctcagaagcacaggcaataaaagcaaaaatggccaaatgagattacatcaagctaaaaagcttctgcacaacaatggaaacaatcaacaaagcaaaaagacaacctacagaatgggagaaaaatatttgtaaactatccacccgacaagggatttgtaaccagaatatagaaggaactcaaacaactcaatagcaaaagacaaataatccaatttgaaaatgggcaaaagacctgaatagacatttctcaaaagaagatatacaaatggccaacaggtataatgcccaacatcaatcattagggaaatgcaaatcaaaaccacaatgagatataatttcattccagttagaatggctattatcaaaaagacaaaaaataggcctggcatggtatctcacatctgtaatcccagtgctttgggaggtcaaggcaggaggatcacttgaggccaggagtttgcggctgcagtcagctatgattgcattaatgcactccagccttgcaacagaggtagaccctgtctctaaaagaataaaatattccaggtatggtggctcacacctgtaatcccaacactttgggaggccgaggtgggtggatcacttgagtccaggagttcaagaccaccctgggcaatatgacaaaacactgtttctacaaaaacttaggaggacatggtgtgtgtgcctgtattcccagctactcaggtggctgaggcaggagaatggtttgagcctgggaggtcaaggacgcagtgagccatgttcgtgccactgcactccatcctgggctacagagtgagagccgtcaaaaaaataattaatattaataaataaagaaaagttaaaaaataaataaaagaaacagtggcaaatgctggtaaggatgtggagaaagaggaacccttgtacgctgttggtgggaatgtgtggtaatatagccatatagaaaacagtatggagatttctcaaaaaactaaaaatagaattaccatatgattcaggaatcccactgctgggtatatatccaaaagaatggaaatcagtatatcaaagtcatatgtgcactcccatatttattgcagcactattcacaagagccaagatatggaatcaacctgtgtccatcaatggataaatggataaagaaaatatggcatatatgcacaaggaaatattattcagccataaaaaagaatgaaatcctgtcacttgcagcaacacagatggaactggaagtcattatgttatgcaaaataagccaggcacagaaagacaaatactgcatattttcattcatatgtaagggctaaaaaagtggatctgatagaggtagagagtagaatcatggttaccggaggctggaaaggaaagtagggaggggaaataaagagaagatggttaaggggtacaaatatacaattatgaggaataacttctggtacttgatagtacagtagagagattatagttaactataatttattacatatttcaaaatagaagaattataatggtcccaacccaaagaaaagataactatttgagtgatagacatcccaaataccctgatttgctcattatacattgtgtacaggtatcagaatatcacatggtccccaaaattacatgtacaacgattcaactattgttatagcagtaggtagttaggcagacatgagaagggcaggacaaggtgccccctcacttccccctgcaccaggaatgtcaggtgaccatcagttgatggtcaggtggtggctaaatcaataataattggttgcagctagtgtctcccaatagacagaaaacacctgaaactggtgagcagcagcttcctgataagatctcaggaggtgggcgagtgggctcaagcatgcacactcaggggcaaaatggcagagtttaactggtatatgaccttctagaacacccaactggtaagggaagagagcctcgagtgagcacatgcacaacgccagtaaacacactgtgcatgtggcccctcccaagtgctagcaggccactgcacatgcggacagcccaccccaagggaagaatcagaagagatgtaacacaacccggaaagcctgccaacatacataacaccaagttgaaggtcaaactgcgcacttgatctctcaagtcacccaattggccctcttccaagtgtactgtattttcttcattcctgctctaaaactttttgataaactttcactccctctgtataacttgcctgggtctctccttctgccttatgcccctgggttgaattcttttttctgaggaggcaagaactgaggttgctggccaggcgcagtggctcacacctgtaatcccagcactttgggaagcggaggcaggtggatcacaaggtcaggagttcaagactagcctgaccaagatggtgaaaccctgtctctactaaaaatacaaaaattagccgggcgtggtggcgggcgcctgtaatcccagctactcaggaggctgagtcagggaattgcttgaacctgggaggcggaggttgcagtgagctgagacagtgccactgccctccagcctgggcaacagagtgagactccatctcaaaaaaaaaaagaaaagaaaaagaattgaggttgctgcagatctgtatggatctgctgctaacactattatttatcaatcaaaaaacaaaacatagatgcctagctcctctctcaacagcaatttaatctgaatcgcagggaatagaggccaggtgtttgtgccttttaaatctccccaagtgtttcttatataaagtaaaggctgaaaaccacagataacaattttaccttatagtattactttaaatattactactgtcatcatgatcatgattcttgcctgtttgtttgccagtttaattttataagaattaatggcaacaagggcatcatcctccagtatgagcccttttttatattatgctttcccggtagcttggtgatgttgaggcagctgcagaaccagaagaggaaagggtcagggctttcctaggccagtctttccatgataaagaaatggcgcttgtcgattaaataaatttcttgaaagatctccgcatagtttttcattctcccttaatctgactgtgagctaaattgcaatctgaaatatttaagttatatcaccaatcaagtggctaattgagaaatctccttctccttctccctgcaaagctcaaccagactgttataaatgcaaagttagtccaggcacagtggctcacgcctgtaatcccagcactttgggaggccaaggtggatgaatcacttgaggacaggagttcaagaccagactcaccaacatggtgaaacccccatctctactaaaaatacaaaaattagctaggtgtggtggcaggcgcctgtaatcccagttacttgggaggctgaggcacaagaatcccttgaactgggagcaggaggctgcggtgagctgagatcacaccactgcactccagcctgggcaacagagtgagtctccatctaaaaagataataattacaattaaaaatgaataaataaatgcaaatttaaacctacttgccacatgcccctaaatatgtttgcattagatctgtattattcttaactaattctggtatagaaaatgacagggccttgttcaggcttctcagaagtctgtgccaggaggggccctaacccagagctggagatagagtttcagaaagtatctgtgacatgttctctatataagctatggactctaggccatcgtggcccatcagctccctagaaagagagagtgggccacctaaccctatgaggggcactctgagtacagcaagggccccagagaggagacaggccagtccgggggctaagggaagctgccccagggggcaaaggtcattttttggaaaataaaatcccaaacctctgactgagttatactccagtacacaattctatatatattctaaccttgaaccacttctctttccagacaaagtggataggcatgtgcattgttcaaagctctgttcactgggaagattttctcttacccctgtctttttcaaggtcaggcctgagtgacactaagtgcggctgtcatcaacattcaacttgcgcacgagtaccaagccaacccatccataaagcaagcttgggctttttgatcctcctttagctgttggttaagaattgcccatatagccatgggtgttagaagagggatgggtgccagtgtaacagtggtgggtgccaggagtctgagctctcggctgtgtagcctgctgtgccctcttcctgctttgctcagttccaagtgtataccacttctattgtataatgaattttgctgggcccatctgaccttatgactgacggatatgacaggacccagttcaagaagagtagttctgaccaggtgcagtaactcacacctgtaatcccacactgtgggaggccaaggcgggaggatccattgagcccaggagctagagaccagcctgggcaacatagtgagactctgtctctaaaaaaaaaaaataataaattagccagggatggttgtgtgtgcctatagtcccagctaggctgaggtgggaggatcgctttagcccaggaggtcaaggctgcagtgagtggtgactgtgccactgcacttcagcctgggtgacagagtgagacccccatctcagaaaaaaaaaaaaaagagcagttctgatgtgtcacatgggcaggcattctgcttctatcatagtttctagcccagtaccatgtctggagttattttttttaaaggcacatgtttcatcagcatattgcatggttttgatccacgctggaaagtgagaacggtaaaactgggttaatttacctcacgggagtcatcataaggatcagagtagataaggctggtgaaagtattataccatcacaacattattgttgcagaaaagattgttactttggatgttgcttggaaatacattcgcggtgagcagagacttaatttttttttattctagccttttgatgactatggtattacttataaaaggattttatctcaagcaaaacaaaaaagcaatgtttaacaatagctctagttgaagatactgcttagaatctaggccgggcgtgatggctcacacctgtaatcccagcactttgggaggccaaggcaggcagatcacgaggtcaggagtttgagaccagcctggccaacatggtgaaaccccgtctctactaaaaatacaaaaattgctgggcatggtagcacacgcctgtaatcccagctactcaggaggctgaagcaggagaattgcttgaacccaggtggcggaggttgcagtgagctgagatcgcaccactgcactacagcctgggcaacagaacgagactccatctcaaaaacaaaacaaaacaaaacaaaagaatctatctgcctggccagcctgtaagcaatctatgtggcagggtttctcgtgtgtttttacgtctttggtggtgatggtggtggagacagctgatttttagtagttgcccaaggagacatactgatataaaccctgcatcttccaccccaagccaacagaagttgagcacccccctcttatcttaaataaatgggtcacacccaggctttagaaaagagttttttgtttttcgttgttttttttttttctaatacactttaattgtattagctgcattggtatctgttaaagaaatgctccctattagagcttgacggcagattgagaaagagtgtgtaagatgagtcaaatctccaagccagctgtgtaaggtggggagcagacagaagagaatccacttaataatgatgttggagcttgctttaaaaagacaaattaagtgttttagcatctatatcatcaactgcattttataattcaattatttaatacctctgtccaaattatcagcagtccagaaagcctctcaccactcccaccagcaggttaagggccttatcagcatccccagtataggagtcagatgataattctcaactgagcacaacaatgttgggccccactctgagtctcctgactcacaggcccagttccagggctgtcattcatccagcctcacaatccccagctctactctttaagtttccagccttggggggagttcccctccaagagaaaggaggggcagggtgggttttcaaaatccaaggcctgagcggtgactggcccagggcctatctctagtctttgggatatggctgggctcccattcttcctccaaattaggctacctaccagcattgctggaagaaggcatctcctaggcccattaaatgctgtgcctggcctagtgcctttgtgtccaaaaggcagagccaaaccatcccaggggtccagctctcaaggtatgcaatcagatgaccagatatggcagaaaaccaaagggtgcagtagctgggcatgtgcctgggtggacttacatggggtggagctaaggtctgggtccagtccttccgggctggctttaatgcagcactttcagaatggagcttgctgttcagaaaacaatatttgtcagaataattttctttctttctttctttttccttccttccccttcccttcccaccccttccctttttcttccttccttcccttccctttttctttcttccttcctcttttctttctttctctttatttctttctctttcttttcttttctttctctatttctttcttttccttccttccttccttccttccttccttccttccttccttccttccttctctccctccctccctcctctccttccttcttccccttcttctttcgtttcttccttccctctctttctgtctttccatttcttaataataagtgatgaggccgggcacagtggctcacgcttgtaatcccagcactttgggaggctgaggcaggctgatcatgaggtcaggagttcgagaccagcctggccaacacagtgaaactctgtctctactaaaaatataaaaattagctgggcatggtggcggccgcctgtaatcccagctacttgggaggcttaggcagggaatctcttgaacctgggaggcggaagttgcagtgagccgagatcgtgccactgcactccagcctgggagacagagctagacaccatctcaaaataaataaattaataaatataaaaaaaataagtgatgaatgttggacatggtggctcatgcctgtaatcccaacactttgggactacaccggtaatcccagcactttgggccaatgcaggtggatcacccgaggtcaggagttcaaggccagcctggccaacatagtgaaaccccatctctcctaaaaatacaaaaattagcctgtaatcccagctattcaggaggctgaggcagcagaattgcttgaacccaggaggtggaggttgcagtgagccaagatcgtgaccactgtacttcagcctgggcaacagagtgagactccatctcaaaaatataataaaaataaaaataataagtgatgaaacttttggaagtttggtgacttgggcccagtgtctttatctcagagcttatattcacgtgtgaccagttagttaaattgtccagaaatgcaaaacagtaatcacagggacccatcctgagtcttccacggaggttaactctggtctatgacccagacttcttcccttttccctcagaatcagccaccttcttgcctcataaaaacagggaggggttatcatgcctccctcccctctcacatgaccttgcaaggcttcagttacagtgtcttaccatgagcccacgtgtcacagcactagcagagccagcctcacttaactgccttttgttgccaacattaactgctgggcttcctgggtgcttcaaaccagaagccttcctgggggcttaacatcagaagcatctcaacacgtagcaccagggccacaggctatgactggaactcttgtggttgtgccctgtggtcattttgccagttatgagtgaacctcaaacaatcgacaactggggctctgtcccaataacctccctgatagcttgcatgtttctcttaacctcatgagtctgcagaagcaggctggcaagtgttcaagaacaggccatctcatgaggtttcctgtacttcctgccactgctgtcgctgctgccaggggcacactcccccagaaaagcctttctcatgataggttagcatttctgctaccagttgtggcagaggccagatgtgaagggcatgaaaaggcaaaataatgaaaaggaaatataccctccactttcttgttttagagctttttttcctttgtttttgtggatttgttttggaggaaagggaatagaagaaaggggtgatggtttgaaaaattaacatgtaagcccgtgtaaaatttgcaaagaggattcacagcgggttggaagaggaagaggtcgtgtcattgtggaattagccaaaggaatgtgcagccctttcagttgtacactaaaatggcagaagtttgcaccagtcaaaaccaacatcccagttctttccctgcattcacctgggtcctctttcatgaagtctctgtccagttcattgagtggtattgtcttatactcaagaggaaatcaccaggttcagcacagtagggaacattgacagactgtggtcaccacagccagatgttccaaactgtcctgaagggctgagaagcttgtcatgttcaataatgtatcccagtgcccagaaaagtgcttggtaccaaactgacactcaagagattataaatatcccttgatgattgaataaatgaatagaggtgattttggctgacattaacattagatttagagaaaaatagttattttatagcaaaacagatataaattactttattaccatagaataatctctgtcccctttctttgttcactatctttattaatccataagtgaatctcccctgccccatccccagtcatatacccatatgaagtgctgacattttatttttctgtactcactgatgacagattttttttaaaaaagatggcagcttgcacaaggagcagggtggtcgacgttacctgacaaggtccctggcctgtgtatcttctcctcaaagcctcaaatgctcatgcagcccaaggatagagggaaccagagagctgtggtcagcctgaagtgactttgccacatctgaaatgacccatgagctaagggcctatggagactacaacagttgtgagactcccacagcagttccagataacttttaaagttatctaatccaactgctcagcctcccaaagtgctgggatgacaggcgcgagccaccacacctggccacatctgtattctttatgctatattaaggtagcatcatcctcagtcctgccatgttgttactactggttttccttgtattgagctttcccctaaatgtgcccactgggcttctgtgcttgagttcatggatagccaggacttgccatgtctgctgggcccagcaaacctgcaaaagcatgccctcccacagcaacattgcagtcaccaaacattgtccaccaagtctctgggaaatccataacaatgcatttacattctttttttttttttttgaaatagagttttgctcttgttgctcaggctggagtgcaatggtgcgatctcagctcatggcaacctctgcctcccgggttcaagtgattctccggcctcagcctcccaagtagctgggattacaggcgcatgccaccacgcccagctaattttgtatttttggtagagacagggtttctccatgttggtcaggctggtctcgaactcccaacctcaggtgatctgcccgcctcagcctcccaaagtgctgggattacaagcgtgagccactgcgcccggccacatttgcattcttatatggaaattgactgcttattttgttacttaaactctagtatcactactgaactcttatgtctgccctcttgttggccattttctgtgttctctctttgctactgttaacagtcttcatagaatctgattttgtccttttaccttgagatgtgttctcatactttaaattctagattttgaccagggcaggatatatacaagacaagcttaaaacatcttgtagtgccagaaagtaagaaagtgctcaaaaacaaaaacaaacaaaaaaaaccaaataaacaaaacaaacacacactgatggggctatgtcaaagagacacaggaggaaactgaaagtgctcccaatgtccaaaactagaacaatttgagcaaaaaaataaagtagtactgaaagtagaaaacctgcttattcatataaactggccaggtgcagtggctcatgcctgtagtcccaacactttgggaggctgaggtgggtgaaacacttgaggccacgagttcaagaccagcctggccaacatggtgaaaccctgtctttattaaaaatacaaaaattagccaggtatggtggcacacacctgtaatcttagctacttgggaggctgaggcacaagaatcacttaaacccgggaggcagaggttgcagtgagctgagatcgcaccactgcactccagcctgggtgacagagtgagactctgtcccccctaagaaaaaagaaagaaaaagaaaaaggaaaaagaaagtagaaaatctgcttattcatataaatgaatatcctttctgtcgccttcttcctcatctttgttggatttactctgcctttggctggaattttatcctctctcattgttcattatacaatgaaataccaaactcctgtggggtttttggttggggttttgtctattttttgtttttattgcattttcttaggcatcttctctcttttcacatttgagatgggctttgaaggctgatagtgataagggatagggagaaaaggtaaaacaggcaagaagtatgtgaaatgcctggatggagtttgacattgtagatagcatgaccaggtaaggccccactgaggggagcactttaagtaaagtgcaggaggaagtgatgaagtgagccatgtggttatctaggaacaagcatgacggacagaagagcaagcacaaaggtcctgaaccaggagcaagcctggcatgatttagaaatagcaaaatgtggcttaagccaagtgactgaggaggaaatcagcaggagattaaatcagggaggtcataggaggagaagcaggtcatgtagatcatgatatggattttgtgttactatgctggggagtgaggagatactattagaaattgtatatgtgaatgtgtttgtgaggtttgtacctggaatgatccaggaaaagtggatccaggctaaatttgccagactaagagttaaggactcttccttttaagcagagagcaaggtcattaagaagaagagagaatgcatgtatgcaacagtttccaggctatagtttagttctgtgcatactgtgagaatgtgttgaatgtttgttgattggtttattgataatttctaaagtttgcaggtagagaaatagatcgagaaaattgtcatgagtaactggaaaagtagagccaggtcttttgactgatagctctgtggcatctctaggcaccactttctttagaaatttggctctgatgaaaattaataccagaccacttaacttggagctagcatcaaaagtatccagaagagagatttaaaatgcacacacttcagcctattcttaggaactccatgtaagtaggctgggggaagggcccaggcacacgtattttgagaaagctcccaggtaattctgatgtgcacccctggtcaaggagccaattgcaaacctctaaatccatggaatagttgtttaattgtaatgtctgtaagacccaagttagtggagtatgtgagaatccctacaccagctatttatgagcaatggacaaataaatcaaggaaatacaaacaggaaagtcacttggctgcctttaaatacagtttcttctcattagagtgaacatcacctttaagaaatttgcatcatttgaaaaacctagagctaaaaattttcttagcactgtctgtgaacaatgagcaagttggtccaaagtttcattgggttcatttctctcaatatattgctctaataatcaatgccatcactcagagtagctgccattgtagaatgcctctgccatactaaataaatttttaagttcttattttgaaaaatgtgtagggctttataaatttgattcttaggggggaaaactgaattaggttgtttttattttgcatacactattagactgactaactcttttggtagacaaacagaaggttccacatccctgatccaagaggatatgactaagaaaagcaatagagtaaataagattgtagaaggtgacacggtttgaatgtgtaccttccaagttcatgtctgcaatgttgagagatgggattttggggaggtgattggtttatgagtgctctaacctcacaaattgattaattccactcatgggttaatggattaatgggttgtggagggggtgggttagttatcacaggagtggatctgttgtaaaagccagtttggacatctctcgtgagccccctcaccatgcaatgccctgagccacctcaggaccccacagagagtgcccagcagcaacaaggccctcaccagatgcagcccctataccctggacttcacagcctctagaactctaagaaatacacatattttctttataaattatccagtctcagttattctgctatagcaacagaaaacagactaagacagacggtattctaaacatagtagcttggaactcaggctccagtgtcagacagttctgagctcactctagttctctgtcatatatcagctttgtgaaatggaataactatcctcagcttcatcatctgtaaactggaaatcataaaggtacctatcccttgtattttgcagggaataaaagagaacatttatgtaaaatgcttagctcacagtgcctaagtgataataggtgtttaataaatgttagctcttatttttttcatagatactgagatacatcctaaaactgagtcttataatgttacttgctagattttttctttcttatcaatatgtgagttgcttacaattggtgctatcttaaagttgatgaaaaagatattaatgactactagtgtacagaatagtcagtgactttagtaaacataaatttacaaatagggttatgagttaattcgtaatgttttgtttaaataatttgaataggcccagaagatatctgcttgtattagcaattatatcaattattgagtgtctactcaataacaataaatacttctttcaaatatattccaaaaagtcacctttatattaattcagtggaccttccaaataatgcaaattgatgccattgtaaacatctataaaatgatttttttttttaggcagatgataacagcctaccattatctgaatctattgaaatggcataatagactttggttgcaacaagagagattacagtcagagagaaagtagaactagaaagtgtagacagaactactctggtatgtcttggctgcctcctgctctgagctgacttgacactaattaagcatcactgggggctgggtgccgtggctcatgcctgtaatcccggaactttgggaggctaaggtgggaggatcacttcaagtcaggagttcaagaccagcctgggcaacaaagcgagaccctgtctctacaaaaaaaaaaaaaaaaaattaaattaggccgggtgcagtggctcacacctgtaatcccaacactttgggagcccaaggcaggcagatcacttgacgtcaggagttggagactagcctggccaacatggcaaaacctgtctctactaaaaatataaaaattagccaggtgtggtggtgtgcctgtaatctcacctactcaggaggccgaggcaggagaatggcttgagcctgggaggcacaggttgcagtgagccgagatcgtgccactgcgctgcagcttgggtgacagggcaagactctgtctcaaaaaaaaaaagctgggtgtggtggtgcatgcctgtattcccagtggctcagcaggccaaggtgggaggattgcctaagcccaagagttctaggctacagtgagctacgatcacctcactgcagtccagcctgcgcaaaagagagagaccctgtctttaaaacaaaacaaaacaaaacaagaatctctggggactctttactgtgtctgctttgagggtgctgctaagaatatatccactgtattgctcagtgtcccttttaatgaggaccctttggaaaaagtttcccctagttttagtttcagtgttcgttattcaacaagtatttacagagcatcccactatttgccagacagtgttctggaaggtacagtctttgtgcttatgggcctcacataataggagaaatatataatgagcaaatgattaaataagtgaataaaagaatgttatgtggtgattaactgttatgaaaaaaaattaaagaaggtgaagcaagacaagggtggagataagggaagggaggcttcttagactggaaagtcagaaacttctttgaagatgggactttcagctgagacctgaatggcaaattcgacatgtgaagatgtggggaacaagcattccaggaagagacaaaacatggtgtaaaggcctcaagtcaggcatgagtttggcatgttcaaggaacaaaaaggagatgaggggtgagaaacatggtggagaagcagggaggtgctggctgacaaggcttcagggtccagcaaggacttgcaggaatcagaggtgcagtgggaagctgttagaacttggaaacacatctgagctactctgaataaacagtgtcatgtttgtttcatgattcctgtgacctgtatatctgaatccatttccttttctcattccctgctcaaaagcttagggctagatttatgacccaactttgttaaatacctaggatccaatcctgtatgctatggactgaatgtttgtgccccccaaattcatatgttgaaaccttatccccaatgtggtgatattgggaggtgaaatgggatttgtgcccgtataagaagagacatgagggagcttgctctgcctctctgttctctgccacatgaggctacaagaagaagacagccatctgcacagcaggaagcaggctctcactggacaccagatctcccagcaccttgatctcagtgcctccaaaaccatgataaataatgtctgttgctcaagccatccggtctatggtacatttgtcacaacggcccagactaagagtgcattttgtatttgcttcattcctggtaccaccttgtgcctagcactgcgtttccttttcctttctctttaacacttcttattttacctagttctggcttatgttatcttttgaataagtcacttcaaacctttttttggatgaaggtgtatgtacgtacatacatgtatacataaacaatggtgaaagaatggaggtactgatgcctctttcatgggatcttcaggataggacagatttttatctatccactggaatgatttcagctcagatgaactcaaagcccatctatgactgtccgcatcttgtgttttagcatgtagctatggttttagaagggatcacagttgatactcatttgaagtagttatgttctataaagtttctgtaagccctcagtgtatgaataccaaactatttttttttcttttgagacagagttgcccaggctggagtgcagcggtgcaatctctgctcactgctaccttcgattcctgggttcaagcaattttcctgcctcagcctcccgagtagctgggattacaggcatccaccaccacacccggctaatttttttgtatttttagtagagacagggtttcaccatgttggccaggctggtcttgaactcctgacctcaggtgatctacccgcctcggcctcccaaagtgctgggattacaggtgtgagccactgcaccaggccagccaaaccatttttcccaggggaaatatggtgttcccacaagccgctggccacattttcattaaccaatcaatagatacctttgttttatgtgtgtttctgtttaaagacaccttatttaatatatattgttgattcattaacattgaactcacagccaacagcactataactcatgcctgaaccaagcttagctaacacatgtattttctccataaggcatttagtcttgttgcacttagcaacaccagacagcaatttagccctatgcttgggggccattttaacagcacaatcaccaaaagaaagtgcaaaagtatgaaaatttagcactaaatagactgcaaaaatgactcttgtttatagtatgagagctggaacaagaaggcacagcatcacctgtttcatcttagcttgaaacatgtatgtccagctactcaaatatttctaccctctgcacatgcatctgaatgattagggaagtgtcttgagcatagatttgggggctgaaaataaattttagtgagtaaaatttgcaaacacagaatctgtgaaaaataggaatttactacattttaaaaaaatcttttacctttaaagtagaccagggtaatcccagttttgggatgtatgtcagcaagactgggagctctttatccatttactgaatgtaggggaccttcaaatgaggtaatcctggaggcatatttactccaatgtgaaaaatgcaatccatagttcaagtttatatataccaagaagctgagtggttcagtcgttgtactacaggtacatggagattgtttttatgacttgaaagaaagagtccatgttattgggaacattaggcaaatgaattaggaggcttgtttttcagcagttttccctaaggcagttaaggaaccagaaggtataatcaaagtggtcagttgtatcagaaatttctggaagcactgtggttgagaggagaggcaaaacttccagcctcttatctagagagggccctcactgtcctcagaatttggacctcccaaacagctggcctctaaatggctgccccgatgggacagaccagaggaacaaggagcaaaactgggctcttcgtagtttcctgttcttcattccccttggtctgtgtttgtggctttccaccactctcctaggtgtcactcttagttcttcagtcatgcttggtgccccttcctcttgatccccctggctgtcagtttctgtcaggctccaccttgcatctttattcaccttcccatgctcacagacacaagcttggtctatgccttcactaatgctctctaactctattgcaaaacatgcctgatcattttctctgctttcacctcaacttcctccaagataacttcttcctcaaagaaccccttcctaaaaagccttctgggattcctgtgtatgatttaaactcaaacacctctgacttcaaattcctctacctacattcctagttctttccaaagtaatcccttgcttcttcgagtcctgcctgtcactgcttttctacatgtgctcataaactttaggcaaactattttccttgctgttttcaaaacataactaaatttcccaacatcatgtcaggagttatcctgcaccttctaccagatatatcttctttctataaccatcatttacaactattcccaggattaatgacagtttcccagttcccctgctggccaaatagatgcagttttctgcgccccaaacctccaaagcactttacttttgccttactaggattttacatgttttgctttgctctaattatttttgtctatatctttcttgccattaatccctactataagagccataaagtttccttacccgtaattcctaataaaggccttgcacagaataggtgctcaataaatatttatgaaacctgaagggcgttttaattatcacatggtaaattggcaatttggtagccacctctttagaaagggaaagaggaagagaagagggaaagaggaagagaagagggaatgccagcagaattttgggctgggcgccgtggctcacgcctgtaatcccaacactttgggaggctgaaacgggtggatggctcaagcccaggtgttcaagaccagcctgggcaacatggtgaaatcccatccctacagaaaaaaaatacaaaaatcggcccagcatggtggctcacacctgtaatccagcactttaggaggccgaggcgggcggatcacgaggtcaggagatcgagaccatcttggccaacatggtgaaaccccatctctactaaaaatataaaaattatctgggtgtggtggtgtgtgcctgtaatgccagctactcgggaggatgaggtaggagaatcacttgaacccaggaggcggaggttgcagtgagctgagatcgcgccactgcactccagcctggtgacagggtgagactctgtgtgtatatatatatgtgtatatatatatacgtatatatatacatatatgtatatatacacacatatatatatatagcctgtctgtagtcccagctacttacagggctgaggcaggaggattgcttgagctgtggaggtcgaggctgcagtgagccacgatcatgccactttactccagcctaggtgacaaagtaagaccgtgtcttaaaaaaagaaagaaaatatagatgtggtaggaaattgttttcagttatctggaaaaaagttgcatgtctcattttcttttaaaaaaaaaaaacagaacttctctaaattcttattttggatacagaattaaagaagcaataaaggaactgctattccagaattaattttgatcaaccagtaaggaggcatcaggattacaaagatgaggaaaactttaggaaaaaataaccatgacagccaaaactcccatgtgccaaaaagtaaattgtgagttaggaagaaccaacttctgaagctgattcaaaaaagttaactgagcatatattttgtatcaggcactactcaacaactaggaatactgcaaagttcctatcctcacagaacctgctgtttatagggggagggagtaataaaaagcaaatttgcaaacaaatataccatataatttcaggtagtgataagtgttactgaaaaataaagcaaactcttgggagaaatggctgattctaggactaatgtagatatatacaagataagcttaaaacacagtgccagaaagtaagaaagtactcaaaaatggagaaacaaaacaaccccacactgatggcagtacgtcaaagagacacagcagcaaactgaaagagctcccagggccaaagctggaacaatttgagcaggaaagtaaataaagtagcattgaattataacccaagtacagaataaataaccatgagtccacactggtacacataaatgactgaataaataaataaataaggggagagaagacagaaaccttccaggcagagaggaattccaaataacacatggagataatccactctcaaggagatggagcttaattccccatcctttaagtgtgagctgtgcagggtgacttcctccaaaaaggtacagtatgaaaaggggttgtgggggagtaacttgaataactttagagtagagaaacaggacaaagaacagctcaggcagatgatcaaggtcaacatcaacagtgataagtcatgtcgatagtatgtacccttgatatgatatgatgagaatggcactttcccccgtgatcttcctaactaaaacatataactccaatctaaccatgagaaaaacatcagacaaatcccaatatagagacaatctataaaatacccaattagtactcctcaaaactgtcaaggtcataaaacacaaggaaagtctgagaaactgtggcagttaagaggtgcttaaggagatcgcagttacatatcatgtggtaccctggatagaatcctggaacagaaaatgatactaggttaaacctaaggaaatctggataaagtgtagactttcattagtaacaatgtatgaatatttgttcattaattataacaaatgtattataccaaaataagatgtcaataattggaagaacccaatgtgaggcatataggaactctgtactattctttttaattttttttttttttgtaaatcaggagctattcctaaaaaatgtttattttaaaaataaataaagcaagctcgggagatagtggcaaggatggaaggctgctctttcggtggtcagggaagatctgtctgaggtagaaacatttgcacagagacctaaataaaatgaggccaagccatgagtctttctggaggaagagtattgcaggcagagagaagagcaggtactaaggtgctgctgcaggggggtgttggcaggagggtgctgctgcagggaagtgctgctgcaggagggtgctgctgcagagggttttgctatgctcttagcatgtcaaaggagcagcaaagatgccaatgtgtacagaggaggctgagtggtaggaaatggggtcaggtaggtactagggcaggatgctgcagtcctttaggccacgcaaatgtgaattcttttgtgggtgaggcacaaggcaggacggcatagagtgcactccagagctaatctgtggaggtcttatcctgactcttccacatgggagctgtaagacctcaggatagtcatatgccctctctgataggtggatgtataatagctgtaggatgtagatcatgccacagctggcctcacaggagtgttgtgaagactgacaatctgtaaagcactaacatccttcggcacataataagtgcggtataaataagtatttaacttttattgtgtggaaagcccctggcaaggttaagctgaagagtgccagtgacttagattactcctgtgaaggctctctgtatgctcactggggagaacagactggaaggaggcaagaggagaggtcagtgaggaggccagagatcagtggtggaggccagagtggcagtggcttcgatgtggcagggatggtcatgatggggcttctggatgaattccgaaagcagatttgccatgatttgctaatggactggataaagggtataagtgaaggggaggagtaagcttgtctttcagaactgagcttgagtaactgagcaaatggtggtgccaatttatcgatatggggagaacggagggaggaggattttgcttgattggttggtttgttttgttttctttttttttttttttttgtttcggtctggagaaggattaagacatattaagagaggaaagttcaagttaaatgagaagctctcaaaagttcaattctgacaatatagttacaaaggattccaaaatgggagaaaagaggacggcatctgaagatgcttatgtagttatagggtttgttatttaatgagctcagattattcctttaaggcaaaaagagataaagtggcatgaaactgtacccacacattgtaccaatatcaatttcctgggtttgctattgtactatagctaagtaagatgtaaccattgggggaaactgagggagggatactccagacctctgagtactatctttccagcttcctgaaaatctatcattatttcaaaaccaaaggttttttaaattactcttattagggagaaggaaataacagcagatcatttagaggtttttgctgactaaaagaaagtataaattaatattgtgatgttgttgacaaactaatgcttacgtggctagggttcatggaagtgtaaaattccacagagggatgggagaagaatgacttcatttatcacaggtcaatccacatccgaagtggtaagttcatctctgggtgccttcatcactttcaggttgacaagcacactgaatgacaactgaacaagacattcagaactgggcaatgctgtcacattagaagtcattgaaggagctgaagaatttagccaggaaaattgcagatgcccacaagacataacaactgtctttaaacgcttgagaaactatcatttgggaatcaaatttagatgaatatttgacatccctttaggtgcactttctttttacaaaatgccagaagtattttttaaagaacattcagctgcattaaaacctctgattttaaaaacaactaagtggaataaacctggaacttcaaaatgttctcccaactgaaacctgttacccgtttggtttgaaattgagtcactaactttaagcaggatgcaacttcttaccaccaccttcaaccatatcttccagcaatgatctcaagagctattaggatagatctgtgacttgtacttaggggttagacatctgtcagcccttgagatgggaccaagaaaaagttttaattaaatattttccttgactgacaacgaggagggcataacactttttctattttttcatttgttctatggattgaaaggaaaatggatttaatactgcaaagttaatattacttcttcatgtaaatttttattatatactgcaatgaaggttagacaaaaattttaaaagaaatgatttgacactttgctataacaagaaactataaaaagtatgataataaaacccagtgaaaaaatcttgcagacactgattttcatatcctgattataatgaaggccttaactgagcagttgcactgttgtgtgcctgttcaccctgctgttgaatttttctttttcctttctctcttttttttttttttttttttttttttgagatggtattttgctcttgtcacccaggctggagtgcaaaggcatgatctcagctcactgcaacctctgcctcccgggttcaagctattctcctgcctcagactcccaagtagctaggattacaggtgcccgccaccatgcatagctaatttttttttttgtatttttagtagagacacggtttcaccacgttggccaggctggccttgaactcccgacctcaggtgatccacccaccttggcctcccaaagtgctgggattacaggcgttagccactgcacccggcccctgctgttgaattgatctatttatgacccacagagagcatgagactaatgtattactttagtgaaaaaaaatcaaaatgctgaacaccgttatgaaccagcaacaaaacggagaacattattctttcttcagacaaaaccaatctcttgctacacctggagcagagagtgtgtgtggtctggttgctggctctctggaaagataagcccagggaaagatggctcagtaatacagtgaagctaggaagggagtttgcacatccaagcattatactgaaggaactctatatgcattatttcatgtaagcctcaccgcaaccctacgaaaggaggtaccattattctcattctacagatgaggaactggggctcaagtaacttgcccaaaggtactcaactagaaagtagtagaggtgggatttaaagccacatctgtcttgagtccaaagtccatgcttttatctaccatgttctgtgaaatgttcactgaatattaaattgtagcacttaatccattcccctcccccacccacccactgtctttatctggacaatcagaagttcagaaagttgaggatacttgtccaaagctggtttgcagtagaactgaggcttgaaccaagatctcctgactcccgggtcaggatatttctgctgtgccagggaccattccatctgaaaagctaaaagctgagagaggatatttctaaattctagaaaatcacaaaggatatgaagtgagtaaatttagaatctgccaaaacccagcagtataaaaataacaggactaggaaccattctggaagtttgagagagatgcatttacgagggagaagtgtgatggagcacacatggtaacgagcatacaggactcaccatccctaagaagctgcacaggctgagaacagagattcaattaaagtgttaggttttacttttatttatttatttaacacactatataccaagctctgtgttaggtggttgttacagcctgaattgtgtccgtcaaacattcctatgttgaagctctaatacccatattctctcaatgtaactgtatttggagacagggcattaagttaaaatgtggccatcagggtgggcctaatccagtttggccagtgttcttaaaagaagagataagggcacacaaaggtacactaagggtgcacagaggaaagaccatatgaaggcagtgagaagatggccatccaaaactcaaggaaacaggcctcagaagaaactaacccaggatgggcacagcagctcacacctgtaatctcagcactttgggaggccaaggcaggtggatcacaaaaaattagccaggtatggtggcgcacacctgtaatcccagctacttgggaggctgaggcaggagaattgcttgaatctgggaggcagaggttgcagtgagccaagattgcaccactgcactccagcctaggccacagaatgagactctgtcccaaaaaaaaataaaaaataaaagaggaaaataacccttccaacatcttgatcttggacttctacactccagaactgtaagaaataaatttctgttggtttattttttttattttttgcgtaattttctgttgcttaagccacaccatctgttgtattttgttaaggcagcccttgcaaactaatacagtgctttataactatacgctcattaatccttgtaacaaccttttgatataggaactgtaatctccatattacaaatgaagaacctgaggcttataaaggttaaaaaaatttcatcagtgtcaatcacaagtggcagagttgagataattgtgaatgacagaaacctaagaatcctaattgaaggatgtctgggtcctatctcccacctcagcaagcagacttcaagacaaacaatctcatacacctctttgcttggtgtttctagaacaggtagctaaggccacgcactagtgtgactatgtgtaggcttagaaaatgattaaggaaggcacccttgaatagcatataacataaaggtcagagcactggactgggcaccagaacatatggggtcaaatccatttcctagggatcctctaatctcatgtactctttctgttttttgagatggagtcttgctttgttgcccaggtttgggtggggctcactgcaacctccacctccctggttcaagtgattctcctgccttagcctcccaggtagctgggattacaggctcccaccaccatgcccagctaatttttgtatttttagtagagatggggttttgccatgttggtcaggctagtctcaaacttctgacctcaggtgatccacctgcctcggcctcccaacgtgctgggattacaggcatgagccaccactcctggcctcttctaatgtattcttgagcaacttaatctctaaatctgttttttaacctacataaaaggaataagctgcctaacttttggtgttgctttaattacattaacatttcaccaaccttttggtgttgctttaattacattaacatttcacggcattcatcatgctgtattaaagctgtctttagtatcattaatacttagcacagtttccttgcatataattggccctcaaacaatgttgaaagagtccatatggaagttcttagcaaattgtacaaatgtaagcctttgattaacccaaggaaaagccacgctgtcgcattttctttctttcagccctggtctctaaaggatggaaagagatgagtcaagaatcaaaatcatatgaaaggtcaccaccgtccaaggacccaggtagcttcaagagagattacagagcaaagggtcacgaccgcctgctgaggaataggattcaggccctaacctgacagcttccattcttcatctctctcctgtgtctggtgacagttgtcctcatatcaccctcatctgtaatctactgccttttcccaagactacttaatagcagtcaatctgaaaaagtcaccggaggtagctcagtaaactggaacaaaagtctttgttcatgatttttactgagggcagccccacattcctttccccaagagccataatgggtccccaggaccaaagagtccaccttgcctttctgacccaccattctttcaggggaagagagatgctacacccaaaataaacactcaacactttctctttggttcagagggtgtaggatgcgcctctagcaatctagcctgtattagtccattttcacactgctgataaaaacatacctgagactgggcaatttacaaaagaaagaggtttaattggacttacagttccacgtggatggggaagcctcacagtcatggcggaaggcaaagaggagcaagtcccatcttacacggatggcagcaggcaaataaagaatgaggaagacgcaaaagcggaaacccgtgataaaactatcagatctcgtgagacttattcactaccatgagaacagtatgggggaaaccacccccatgtttcaattatctccctctgggtccctcccgcaacacatgggaattatgggagtacagttcaagatgagatttggtggggacagagagccaaaccatatcatagccattctgccagaaacaaaagcagaattcatgcatccatttatttatttgtttgtttattcatcagttcatgcattcatcaaatgtttgttgagtgccttctgtgtgccaagcacagttccagtgccaggggaacagcagagtccaaaacaataagcattcctgctcgcacagagtgcagtcatcactgggaagtggaaataaacaaaataaatcagtggaagatggaacttttcaggcgtgacaagtgttatggagaaaaatagaccaaaaaatgagggtagggaattctggggtaaagacataaagataaaaagcaagataagcaaacatctgagagaagagccatccaggaagaggcctggagctgggagtgcctggcatgttctagaaacacaagaggccagcaatgctgaagtagttagcagtgagacaagtcagagggttagcaggaggccagactggagagaacctcgcagacttctctgcgatggggagcatatgggggttttgagcaggggaggaatctgatcaaaatcatggttttacagggtctctcggcctgctgtgttgagaacaggctgggcaagaggaaggcagcacaaaggcggaagcagaccagtcaggaagctgttgtaataatctaggaaagaactgatgatggcttagaacagggaacaaagtagtagaggcagggagaagtgaccaggttctgggatgcatttttaagacagagcccacaggctttgcctacagtgtgttgtgggatataagagtaagagaagagtccaggaagaatgtaattgccattcactgagatgaggaaaactatggaagatcaagtttggtggatggatgacccaagaagctcatttggtgatgcttagctttgagatgactttagatactcagttgaagatggtaagtgggctgttgaatacatgaggctgaccttcaggggacaggtctgagtcaagggtataaattgggaatggtcagtatttaggtggatcccactgccataaggctagacaaaaacattgagagtaagtacaggtagaggagagactgagcccgggacaggccaccagtagacaccagagctgagaaggaagtagccaaagatgaactagaaggaacaggagggaggcaggaggaagccaggagaaggtgggcccttccttctcctcactgctgcctcgttaaccctcattttgcctttttgctgtcactccacctctgtcagcttcacctctctcagattcattcttaggtaaataaagatgttttctatcactgtgcatgagccaaaatagatatttactaggtaaacactattcctttaattgggcgattcttaaaaaaaaaaaaaaaaaaaaaagaaggcactcagatctctgttcggtgtgttcgttacaatatgtggatctgctggaacatcaaattacccagctccacgggctccgtgggctccacagtcagcctgccaaatggtgttgaagatattctcatgattgttgctattgttattgttcagagaggcttcagcccttggggcagccctccctccttccctctcccactctccaccccctgatccagaggcacgaatgctctcatcaattcactttggtccagctgccaggctggggaacagatgttgcattgttaacaggaaggagaaaacaaacagctccactctcctgtgttctcccgccctcctcccccatccccctttcagtcccctggtgaaaatgggaaaacaatgttggggagaggacgggggtccagtgagtaatgcccttctccctgccaaggccgagccacggagctcctgaccagaggcacacagagcattctcctgggccctgtttatagaggacataagctgtgtcagctgagcgggcttgctcatggctggtgacgtgaagatgttctcactgagcagaacattgaaagaagacaatggccctcttctgcatgtggccccagtgacaaatctacctgcattttaagggcaaaagctatgaccaaaagacaagcccagggcagaaggaaaatgtttcttggctgaactctatctctgtatgtctgatcatttctcctctggaggctttttcgaaatggggagaattcctttttttccctagagaacacagggtaagagtctcccaccttttctctcacttgtcacgcagacccttccaagctggggaggggtagaggggaggggtgcatggagtagggtaaatgtaggaaatctagagtgaaggctgcatgtgaaatagtagcatggaggtaaaggagcacacagcctgtcagctaggctaagggattgaaacttcccttgaagttactagatggcaaggaaaagattttaggaagaagagtgacatacaagaaacagatgacatctctgtgatagatgggtgggaagggaaagctagtcaagaggccgctatagcaatccaggtcacagacaaccagaagccctaagacagtattagcgatagttcagctgctgtcaatgaggcaaaatcaatagggcttaggaaccaattgggcatggagaaggggtggctgaggatgatcaggctgtagaaagaacattagtggctctaagcctggaaagtttatgtccaccctgtatacaacatccacaataaaagtactgtctaatcgtaaaataagtagaagaaagccaataagctttgttttttctagggtggcattttgatgcttttttaaagcactacaatcttgtttgtttaagcttttttttttttatttccataggtttttggggaacaggtggtgtttggttacatgagtacattatttagtgatttctgagattttggtgcacccatcacccaagcagtacatactgaacccaatttgtagtcttttatccctcacccacttccaacccttaccccctgagtccccaaaatccactgtgtcattcttatgccttggcatcctcatagcttagctcccacttatgagtgagaacatatacaatgtttggttttccattcctgagttacttcacttagaataacagtctccaatcccatccaggttgctgtgccattaattaataattttttatggctgagcagtattccatcatatatatatatatatatgtatgtatgtatacacacacacacacacacacacaccacagtttctttatccactcgttggttgatgggcatttgggttggttccacatttttgcaattgcaaattgtgctgctataaacatgcgtgtaagtcactacacacttttgaaataattttttggcactctgtgtttgtttccttggtgttccaagcctatgctttttttgtgctcgctggagaatccaacacagggaggaagtttcaggattcacgtccaggccacaaggtagatggcgatgctgctcacagaggacagggatgcaggaagaggagaagggaggtggagcgagagtgatgagctcagccttggacatgctgagtgagaagtatcaatggagacagacactgccagaaagcagctgattagatgagtctggagcgagatggtggaactgggcatcatcagcgctcatgcagggggagagtcatgggagaggatgaggtcacccagggtgaatgtgtggagggagaggggagacagcctgaaatcacaccagcagaaaatcagcattttagggactgggcaggaaaaggagcctgatgagaagcatccagaaagactgaagaaaatgtgggagggagtaaagctgcaaagaccaggaaaagtgggaattttaaggagaaggaaatgatcaacagtatcaaatgctatcagctgattcaagtcagttgagaggatggccagggctgattggcaccactgtgtttaacaatgaagaggtcactggtggtcctactgagcgtgatttctgcagagcagtatatgtggaaggataacagaaaagcaaatgatgtgataaataaaaggcaagtttataccattagtggtagccgtagaggaatggaaggttgagggaaggtttcatttaaagatggtaaagaacacactggcctggtgcgtggctcatgcctgtaatcccaacactttgggaggctaaggtaggaggatcacttaaagccaagagttcgagagcagccaggacaacatagtgataccctatttctacaacaaataaaattaaatttaaaatagctgagtgtggcagcatgtgcctgcagtctcagctacttataagactgaagtgagatgatcctttgaatcctgtagtttgaggctacagtgagccgtgatcacaccactgcaccccagtctgggtgacagagtgagatcctgtctctcaaaaaaaaaagaaaaagaaaaaagaaaagaaaaaaagaacatttaaatacactaatagttcatttaacctgctaagcaaatacatcaagccccactaggtttgggggcaaggagggtatctttaatacataaataagttttaggggaaaatttctttttacaccacctacaggctacagagaatcagctgaggcaataattttacttggcttggatgtggtgctctggaaagggtggcaagcatttatcaggcacctactgtatatgttagttaatgtatgagctgccatatggaattcagaaacaataagctcaagaagctcatcacctcagaggctgcaaatgtacagtgtgaaacacacattgtgtttgtcctacaccgtgattttgtaaaattaaaccaccactttaaaaagtcataaaaatttggacatctgttctctcttgaaaaactggaagatctacatctacctggatttttggtgggcagcaactggctggagtaaagggcagctgtcccttactgagagcacccattctccagttcacacagtccccagaggtctactatctgattcacggagcggacttcagatacgtcatccacctggcccttggtaggcatttgtgtttgtgactacagctgaagtcaatctaagtcatgaactgctacatgctaaaatgagggatggcaataactatgtggcaggtattcaaaaaaaggagaaatcagtagaattaaatagttgagcaaagcttcttagacttggtctgacaggcaggtaggataaaggtggatgattggatgcataaatggatggatagatgaaagagaaaagaattccccttgggttcaggaacagaccaaatacgtttacatggcagactgtggctagaagaaggagcatagatcaggtatctttcatttaaaatctgaaaactcaggccgggcaccgtggctggcacctgtaatcccagcacttcaggaggccaaggtgggcagatcacctgtgatcaggagtttgagacaagcctggccaacatggagaaaccccgtctctactaaaaatataaaaattagccaggggtggtggcaggagcctgtaaacccagctactcaggaggctgaggcaggagaatcatttgaacccgaaggcagaggttgcagtgagcagagatcatgccactgcactccagcctgggggacaaagcaagactccatctcaaaaataaataaatgaaatctaaaaatgtctagttttcagagcagggagaaggcatttcaacttatctgcaggcaatgctatctattatttctctatatgagtatcctgttacaggctacttcctgattgacagcaataatcatggagtgatattgcaagaagctgctgtcttgaaaacaaaatgtaaaaacttatagcatcaggagttcatatctatacaacagtttcactcttttgcttggcataatcacattgattccaattccactgatagtggaattggattcttccagtcttttccaggtggctgttggtatccatcctcaaagagggtgctctttaggctcaatgaactgaaattccaacctcacatcctgtccaagtttccaggcttctgacagaatctgaaattaccccaagggggtaatcacttacctaatccctttgataatttctaaagtgaaagaatagttgaggaggggagcggaaaccacctaaatgacagaaggaaaagcattaaacttttaccacactagttcattgaccccgtttcaaagtcctggcctttgcactgcatttcctgtcttccaaataagaccaattgtgtgtatggaaaagcccacttgccacctgaggaccctaagatgtagcccatccattgacaaatcttacttttttttttttgagatggagtctatgttatccaagctagtcttgaactcactcctgggcccaggcaatcctctgttagcctcccgtatagctgggattacaggcacccaccactgcacccagctctgacaaaccctactgttaaataaaaacaatgaattataacatactagggataatcagaagcttccaggaagaaaatagtttccatagaaacacatgataataatagcaatagacttctcaatatcagcactaaaagttagtagatgaaaaaatgtttttctgaagaaaaattattttcaactattaccaactgaaggtcccaattaaatgtgaacataaaatacattttcatacaaacaaaactttttaaaaatttgcctcctatgtatcctttactagagatttctagagactgtgacaaaatgaaaataaaatgaaaccaaaatgaaaatgtaaaccaagaaaggggaaaacatgggatgcaggaaatagggaatgcaatataagagaaagatgaaggaaattcctgggatgaccgtgaagggaagtcccacaaggacagctttgctacaggcctggaggatcacccaaagtggagcaagaagacagaagcccctggaggaaggtctacagggaaaaaaaaaagaaaaaatagagctgtacacacagaaggcttcaagatgaatgtaaaagtatctccatcctccacagacacctgctctgaccacatggaactttatacagagaggatgtttaatggggtagagggatttagccataggttaaaaaaaattaagggccaggcatagtggctcacaccagcactttgggagaccaaggcaggcagatcacttgagcccagaagttcaagaccagtcggggcaacatggcaaaaccccatctctacaaaaaattagccaggtgtgatgatgcatgcctgtagtcccagctacttgagaggctgaagtagggggatcacctaagtctaggaggtcaaggctgaagtgagccgtgattatgccactgcactccagcctgggcaacagagtgagaccctgtttcaaaaaaagagaaaagaaaagaaaaaggaaaaaaaaagtaataagaaaacaaaagatgtaagcaggcaatcattaattacctaaaaaatcaaaaattgaaattataatccaatacttggcttagcatgaacaatctttcaatagtcataataatctaaatgctgaatattatttgacttctctgctggaggaactggaatcgtatgaaaagaaaaagggagcaatagagatctaaaacgccatctacaataaaatgtttaaattatttcaagttagccaggcacagtagtgctcacctgtagtaccacctactcaggaggctgaagcaggaggttgcttgagcccaggagtttgaggttgtagtgcactgtgatgcctgtgaatagcctctacactccagcctgggcaacataatgagaccctgtctaataatagtagtatcaaattattaattaaacaacatcagtatgagcatattctttgaaatatggaagtatggctgggtacagtggctcaggcctgtaatcccagcactttgggaggccaaagcaggtagatcacctgaggtcaggagtttgagaccagcctggctaacatggtgaaaccctgtctctactaaaaatacaaaaaaaaaaaattggctgggcatggtggcaggtgcctgtaatcccagttactcaggaggctgaggcaggagaatcgcttgaacccaggaggtggaggttgcagtgagctgagattgcgccattgcactccagcctgggcgacaagagcaagactccatctcaaaaaataaataaataaaaataaaaaataaaataaaatatgaaagtacatatcattagaaagagtgaaagatttgaatgcaagtacctctggggaacaggacatggagaaggtggtcaggaggctacaggactgctgagttaagtgtttttagcacatttaacttgtttaaattcagggtctgtgtcactttgattaaaatttaaatgagatctaggtgccactttgggaggccgaggtgggaggatcacttgaagccaggagttcgagagtagcctgagcaatgtagcgagacccccatctctattaaaatatatatatataacaaaataaaatttaaataaatttactatcagaattaaatagtatccctcaaacacctagcatccctatacatacctactgaggtgaatacatggaaagttaacttagagccatggttcttgggtctggcatgtttgtcaagcagttatcaacctgcagtggcagctcccttacagccaatcatccatgcagagaaactctttttttttttttggatttaaaaacactttttatagtgtgttgtttttattgagtggtcacacccgaaggggtggcggtggatcctgtgggggaatggggctgcccaagcctcatgcagagaaactcttgcctgtgtattcaggcaacagctgcctctgcaagtctgtgtatcagaaggaaagaaagtggacaagctagacaaacataggcatctgtggagacagatattttcacattcatctttaagcctgctatgtggacacctaccatgacagaagtctgaattttggatagtgttgaaaacaacaactagttctagtcctcaccctcattcagagagtctgaaaaaagctttagaaaaacagaatgaactcttccaagttgctgagattcatagtatctccttccagaaaaaaactatcagttagttagtctgaaaaacacttcctacctacaggtgctagaatacttcaccctgaaaggtaagtgttagatgggtcttagataattcaacttagcaattcaaccaggagatccaaccaccaggttcccctgaggcccatcctggtggcaactgtgctacgatgggggcagagtgggtgggagcccatttctccacaggaaatccagaaacagtcccaccaacttccccaggattaaccttaaatgccttcaccctcccttaaatcctcccatctccttccttttgtcacttcaagcatatcactgtaacccatgttcaatactcaggaggaaaagaatcaatcagaaactcacaccttggctcgcttattcagagactaggagatccagagaggcaaagtgacttgcccaaagctacagagccgttttgcaacagaaccagatctagaatcctggatggggctccatactgcctagctcagagcttagcctgtaaccttcagatagccagatagaaatagatgtcaaaggccggatgcagcggcttacgcctataatcccagcactctgggaggccgaggcaggtggatcaggagtttgagaccagcctggccaacatggtgaaactctgtctctactaaaaatacaaaaaaattagccgggcatggtggtgtgtgcctgtaatctgagctacttgggaggctgaggcaggagagccacttgaacccaggaggcagaggttgcagtgagccgagatcatgccattgcactccagcctgggtgacagagcaagactctgtctcaagggaaaaaaaaaagaaatagatgttaaagcaaggtcaggatctaaacagagttgtaattctgaggattctgatccttccaccactccaaattgcctcacaaatccataacaataaattaaaataaaataaagggggaactataaaatccaacaaatcagaggcttacttctgcctgagctgcccattttttggggtttaaacaatccatgcattcagcaatgagttattgagcatgtattttgtcctgaggaacttccaaatggaggtgtctagtagagaggtgggtgctgaggtctaagaagagagagatctgagatggtgatcattgtcataataaaggatgagattgcccggggagaatgaatacactgagaacagaagatgcccaaatcccaaggagcaccagccttaggatgggaagagtaagggaaaatacagggaactcctagaatggaccctagtctctgaataagcaagccaaggtgtgagtttctgattgtttcttttcctcttgagtattgaacatgggttacaatgatatgtagctaatgcttgaagtgataaaaggaatgaagtgggaggatttaagggagggtgaaggcatttaaggtcaatcctggagaagttggtgggactgtttctggatttcctgtggagaaatgggctcccacccactctgcccccatcctagcacagttgccaccaggatgggcctcaggagaacctgttgaagacaggtgtttccagaaagggtcagtaggaggccacccactcttctgctaagtgaacttagtccagatcagaacatgtactgctcagagctatgtggtataaaggttgggcaaatatgcactttcacagtgctgagggcaaagaccaagaagactgggacatgaccagaaagaaaggttatcacatgctaaaagcaaagagaaaaggcaacaacagtcacctttcatctcattaagtgtattttctaaaaaaatgtcactttggaagaaattccaagtaggaaagtagttggtcggcccagggaaggtgttggttgattgttagcttttgattggtccaagatccaggaggttttatgagcaaagagctcacaatctcaacccccatgtcctgattacactaggctctccctggaggttctctctggctgggattttagacttgagaggtgtagagagagctaggaaccatggcagtagggtagaaaaagcccaggctttggagcaagcagcctaagttggaaccatgacttcaatccttatcatcagggtgaccttgttaagattacgtaaactccatgagtctcagtgttgtcatctataaattggagatgatacttacctcaaaggattgaatgaaagcgtatttacaaaaaactaccaatagctactcagcaagtgctccgtcacctcctgcttcctcctgcccaccttacttttgagagccacccttgagtaggcaagataacccattatcatggcttcctccaactccttccaaattagaaacattgtccagactgacaatgatctcagcattttctctgtgatccatcagtaggtaggattctaccattatgtcaccaagctattgtaccctgggtattgcatgctccaatcattgggtataagctggcctgcctttgtaactctcagctgtttacgtagttctctgggaaaatactacctttctaggagccatcagaggtagtgcaagcttgatgtggttcctgatcttctgtccaccctaaatccctagtataaaggtcctcagtttaaagacatacacccataccaacacacacacacacacacacacacacacacacacacacacacacacacacagagtgatatggctaggcagctgctgctggtcaacattagtgagatttccctcttgtgctgttgtaaaccaccagccatagctattgtcctgtcttttctggtctctctctctctctctctggcatatgagtaattcctcatttgctcttttttccctgaagttcatgccctcaggcaccgcaggcaacctggataaatttagctcttctcagggccttttcctgactttgttccatgactgttgaaggtttggctgctccccagagagagctttggcctggcttccctcccttggaggtctcatttggttctggtgtctgctatgccacttgcataattggtcatgaatcacttcaggttacggtatgtactttgagaatcaatcagtttgtgctcttggaagctgaaatccttcattccagcttcgcatcccttggatctccttccctgtgttttcccttgccctaaacagcctgtggctactgctcatagctgtcatgcttactccccattagggctaagcgggaaatgattggttggtgactaataaagcctcttccactctcttctccaggagcagggcctcagatcccatgagcaggatccagtacagtgaggatgttcatttaaagtttactagtttgaatggttgtagctgaatataagagaggctggagtcaaactccctctttaagcaattaaatgaaagagaactgcatgaaaaggccattatgtgtttagacatgatcatcttcaaggatccaaagtaagaatcatggatcatgctcaagcttttatcattttagttactattttctctcttcaatataggccattgataaattatccaatcagcaagcatttattgatcaccagctttgtgctagtagctatgggcatttcagaagtgaacagcatcattcccagtcacttatggggggaaaaaaggtatttttttaaacagtgaattacaaaggagagataagtgatacaggaaatgagagctattttaggggatgtgggtgacacctttaaaggacctgacatggactctgctttcctggggcttgcaaactacatggggagattgaactgacccacatgaaatgagacaagaaccagggccaaacaggaacattctgaggaggctttacggaggcagtaggtttatacgagaccttgaaaggtgggaaggatttgaatggatacagaaaggaaagaacttaccaggatgaaagaacagcatgaacaaaggccagaagagaagactggcacaagtttcacatatgtgtatgttttggggagtgcctgtaaaaagctggtcttactccagcaggaaatacatatggaggggggcagaaaaacaggctgaggatggtcagcatccagggccttgagggctaggcatgacccagtcaacttactagcaacagacccccaactgcaggagcaggctcctgttgggaaggggagacactgaccttgttccttgtaggaaccactatgaatggcctcttcccagtccccatattcacctccaccccagttagctgcccttgctatggaaaaccacattaaaaagagtcgtgaaaccaaagtgatctactccaggccagtgaggcagtctctgcacatgccccactgggagggtctctctcagtgcctggggctgcagacacttgtgtgtggagtccactacttgttggtagtcggggccaccacaggctatggcttcaagaggcagtgagataaacagctgtgccctggatagaaaagtacccagacactactgcttgattattttcctggcatgcaactgggaccagtggcccaggtgtcactgctgccaccctggctgatccacagaaagaagggtcagatctattttaaggatctgtttgcccagtcacatggagaaactgctactttaaaaacagctatttaccaggaaagtaaaggcccctgcaaaataaaaggttagtatactatccctagtaactctttaaaccaaagcaaacatccaggcaggccatgtttgcactgcaccgttcttgctttctgcccttggtcacttgattcccaaggttcttggttgatttcttcctcggagttaagctgagaaagagcaactggtaatatcaaagcacaggggtctctagagagcaagggagttataaacacacagcagttgtattgttacttgaagagtttgttactattgctctattgttactttggttggtttgttttaggagagtgaaggagtctgatcaggcaaaatctgaaagaatctggaagatctaagacccttcagcagaaatgcgccttctaccttgtattagtccgttttcacgctgctgataaagacatacctgagactgggaagaaaaagaggtttaatggacttacacagttccacatgactggggagccctcataatcatggcagagggcaaggaggagcaagtcatgtctttcacagatgatggcaggcaaagagagagagcttgtgcaaggaaacgcccatttttaaaaccatcagatcttgtgagacttactcactatcacgagaagaacaccatgggaaagacccgcccccaagatttaattacctcccaccgggtgcctcccatgacacgtgggaattatgggagttacaattcaagatgagatttgggtgtggacacagccaaaccacatcacacctatatttcaggattctgatattagtgtatgggaagtaacatcaaatatggtctacagtgatattgttcaaactagaggtccaaaccatcaaggcaactccaagagcattaaaatcaacatttggagaggcatcaagtgtggagacagtgcagtggctggcactttctacaaaccgtcagagcagtatgctcccagcttctccatggacatccctaaaccttctttacctcccagcttctaaaatctgctacctcattaaatcatgtcaacttaggaaatcttcatgggacctatcctgtggaatttatagttttgcttagggcacagtatgacacatatttctaatagagaaaatagtacaatatatgaatactacagaataagtggcattaaaaaaatgcagggtgtaggtgacaggtggacctgtgtgccctagagcacacaatgaaaaacacattgcctatcatggaaattgaagtccttagcctgacctccaaagctttccataatctgacaccaatctccttctcagccctatctcccaggactcctcctatacagtcaaaccagacttcccctaagctcacctcgctccatggctgggtttttgccacttaacacaatcattcctttcctctcttcttccttcagtcacttcacacacgtccagtgattctgctctccaaatgctaactaggttccaggtctggctcacatttctcctgttccttgaaacctttccagcccatcccagtgacctcaccgtactctgaactcacagcactctttgtccaccatgcacaccactctttgtacatcacgcacagcactcactgcctggatgctcctttgttcatgaatggggcgcagccttgtgagggctctgatgggttgctatcttggacattgacttctcctttgatctctcctcatatcatctcacaaccatattatcctttctttgatggcttgcatttttgaatacccttcaagcttctagcacagggcccaatgcagagaagttggtcaataactgtttgtgaaatgaatgacaatatagaaaatcatctgatgctcaattatgtttccgcctgaagaggtaaaaagaaagggctacatttattgagggtctgtcattttcacttgttcagcactttaacacccatctaaaatgcagatatattatcttccacttatataatatgaaaatgaggttcaataagttgttcaacatcagtcagcaataataagacagctgagagacaaactctggtgtgcctgacttggaatgccaggctacgtgcactacctcccacctaagcatccgtctgtgggcaggttgctgtagtttcttcctgtgagtctctcagatgacttttactttttatttatttatttgtttatttatttttgagcgtttcactcttattacccaggctggagtgcaatggtacaatcttggttcactgcaacctccgcctcccaggttcaagcgattctcctgcctcagcctcccgagaagctgggattacaggcacctgccaccacgcctagctaagtttttgtgtttttaatagagacgcagtttcactgtgttggccaggctagtctccaactcctgacctcaggtgatccacccgcctcggcctcccaaagtgctggggttacaagcgtgagccaccatgcccggcccatgacttttacttaatcaccccatgcactctccctcccttcaagccacctccaaagagctacttttcctggaaccactgcatgctttcatgtttctgtgcaaatcccttataattccttcagctggaaaatcaccttccatcttttctacctgtgctatcttatgtatccttgaaggctcagctgaaatgaatattccctccatcaggttttctgttaacaaaattaagtgccctcacatctgagtcctcatggtcccagtgcctcttccacagtttagaactcatttgattttgtttcaagctgcaatcagttgcttacctctctgcttcctctcttaggctgtaagcaacccaagggaagggaacacactctcttcatctctgtaagctgggccttgcacgacagcagcagagtgtcccaaaagtctttggtggttcaggtggctgcaggtggctgctggttgccagtgcagagcattgattcagtcatatcacacaccttcagtgattctgctcaggcaataagccactgggataccaacgaaagccaaaaaaaggaagctccaagtagacttcccatgtcagctcccaatgtgcaacccaggggtttcatcttgaaaccatgtagtctccagttttaagtgattcaagaatgttttgacctcccttcttaatctaatctatggtttccaagatagtcaatgcctcagagagaggctgtcataagggtccctgttctttaaagtgccaagaaaaaaaaaatggttagatagatcctttgtagcatgcctttagtagtaaggtgtaacctcgaggtttgaaaaatgaatgaatgaggccgggcatggtggctcatgcctgtaatcccagcactttgggaggctgaggcgggcggatcacttgaggacaggagtttgagaccagccaggccaacacggcgaaaccccgtctctacaaaaatacaaaaattagctgagtgcggtggtgtgtacctgtaatcccagctactcccgaggctgaggcaggagaattgcttaaacccaagagtcaatggctgcagtgggccgagattgtaccactgcactccagcctatgcagcagagcaaaatgccatctgaaagaacgaaaaaagaaaagagagaagaaagaagaaaggagaaaggacaagaaaagagaaaagaaaagaaaagaaaaaaaaaaggaatgaatgttaaacatgccagaccctatttaaatgaagaaaaaggatatttgtttggtttgccttatagagtccggcccctccaaagattctaagacaaattacatctaacagtggagactggacttcctcctgaagaacaagcaaccataaagggatggcagctcggcagcagcccagtaacacaaccagtgacaatctgtacaccaagtttctgtggcatactgctccttgaaggcagggcttgaaagctttcattcttcttcttcttccttcttcctcttcctccttcttccttccttctttctcttcctcctccttcttccttccttccttccttccttcctctgtctctcttgcttgcttttgcttcttctttctcctcctccttcttctctctctcagcagatcagaaagttttaattctacattcccagttcttagcacacagcctaagacatagtagacacttagtatatatttgccaatggatactcatacttgctttctctccttttttaattttttgttttgtttttgtttttgtttttgtttttctgagacagggtctcactgtttattgcccaggctggtcttgaactcctgggctcaagcaattctcctgccttggcctcccaaagtgctaggatgacaggcgttagccaccacactgatcttcttatctttttttatcttccatctttctctttttcctcctttaacatctccttcctgcccattcaggacctgttgagcctgcattactaaaaataactgaggccctaattactaaaagtgagggattaccttccccttctctacctttgccctaccctcccccatcctctcaggcaatacatagatgctctttgtgaaatattaaatattaaatcctattttttaaaaaactgatggttcccaaactgtgcacagtggctcatgcctgtgggaagctggggtaggaggatggcttaatgccaggagttcaagaccagcctgggcaaaaaaataagattcccatctccaaaaaataaaaattagctgggtgtggtagtgcatacctgtagtcctaggaacttggatggctgaagcaggaggatctctcgagcccaggagtttaagcctgcagtgagctgcactccagcctgagagatagtgcaagaccccatctcaaaaaacaaacaaacaaaaaacaaaaaaaaaaccccaccaaaaccctgatgattccctcattttctggatggctcagaatgatcgtatccctcttgagtaatccagcccttctcctatttcttcatcttcaccctcatttttctactcacttctttcccacttccagtggtctcagtccctgggtcgtctggctgctaaccctcaaagctgagaaacatgacccttagagtcttagagccgttccttgggacacccccttgaagctcgtgtgggattccttttctttttttttttttccccagatggagtctcactccgtcaccaggctggagtgcattggcacgatctcgactcactgcaacctccacctcccaggttcaagtgattctcctgcctcagcctccccagtagctgggattataggcgtgcactaccatgcccagctaatttttatatttttagtagagacagggtttcaccatgctggccaggatggttttgatctcttgacctcatgatccggctgcctcggactcccaaagggctgggattacaggcgtgagccaccatgcccagcctcgtgtgggatttctttgagatgggttcacagctgctgttggctgccctccccacctacactccactatcctgtcctgtgctagtcccaaagaatccaaaagactacctctgtcctgcctctggagactggacacataggctgtgctggtggccttcagggtatgctggccaccatcactgaggaaaacagtgcattctgttctggagtatgtgccagattaagggcaatccaggcaatgtggaatataaacaatgatgtgggagcataatgttggcactctcaggaaaacagataaaactcccttgtccaatccagttttattttttgcagagaccattttactttcttgagcatcaaaacatacacacacatagggtttttttgtttgtttgtttttgtttttgttttgagacagagtctcgctctgtcgcccaggctagagtgcagtggcgagatctcggcttactgcaaactctggcgagatctcggcttactgcaaactgctgccccccttccccctactgccaggctgaagcaattctcttgcctcagcctcctgagtagctgggactacaggcacatgccaccactcccagctaatttttgtatttttagtagaagcaaagtttcaccatgttgcccaggctggtctcaaactcctgacctcatgtgatccgcccgcctcggccttccaaagtacagggattacaggcatgagccacctcaccctgtcacccacatagttttgagccctggtcccacctgtcaggtagctggtccacactccatcccagaggaagctcttaggtcaaggggtgggaatttcaagaggggcaacgagtagctggaagccatgttcccaggcccatgttttaccccagcctcctgccccacatcctccccatagatctcacgtaaagggcctgtgccttgcagtgagggctgtttcatctacctgccttcctaataaactttcagacagaagtatgtatgtgtgagtgtgtgtgtgtgtatgtatgagtgtgtgtgtgtgtgtggtgttaaatggggatgttaatatagtcaatactaattcctagataagaacattgtcttagtcaagactaattcaatgctaatacctagataaaaacattgtcttcatcttggaaggtgaatacctgttcattaaatgatcattgctttggaagaacttttaatgggaaatactcagaaaacaatgccaatgtggatggggagacaagcacgacgtccaatagacaccatgcattataagcagagatagagataaagataggcattgaacaaagagagaaggaaatacaccaaaatgcccagagaggttttctccaggtttggagttacaggtgatctttgctttcttctttcctgtatatttctgtgctgcccaagtcttttactgtgagcaaatgtgactctagtaatggtggggattaataattttttaatttgtttttcaaatgtagaacacttttccctgtctcccagtgtcatcaagaagcccagaagaaagctgagtgacctggccgggcgcagtggctcacacctgtaatccaggcactttgggaagccgaggcgggcggatcatgaggtcaagagatcaagaccatcctggccaacatggcaaaaccctgtgtctacaaaaaatacaaaaaattagttgggcgtggtggtgcatgcctgtagtcccagctactcagcaggctaaggcaggagaatcgcttgaaccggggaggcggaggttgcagtgagctgagatcgtgccactgcactccagcctggcgacagagtaagactctgtctcaaaaaaaaaaaaaaaaaaaaatcctgaaagttgaggagtgacctcagtactaaggccctcagatcctccaaccccatggcacaggcgctccctcctgttgtctagcacagtgtctggcgaaggccatcacccttatatgagggcagaaggtgagctaaagccctatggaaaaggtggctcaggcatatacaggcctgtaggaccaagctcagagacagacctgtggccagtggctccacagctatgccccaacctaaatgtgcccccagagcttgctccaaaaagattcgaggagtaggaggggaacaaggcaaaggagataaaaaggggattactgggaaagtattagaactaccctggaccgggcacggtggctcacgcctgtaatcccaacactttggaaggccaaggtgggcagatcacttaaggccagaagcttgagaccagcctggccaacatggcaaaaccccgtctctaccaaaaaaaatacaaaaattagcctggcctggtgccgggcacctgtagtcccagctactcaggaggctgcagcgggagaatcacttgaactcaggaggtgaaggttgcagttagccaagatcgtgccactgcactccagccaggacaacagaggaagactccatctcaaaaaagaaaaagaaagagagaaagagagaaagaaaggaaggaaggaaggaaggagagagagaaagaaagaaggaaggaaggaaggagagagagagcaaggaaggaagaaaggaaggtaggaaggaagggagagagaaagagagaaagagaaaggagaggagaggggagaggaagggaggggaggggaggggaggggagaggagaggagagtgccctgctcaggaggtagcagatttccagggacccctgagggtcagaagagaaggactgggagaaagccaaggagttgaggcaaggttcacatcagctcagggacacccacgtcctcctctggctctaaccatccttctcattgacagatctttttaactgccttttgtttcctcttatctccctcacccagccaccagcttctacccccacccccaactgaattgcatcaccatccactgagctcccagggcctgcagctgttgctgcctggggtgacagacacaccccgatttttgaagggaatgagcttatgaggtcagggaggaagggggaattgggggctggggagaagcaaagcttggagtaaacttcccagaactgcagagggtggctgagaccacccactcttcttacattgtcactgtggtcagagccttgagccactgtcaagtgttggattcagagtgggtgggtgtccaaggagaagaaactggaaacagcagggaggaaagggcaggcacaaaagtgttgtgggtaattccttctgggagaattgataacttttgcattcatctggcagggccctctggaagcagcaataagttgacatctgttctttagctactaatgccaaatagattacttgacagtagtttaatatgcacaactaggaactctgtgtgtgtgtgtgtgtgtgtgtgtgtgtgtgtgtgttggtggagggtgggtgggtggaaagggagcaagagggaagatcttttgagagggtaagaggactatctgcattcctccaaatttctggagaaagaactcaataacaaattcagaaaagtatattaagtcctgggggattctgagccaatcttcccacagctggatatgtcaacatctgtccttcggtcctccttgtcctcaattttttttttttggaaaattgaccccattttgataagaatgtctgtgtttttgaaaaacataacccatcacatatgatctccatggcaatgatattttgctataggaggcagtagtaggatgtggtggtaagaacatgcacctcagaaccagacacctgggtaaaagtctgacactgacagttacaagctgggtgagcagtctgatcacttgccaagttgggtgacactagttcctcgctcacacagttgttgtaagaaatgaatgacaggttcagagaacacgcagtagaataaaaaagaaagaaagaaagaaagaaatgagtgggcatatgcaccgtgctgaaacacagagactggcacgtagtcagtactgcataaggtcagcaccctccgtatgaccccaccccaaatccagccactccgggtatgtcgtgatgaactaagcattagagcatggggcctaacgatggcatggctgcaggccaaatcctgcctgctgcccacttagcccaagagttaacatttttctaaattttttaatcactggggtacgaaaagtcaaaaacaagaatagcatttcatgccacatgaaaaacatatgaaattcagacttcagtgttcataaatgagttttctgaagcacaaccacactcatttgtttatgtatcttctctaagactgcttttccgctgcaatgacagagctgagcaggtacaacacagatgtatgacccacaaagcctagaatatctactatccggccttttacaaaaaaagtttcatcagccttgcattagaggatcagcagtccaattccagccctgcttcccaccttccaaatagagataacaccttctctgtcactgaaaaaccctcaccagcatgcacgcgcgcgcacacacacacacaccacacacaccacttggcttattcaccgtgatgctgttaacaccagctggcctccactttggaaagtgtaagaccagattaggctataaagcattactgttattttctgagcaagcacttgggggtggtgcaatcccagtcaacactactgaaacaactcaatgtgctctttgttctccaagtccttgatctttcgttcttattacaacttctcagggcctgctgtgttcatttgaactggttcagctggaaaaaatatgagttgggttttgtttataccttaatcagctgactagaaaggggttagaaagaagagagtgaggaagcattaaaatgcatacattattgagtgtttgctatatgccaggcactctggaattacagtaatgtattaataaggaaaggtccctgagagagggagagacaaacaaaaaggcaagtagttataaaataatccaataattcctatacagagacataaacaaagcgctgagggaacaaaaaataatttattctactaggttttgaagaggagcatcaagaaaagtcacagggggtgacagctttggcctaggaggctttgaagagtggggaaagttggttaggtgagaagagagggtttatccttggtagaacaggaaaataacagtggcaaaagcaaagagggaggaggacatgtatggcatgttcaatcagcagggagtgcaggaggagactccaggagacaagctggggctgcactgcagaggagcctctgtaccaccctcaggggatggcactttatcctggaggtgatggagagtctttgcagatttttaaaaggggagagagaaaatcacatgtgtgctttgaagatgatcattatgggaagcaacgtggagggatgtgctgacacaaagaaaacctggatttaaaaaagggctgggcacggtggctcatgcctgtaataccagcactttgggagccagaatggggggatcacttgaggtcaggagttcgaaaccagcctaaccagcatggtgaactcccatctctactaaaaatatgaaattagtcaggtgtggtggcacatgcctgtaatcccagctacttgggaggctgatgcaagagaatcgcttgaacccgggatgcggaggttgcagtgagctgagatcacaccattgcactccagcctgtgcaacaagagcaaaactctatctcaaaaaaaaaaaaaaaaaaaaaacaacgaaacaaaacaacaaaaaagtcatgggtgatggatgatagcaaagtgtggtgggaagaaagatcttggatgtagagttcatcgaacttcacaatatattgaactcacagttgaaagagagggaagagtatgaggataaatcccaggtttctggagtgggtacctggacaaatattggtgccattaattgagacaggaaatggtggaggagtagcagtttgactggggatgaaaaagatatttgggcttataatgtggtattcgacttgtagcatatgacatggttttaggtcatccaggttaagaaatccagcaggcaattactgatactctaggtctagagcccagaagatgcaggagctagaaatagacatttaataactttcagtatatgatgcatgacagcagaggacccgtgcatcattcatgcatgggctcagcaagtgtggaaaaaataatctacaattagaatcctagggaataccagcatctaattggatgcaaggcaagagaagccaactaagatgggaaaaaaggagaacccagaatgaaaagtattgccaaagcctcgaagaaggatgtttcagaagtttctctgccactggagagggtcaagagaattaaaaaaaaaaaaacaaacaaacaaaaccccacaaagcacaaactctctcaaataatggattcccataaagcccacttggaattctgtgaaagggtgtcaccttggagagttataaaaatcaattggcctgcttccagaactcagtgcctagggttaataaactggaaagcagaggtgttttccaagacagacaattggttttgatgggcaccaaaaagcagctgttgggtttgcaaaaaggagtcattggtgacttagccaggaaacatttcagtagagtaataggagcagagacaaatttacatggtttcagaagtcagtggatttgaagaaatagaaacaagaagtaaagcatgcactttcaaaagtggcatttctacaactgttttatgctttcctcgtttctttttctctctctcttaaacaccaattgtctgtcctggaaaacacttctgctttcaattcactgggtgctgttttccgaaaatagaccaatccattctcataactctccaagatcacatttaccctttcacagaattccaagagggtcttacaggaacccatgatttgcagggtttttgctcttgccaaaaaagtgtttctagagaaaatcaacaaaaagattgaaaagtccctgggggagtgagggtacaccccacaggatgggtacctctgtaaaggggtctgccatgggtctgcgtagggagtcagtcctcctctctctccagtgaatggcacggtgccagtgaagaaggaaaagggggcggctgcactctcaagcttctcttctaacaccaagctttctttcctactttagcttgagaccaacaaaaagtggagaacttagggtagtgtgggaccaggtccctggtgagctgggttctagttccagctctacttcttatccccaggttctaccaaagagagagttttcctactctagtttgatttcttaaaatacaaatatgattaatacatttgcttaaaaccttcagtgtggtttcaccttgccctagaattaagttcagtatccttagtaggaacaaacagcaccttccacatctaatagctgctagatctctcctccaattctcttgtccaaacaagtggaatttttttcttccaaagcaacatgctgttctctctccttgtggctttgaaatgtactaatcctctccctagaggcctcagttttcacactttatctggcaaccttgaactcctctcagttttgatgccagcttcttcagggaactcttttcaattccctaggcttggttagacccctagatcagattatatgtttatttcctagcactcaaatgccttgtgtcagttgtttaaggtcagtctctcctactagaatattaagcatccatcagggcagggagctggtctgcctttttactactacgaccctagcaccaagcatcaaaaaatgaataacatgttcttttgttcattcattcattcaatatgttgtaagtagctgatcatacaatatatgaaaaatctcttccaaaaatataagatccaaatacttggaacattttctgaagaaaaatgcagtcaatataaatctagtcaacagtcctgaagccaaaactcaaaatgtgcatttataataaaggatgatactattatgattactatacatgacttcaaactggtttttatatctcattacttttataatcaaattattacattaatatatgtcactaataatatatatttgatctcagacaggtcattatatcttagtaccagaagggatcttagagagctcctaactccttgtatttttggggactatatcaaatttaaatattctagatcccataaatcattgacatttcacagaaattctaatattcctacaaacaatatctgaaagagttaagttagcaaacatcacaatgacttagtaagctgagttcatcaaacacgcaaatatgagtaaaacaatactctaccaacttctactgtaaacaaatggtgagaattacaattcaaatattttattaactaacattttttccctgaactttttcattgaattgcccaaatctttgaatgatacttcatatacttttacaaatatatacaaccataaagctgccattcagatcaatatatacattatctacacctcatacactgccttctgccccattgcgatgaacctctggccccactcccaccaaaggtagtcagcattctaaattctttcaccatacttgggcttttcttttttgaacttcatataaatacaatcataaaatatgtccttttttgtgtctagctatttttgttcaaaattatatgggttagattcatatatacttttgcatttaataataatttggtctttttcattactgtatagtattccattgactatatctgccacaccatgctactattgatggacttgtggattgtttccaatttggggctactgggagtacaacttctgtgaaaagttttgtgttgtggtgcatacatttacacatttctgttggttataagcctatctatgaaattgctaagtcatagggtaggcttatgttcagctttggtagatattgcccaaaaggttttctttttttttaattttttttttttgagacagactcctgcactgttgcccgggctggagtgcaatggcccaaaaagttttcaaagtgattgcagtaatctactgtgccaatttacccacctaccagcagaatatgagagttccattgctctacaaccttttcaactcttgatattctaagtttttgttgtattatttactttttctttctttctttttttttttttgagatggagtctcgctctgtcacctaggctagagcgcaatggcatggtctcagctcactgcaacctctgcctcctgggttcaagcagttctcccacctcagccacccaagtagctggaactacaggcacatgccaccacacccagctaatttttgtatttttagtagagacggggtttcactatattggccaggctggtctcgaactcctgacctcgtgatcctcctgcctcggcctcccaaagtgctatgattacaggcgtgatccacgtgcccggcctgtattatttactttttaactgttctggtgtagaagtaccttcttatagttttcatttgtattttgtattttcctaataaataatgatgttgagcattttttcatatgtttattagccatctagacattctctttattaataaagctttgagaagaaaacatagactatcatcattaccttgggacaggcaaagatttcttttttttcttttaagcaatgagatctcactatgttccctaggctggagtgcagtggctatacacaggtgtaatcatagcacactacagccttaaacctctaggctctatcaatcctcctgtctcaacctccagagttgctgggactacaggcagatgccactgcacctggaaaacacttcttaaatagaacacacacacacacacacacacacacacatatacctatccataaagaaaagagtgataatgtagacttccattaaaatgtaaacattctgagccaggcacagtggctcacacctgtaatcccagcactttgggaggttgacacaggagaattgcctgagtccaggggtttgagaccagcctgggcagcatggcaaaaccccgtctctacaaaaaaattaaaaattagcctggtgtagcagagtgcacctgtagtcccagctaattcggaggctgaggtggaaggaacacttgaacccaggaggtaaggctgcagtgagccaagatcataccattgcactccagcctgggtgacagagtaaaaccctgtctcaaacaaacaaacaaaaaataagtaaatattctgttaatcaaaggacaccattaaaagaataaaaaaggctgggtgcggtggctcacacctgtaatcctagctttggaaagccaaggtagatggatcgcttgagcctaggagtgcgagaccagactgggcaatatagtgagaccccatctctacaaaaaataaaataaaaaattagccaggcctggtggcatgttcctgtagtcccagctacttgggaggctgaggcgggaggattgcttaagcccgggaggcggaggttgcagtgaactgagatcgcgccactgcactccagcctggatgagagtgagacactgtctcaataaataaataaataagcaagccactaagtgagataatgtatttggaatcataaccaatattcttaaagaactcttggaaattagtaagaaaaaaaaaagatagctcagtgtgaaagtgggcaataaaacttgaattaaaccttcctttctgtatttatttattctgagatggagtctcactctgtcgcccaggccggagtgcagtggcacaatcttggctcactgcaacctccacctcctgggttcaagcaattctcctgcctcagcctcccgagtaacggattacaggcacgcaccaccacatccggctaattttttgtgttttcagtagagatggggtttcaccctgttggccaggctggtcttgaactcctgacctcaagtgatccacctgcctcggcctcccaaagtgctgcaattacaggtatgagccatcactcctggcctatttttattattttagagatggaagtctcactatgttgtccaggctggtctcgagctcctgagctcaagtcatcctcccgcctcagcctctcaaaagtgctaggattacaggcgtgagccaccacaacaggcctttatatatttatttatttatttatttgtgacagatgcgagccaatgtgcctggtgaattaaaccttctttatcataaagcattacaaacactgaagtatttttgactacacttgtttcttttgtctatctttaataaagataattcattcatgcagtttcaatgttttatatctttgcacaactttctatataaataaaatcacaaatcaggataaaaacaattcttttgagccgtagtttgtcctctttggagtttggaaaatatacccacaataattactccatctagtctagctccccattcgcctgagcctttatctgacaaatgaactcccggttctcaggatttccaaatgttccaataaaaacatggaaaggaatgattccctctctgtcttcaaggatgaggcagatattcttgttcagataaagcctcccagcctccaggcacctaggcaaagtaaaaaaactcatctttcttcatctcttctgggactgtctcagaaagctggattttttccccatgcaaattcctcctcccccacactaccacattctttgaaaatcaaaaagtccaagagtagagttaggcatgggtggcacacacttgtaatcccagctatgtggaggctgaggagggaggattacttaagaaaaagcaaaaaaaaaaaaaaaaaaattgagttgagttatagttttaccaagtctttgtgaatacagaatacttaaagtggcaaagccagcctggaaaacatgggagagacatagacccaggtagatactgaatgcttaccagatgtcaggcagtatactagtataccagatgtcaggcagtagactagataagtatgtcactactctcaaggggcttatagtttagtatgaatgatcaataataacagccagaataaaatcttcatttatgtagtgcttacactgtgcaagacattgtgcaaagcatttgaacatatatttttaatatataatatatacagtatattatatatggctttaacacattttttcatatttttaataactttaatcttcacagcacatttaggaagaagatattgtttttaatcccctttttgatcagtatattgagaggttaagtaacttggccaaggtcaagtagtaagaattcagactaagagttgaaactaacacaattagaagcgggtaataacaagtgcatagattagacagccagaatgtacataaaagcgtgctaggaacacaaaagagggacgacctttagcccagcctggacaagtccaaatcttcctggaggaggtgatatttgagccacactgaatggtgggtggattaggaagtcaggcaagggggagggcattccaggcaggaatttcagcaccctgggagaagcagaggtgtgagacaacaaaccagtgtggctgtggatacatgtgggagacaaaagcagaggcgtgggagggcaacaccacaaggcgcttcataggccggcaaaggagtgtgaagatttgggccttatcccgaaagcagcaagagtccccaggaggattttaagtagggaactgcctaagtcagatttggatgatgctagagatgatctgcaaagtgggaggtggtgaagaagcagggtaggaagcctgggaagccaggggaaagaactattagggaactaaaaacgtgtctacttacctcagaaccatacgccaccaccatctgtggccaaggcagcctcaccctagtttctgacctcacaaacagcagaggtcatctcccttcccctcccaattcatggcatccagccttcttcaccctgcactaaatactttttcctctacgggactgttaactttagccttttttaaaacagctttattgaaatacgattcgcatgccatacaactcaacatttgaagtattcaattcaatagcttttagtatattcacagagttgtgtatccatcaccacgatcacttttagaatattttcattatctccaaaataaacttcctaccctttagccaccatcctccaactcccccattcccctcagccctaggcagccactactctactttctgcctctacagatttgtctattgcggacattttatataaatgtaactatacaatatgaggtccttagtgactggcttctgtcactttgcataatgtttccaaggttcatccatgttattgcatgtatcagtattttattcctttttcttgttgaataatattctactgtatgaatataccacattttatatatcttttaatcagttgatagactaagccttggtttttaaaccaaccactgtcaaaaaggatgggtttgccatggttggcttttgtaatcctcctccatccttatagcttcagtgccagttcctccaactgaagtagtgactcacacaaaaggacagacatgtggatgctaatgtttcctacactagattataaaccccatgagggaaggacatttgggcatcgtgcaagtgaggcatggtagacagcaaagagcttaagctttggttatatatatatctctatacacacacaaacatatatatacatatatacacacatacatacacacacacatatatatatgtatatgtatatatagagagagacagaaagagggagaaaagctcactctgccacccaggctggagtgcaatggcaccatcatagctcactgcagccttgaactcctgagttcaagggaaccttccacctcagcctcctgagtagctgggactacatgtgtgtgccactatgctcagctaatttgtttttattgttttgcagagatgaggtctcactatgtcgcccaggctggtctcaaagtcctgagctcaagtgatcctccttccttggtctcccaaagtgctaggattataagcataagccaaagctcttggccagcacctacaatttggaatcaaagaatcctggatgtggatttcagctaaacaactatcggatatgcagcttcttaggtcccttgctgtaaagtgtgaataataatacagggtgattgagcactagtggttctgtaggtaaagtgtactttgtaaattgtacctattattattaatattactattttttttttttttgagatggagtctcactcactgtgttgcccaggctagagtgcagtggcgcgatctcagctcactgtaacctctgtctcctgggctcaagcaattttcctgcctcagtctcccaagtagttgggattacaggcatgcaccaccatgcctggctaatttttgtattttcagtagagacggggttttaccatgttggccaggctggtctcgaactcctggcctcaagtgatctgcccacctcagccccccaaagtgctgggattacagatatgagccagagcccagccaattgtagctattattgctcttattattatacagaccctttatgatttggcctctacctactactttgggctcacctcctgtcaaatctccccttgccttaaactttatactccatcaatatcaaactgctcattttttttgtttgtttgtgtttttttttttttttttttttttttttgagacggagtctcgctctgtcgcccaggctggagtgcagtggcacgatctccgctcactgcaaactctgcctcccgggttcgcaccattctcctgcctcagcctcccaagtagctgggaccacaggcacccgccaccacgccgggctaattttttgtgtttttagtagagacggggtttcaccgtgttagccaggatggtctcgatctcctgacctcgtgatacgcccaccttggcctcccaaagtgctgggattacaggtgtgagccaccgcgcccgaccatattttttagttaaatgttatttggtttcacgcacccataccttttacatgaagtctgaaatgcctaaaacaccacacctcccctgcttgtcatgggaattccattccctttgttttgtttgttggtttgttttttatgagatggtgtctggctatgttgcccaccctggagtacaatggccattcgcaggcaccatcattgcacattacatgctctaactcttgggctcaagcaatcctcctacctcagcctcccaaatagctgggactataggcatgcacctctgcacctggtcccatctgtgtttcacaacccatcctaggcatcagcttctgaaggaagactttcttcctattctatctcctggtcagtccttctgctgtgctttctctatgtcttgcatctagtacgtgcttctattcatgtacttatccctctgactacatcatacagtgtgtttctctgattgtttacctgtcttctggattatgagtctctttggggcagaggctgtacctatagcacatggcccagtgcctagaatatagtaaaagatcaatatatttccactgaacaaatgatataacagagagcagaagtctaaatagcccctaggtttttgatagtaccagtctctaagactggaacaaaggacagctggtttaggaattaaattcacccaatgaaagtctagcaggcagtttaatacgtgtgtctgaaaatcagatgacagataaggacctcatatgcactttggagagctaatcccaccgttttcaaatccatgtctacatggaaactgaagtcatgattttggttatcaatgccccaaaactgtgaatagagtgagtaaaggaggaaactaaggacttccaggaatacccatttcaaagggcagccaaaggaggtgaagattaaaagataatcagccagaaatacagaacaagaaccaaggaagagaggtgtccccaaaagccaaagaaaaacagaatttcaagagatgcggatgctccatagttacaagtggatttggaggtcatcaggaatttagtggaagcgatttcagcaaaatatcaggggattggggtggttgggattgcagatggctatggaaaagagaaaaaaggaggaaaaggaggattcacctacctgatcactcagaaaaagcctctcttccctgctaacagattttaaggctgtatttgtagcttcccaaaggacagtcagctcctctagaagtccatggcaagaacaacttcatggtggactttttgcttccaggagatcaaataattttccagtgtgattgatgcctctcctcacttcaactcagaagaatagtcttcagtttatgtaaattgaatcccacagatggagtggcatcttcaaagcacgtaacagatggatggtacctgaaccctaattccagaccctctcagaggtccctggaaaaaaaaaacaaaaacgcaatgtgcgtatattttgccataaactagatgaaatccaaaaaatggttaaggaggaagagctaggcctaattgatcttaaaagcctcagtggtctctagggtagataggtgccaaagtgagaacataggaatcatttaccacaggtgctggtttctacaatcttaatatgtcatacatgtaagccttttctctacagttaggctatgagagccttggagagaatgggcatccccaaagtactagacatgcagtaggaacttattagacaatagaatgtttagacaaaggaatgaccttagagaccatctggctcagctgtgccaaatcatcctttgtaagtgttttcttgttgacttgtcaggctttgccactcaattataaattcttctaggggagatccctaacttgtctatctttcctttggcagtgcccagcaagcaaagggtttggccgtaaaaggtgctcactaaatttttttaaaaagtatttcatctatatactaccactagatgtttgatgaatggagaaatgcactcataaaatctccaaagcatgaaatgaagcaatgaggaagccttccttccagatactggatttaatgtcacttcctgaaagaggtctttactgagtgggtacgcactttaattgttccacagaacttctcagcttacctgtgcttcgtttgttttgtattatttatttatttattttttgtagagactgggtcttgctgtgttgcccaagctggtcttgaactcctgggctcaagtgatcctcccacctcagcctcccaagtagctgtgactacaggcaccaaccaccatgtctggctcttgtttatttttcaattgtctgcccttctactagaatgtaaatttccagaagttggggatcttgcatatcttgtttaacactgtagtcaatttacagccctagcaagcctggggcatagcaggaacttaacatttgtggaatgaatgaatggctgaatgagtaagtggagctgaaagtaggttagaatggaagactcagatccagtgaagggagcaaagccatgggccaggtcctcctgcctagggctcttttgtccccagaactagtcacctccaagccttatctccttctcccctcacccactctcccatcccacagcaatgggggcagggcctctggcttcagagcttattaaagtctccatagataagtaaattctgttgggttgaattgtgccccaggctaccaagattaattaggtgagcccagctaatgagttaactgagtttttacttttccctcatttgaagttttaatccccttctgtctccagaagcccttaaaaggagagctaggaaaaaaatcattagggtgtttcaagtccccacagtgatttcccttacaacaccatgctttgactacaagttctgcaattgctcctccacacaagcagaaaggtttttaggtttgtttttaggtggactggtggatgagaagacttcccctccagcttcctagtccacatgatgccagagagtcgcagcaggactgggtgagaccaggttctggcgaccttctgccttgtttacttaatttactgcttgtgtcaagacggttctgggaaagttgcttatgtcacctcctaagagtaagggaaaatctctggctgctgaagctgcttatccctactgtggccgttccgggttacccacttcttcctaatcccaatttgccttccttgtctagctgctaggggctagatggctcaagggatttcttttgttgatattgctgttggtgagattgcattttgctttgtctttctcctaactcaaaacagatggaacagggaaataaagaatggttgataatcctagtcacttatctttggtaaatttcaaagggtaagtggaggcaaataaacaatcattcagtaaacaagtatagttgttttttttttttttttgagacagagtttggctctgtcacccagactggagtgcagtggtgccatctcggttgaccacaacctccacctcccaggttcaaaccatcctcccaagtaggtgggactacaggcgcatgccaccatgcctggctaatttttttttttttttgtatttttggcagagacagggtttccccatgttgcctaggctggtctcgaactcctgggctcaagcaatcctcctgcctcagcctcccaaagtgctgggattacaggtatgaaccaccatgcccgaacacaagtacagtatttaatgcacattaaggagggcttaaaatgatccatattaggctgggcatagtagctcatgcctataatcccagaactttgggaggcccaggcaggtggattgcttgaagtcaggagttcaagaccagcctgggtaacatggtgaaaccctgtctctagaaaaaattttaaaattagccgggtgtgatggtacacacctgtggtcccagctactcaggaggctgaggtggcaggatctcttgagcctgggaggttgaggctgctgtaagctgtgattgggacactgcactgcactccagcctaggcaacagagtgactccctattaaaaaaagaaagaaagaagcagaagcagaagaagagaagaagaagaggtagaggaagaggaggaagaagaggaagaagaagaggaagaggaagaagaaaagaagaagaaagaagaagaagaaaagaagaagaagaagaaaagaagaagaaaagaagaagaaaagaagaagaaaagaagaagaagaagaagaagaagaagaagaagaagaagaagaagaagaagaagaagaagaagaagaagaagaggaagaagaagaagaggaaaagaaaggagaaggagaaggagaagaaggagaaggagaagaagaaaaagaagacgacaaacaaaaaaccgaaatgcttggccagaaatagagtggaggccatgtgactggagcagtgtggctgtgggagagaggaatgagaagacttaaaagaggtgagcaggagccagaacaccggggactctgtaggccatggtaggtggcttgatggaattccaggaacaaaggagagtggcccaagggatgccagcaggaaagccttgtgatctaatttgcaattgcaaaagatttccctgtcttctacatggagaatgaattagaatgcagcaagagaagatacacagaaactagtcagaggaggtattggggttgaccaggtgagagatggcagaggcttggctagggtgatgatagtgaaggtagggagatgtgaatgacatcaaggacatgatctgaaagtgggactgacagggcctgctaatagattatgaagagtaagaaggagagagaaatcaagaatgctgtctttgattctgtcccgaacacatgcatctctactcccttctccatccctaaccccttcctctgtcatccacatcccaagagtttccagtctccctgagtctttggtcagaaaaccaattttcctgggcattggacaaaaatttgtctccaggatttcaaaccagcagatatatctcttctccttctgcctgggactgtggactcctgaaatctgtaagtattttgcaagttctcttaccaggaccacattcttgagaagagggttcctgtgactctgggccaaagaagtgctgagaaggtagtcctcttcaaatcactcacagccctaaacaggtgaatcagcctcgactggcatgtgaatttgtcccactgattgaaagagtagaaatttatgctagtggcaggtgccaaccaacagtagattcaacataagaattcagaaaggcaaacctatgtgcatgtcattataaaaacaactgtgacaacaaaaggcaccagtccaatttaagacataagctcctaaggaacaaatttcctaacaagacttccttgtttgctctatgcaaatgttgaggcttattgcacatttgacacaaagactagactttatgtgaaaattcacacaaacatttcaattgcctagtggcttgaaaactaaaggagaggtctgttgtgtatgtgtggggtgagggtgtggcagtgaactggggcaacaggcagaccgtacaaaaaagagggtggatttaatggtggcaaatgcctgatcctaaccctttctccctgcccccagggtgaaggataatatgagccttgccattcagcaactacactagaatagaattaatagcacttgtgctgcccagaaagccattctctgaacagatggcatttcccagaaggactaaagcctaacaagcctgagcttaaatcctggaattggctggctcacaataactatgaaggaagaaaaatcccctgtttggtttggctttcagtctctcctaggccaggaatcaacgcttcatgaactgaggagatggaaagatagagcctctaatgtataccagatcgggccacaaaaccttctcagcaatgggcatacatcctaggcctggctctctataaatatccgatggctccttgggaaggaagctggactgtctctccagttcaggcccatttccttttctgacactttccaatgccttcactggagggctgccatgtagcctaaatgctggaataccatgacctgaagcctgtctccaaagagactctcagaggaagggaatgtcatctcctcatcaaatccaatatattaagaaatggcagggagaatctcagtgaagatggatgtagggagaaaggttatgaaaaagagaagtcaacagctgagttcaaaccaattcagaccctctttggacaaccagtgggacttcagacactcacctgggaacctgatggtatctcattgctaaccttacatgactcactttccaagtgatgtccatgcccttcaccaacatcttttaagtgtcatttacttgtgttttgggaccaaagtgttacaactacatcttcatatttaattgaaaaggtttatttttttctaaatcagaactggcctttcagtcaatggcgtgacaacttccctaaaactagtaaggacaagaaaaaaaattttttttaagagacagtgttgacaaagagactctgtctcaaaagaaaacaacaacaataacaacaaaccaaagagacaggatctcactctgtcgcccaggctagagtgcagtggtgtgatcacaactcactgtagcctcgaactcccagactcaagcgatcctccctcctcagcctcttaagtagctaggactacaggtacacattcccatgcccagcaaatattttatttttggcggggagagatggggtctcactaggctgcccaggctggtcttgtactcctgggctcaagcgatcctgtcactgtggcctcccaaagtgctgggattacaggcgtgagcagccacagcaccggacagaaaatttgattttaaatttaattttttttttttagagactgggtcccattctgtcacccaagctggagtatagtggcactgtcatatagttcactgcaccctagactacctaggctcaagagatcctcccacctcagcctcgaaaatgctgaggggcgtgagtctccactcccagctaaaacagaaaattctaataggctggagccccacagcattctgataatatcgtatgcacataacaggtgtaatctgagtcaggctgtcggatctaatctcgtgcctggagagcagagatctagaaatcatgtcttagatttgaatttcacctttgccattgagttgtaggactttattttctttgttttatttattttttgttttctttgagttgtaagacttttgacaggtcaccccttctttttactgcccactcacatagatgaatttagaacaaccagttcgaaaacaggtacgatggccaggtgcagtggctcacacctgtaatcccagcactttgggaggctgaggcgaatggatcacttgaggtcacgagttcgagaacagcctgccaacatggtgaaacaccatctctactaaaaatacaaaaattagccaggcatggtggtgtgcgcctatagtcccagctactcgggaggctgaggcacgagaacctgtagaacctggatggcaggggctgcagtgagccgagattgcaccactgcactccaacctggtgacagacagactccgtctcaaaaaaaaggtatggcaggggaggcaacaacaacaaaaaaatagacacaattctagttacctaacactgcatcattctgtgagtgtcttaaggattgcagatgggggtttgtgtaaatcacttgcatttgaataaaacagatatgcacatatgaaaaattcacttagcaataagcaaagatttaatctctgatacaattttgaacaatatcctgacagttcacaaatctttttttttttttttttttttttgaggcggagtctcgctctgtcgcccaggctggagtgcagtggcgggatctcggctcactgcaagctccgcctcccgggttcatgccattctcctgcctcagcctcccaggtagctgggactacaggcgcccgccactacgcccggctaattttttgtatttttagtagagacggggtttcaccgttttagccgggatggtctcgatctcctgacctcgtgattcgcccgcctcggcctcccaaagtgctgggattacaggcgtgagccaccgcgcccggcccacaaatcttaaaaattcactggtacatcttggtggtctgtttttctgagtctttcagatcattcagtcttgcacaagcagcagctgcaatctaccgggagggagattctgcaatgggaaaccacattgctcatgctgggcaaacagacctgtcatttctagagacctggaatgatcctgcctgcctggctgcaaggcagggaggaaagcagcattcatctattcaatagcctggtggataaaacaaccccattgccaggtgtggcggctcacgcctgtaatcccaacactttgggaggcagaggtgggcagatcacctgaggtcaggagttcaagaccagcctggccaacatggtgaaacccccatctctactaaaaatacaaaaattagctgggcatcgtggtgggtgcctgtaatcccagctacttgtgaggctgaggcaggagaattgcttgaacccaggagacggaggttgcagtgagccgacatgatgccactgcactccagcctgggcaacagaatgagactctgtctcaaaacaaacaaacaaacaaacaaaaaaaaccattgaagtggaggtttggaggacttagagacttaactatcctttaaattataactgagaagttaaattgggtatgtttttagagaaatttgactttctcagaaggaaagtgaaaaatataaaatccagagagaaatacaaagtatagtcagatcagtaattcttagcttattttttttttttgcagtctgtcctaaggtgacattttgtgtgttatttgtttattgtttatcatttagttctctcactagaatgtaagtgctatgagggtaggaacatgtgtattttatttccatatttccattacattacctggccctagtagagtgccttccataaaataagcattcaaaaaaaaattgttgaatgaatgaataatgaatgaatgattcagactttttcacgtcctagacccctttttaaaaaatcagtggaagtggctgggcacggtggctcatgcctgttatcccagcactttgggaggccaaggcaggtggatcacctgaggtcagcagttcaaggccagcctgaccaacgtggtgaaacactgtctctattaaaaatacaaaaattagctgggcatgatggtgggcgcctgtaattccagctactcaagaggctgaggcaggagaatcgcttgaacccgggaggtggaggttgcagtgagctgagattgtgccactgtactccaacctggccgacagagggagactccatctcaaaaaaaaaaaaaatcggtggaagttatgattcttaccttatccccaaaatacatatattcaaaaatgtaaaatatatgttattatattacataatttatacatatataattacaatacatattattacatttttatatctatctatctatctatctctaattgaatcttctcatgcaaaggtcccagtttgcaaaagacattcctgcttcaccaatggtatctgttatccctaaaaagcacataaacaaaagctctgctgtcattctccttggaaaaaatccttttttttttttggtagagactgggtttccctctgttgcccaggcttgtctcaaagtcctggcttcaagcaatcccccagccttgacttaccaaaataggattacaggcatgagccaccacgccccagcccagaggagcaattctgaagaggcttaagactgggacttttgggtcttctgactcccaggataaaacatctgacattggctcttagagacatatgaaaggtcctgggtcattccagacatgtgaccagtaaaaggagcccttcggtgaaagggaagagaaaaaaaactctaaatttggactcagaaaacttgagttctaactcagctcttgtgccatactggctgtagaatcatagctaggtaatggacttctctgagcctcagtttcctcatgtgaatgaagaggtctggcctaggcccagcattccacattacagtatcataacttctaaaccaggcaaatgaaggagcgacagagcttcagatgaaacaggatgttactatgtagttaaaatgtccattttgtagcagtgctcccttgctatgaaaagagagcatgacttatgctgaagcacaagaaactttaagtaagataacagaaaggactctcaataatataaggactgtgagacagagtcagacatgtgggtgcttgcagaatatccctcagaaggtgtagtgggatgagggccaacattcatctctcagatgatctgttctagtatttgctggaaaaagatcctcaagtccagttgcctccaaaatccacccactctttgggtcaggcatggtggctcacgcctgtaatcccagcactttgggaggccaaagtgggaggatcacctgacgccaggagtttaagaccagcctgggcaacatagtgtgatcccatctgtagaaaatattacagctttttaaaaaaattttaaatctgcccactctctgaccctaggaatatccctaggcttacgttttccacaaataagattttattttattatttgagacggcgtctcactctgttgccctggctggagtgcaatggtgcaatcttggctcactgcaacctctgcctctcgggttcaagtgattctcctgcctcagcgtcctcagtagctgggattacaggtgtgcatcaccacgcctggctaattcttgtgtttttcgtagaaatggggtgtcaccatgttggccaggctggtctcgaactcctgacctcaagtggtccgcccgcatcagcctcctaaagtgctgggattacaggcgtgagccattgcgcctggccaccacaaataagactttaagtgaaaaatttctacatttattctaatgctttgggaaaaagtattgattgccgtggggtattttcttctagtcagttctttcacacaaagaaatctagacgaaagcgacattgattgggcacctccccggcagttctttccatgggccatcttgtttaattctagagcaaccctgaagggcacttatttcctaccaattttacagataaggaaactgagactcagacaagtcaagtcactttctgcgaacaagctaggaaatggggccagaatttaactccaggtctttctggagtggaagctctttccacacacctggttgccaccagggaggagctaagtggtgtttaggcagccaaggggtttctgggcctcaagtggtgctgtgcaccatgcacagttcactcactcttctccccgcaggccagtgtacactgcagatgctgggtctggagccttctccactcctttcctgagttactatctctgagcgtttcccttacaatgaacttttagactccagcacataatcagaattaaaacagaggtcaaggtggggcatggtggctcatgcctgtaatcccagcactttgggaggccaaggccggcagatcacctgaggtcaggagttcaagaccagcctggccaacatagtaaaaccccatctctactaaaaatacaaaaattagccaggcgtggtggcacacgcctatagtcccagctactagggacgctgaggcaggatcgcttgaacccaggaggtagaggttgcagtgagccaagatcatgccactctacttccagctgggcaacaatgcgagactcagtttaaaaaacaaaacaaaacaaaaaaagaaattaataataaataaaataaaacagaggtcaagagataaatgactttctggagacaggtaagaattacaggtaatgggagaactccaaggctttctatcccgggaaaagattgggaaaagtcccagggagaagggaaaggggaaaagctgagggatagggaagcagtctatgctgggattcaaagatgctcattggttctgtttttttgttcttttttttttttttttttttttgagatggagtttcactcttgttgcccaggctggagtgcagtggcacgatcttggctcactccaacctccgcctctgaggttcaagtgattctcctgtctcagcctcccgagtagctggaattacaggcacccaccaccacgcccggcttatttttgtatttttagtagagacagggtttcatcgtgttggccaggctgatctcgaactcttgacctcaggtgatctgcccacctcagcctcccaaagcgctgggattacaggcatgaaccgctgcgtccagtcactactctttggttcttagagtggcaagggttctccatcacccccagccccatcactatggcctttctttgcctgacttacatctcctcatccttccagaggcattcatctcaaaaggcatcttttctagacatcctcctgttaggaccggggcccttctctgggatcctataggagccagtgcacatcttaacatttaccagattataataaaataatgttaatgaatctctctgcctcagtggaccatcctgaggataactctcttttatccatgtctgcacccctggcacctggtacagtacctgacaactaagaggggttcgagcaatgtttatcgaatactcaagatacagaagctctgagagaaatggggacctcaggacaatgggagaatggagacctggaagtgagatctgtggagagtgggtactactctgtcaggacctgttccaatgcctggtggatgttgcacagtctagctggatggtgcaaagcttctaacactgctgggagtggttccacttcaaacaattctagtttagaaagtttcttctggagttgggccaaaatgtaagccccactaacctttacatgtagactctcacctaggatcccttttgtatagatactacaggtcctgtatagaaatgtcctagctggagagctgtgccctatttctaggcatctggtgatgctaaagaggcagaatgaggtcaagtttgtgttagaggctttctgagctgtcattacagagctgcgcatagtcccagcctgcatcctgctctgtgtgacctccagaacaccaggtgaccctgagccataacttcttcctctgtgaatagggatgctgacattttcttcctgactgtgtcgtgtgaggatgaaaagtgaggatgtgagtaaagcctcacctggccttggtcaaatctcagtgaaaggtatctattgaattattattgaaatattattattgatatggtttgaatctgtatttcccacccaaatctcatgttcaattgtaatccccagtgttggagatggggcctggtgggaggtgattgggacatgggggcagtttttcatgaatggtgtagcaccatccccttggagctgttctggtgatagtgagtgaggtatcctgaaatctgtttgtttagaggtgtgtggcatccccggcccactctctcttcctcctgctctagccatgtaagacatgcctgctttccctttgccttctgccatgattataagttccctgaggcctccccagaagcagcctctacattttctgtacagccagcagaaccctaagccaactaaatctcttttctttataaattacccagtctcgggtgtttgtttgtttgtttgtttgtgacagagtattgctctgtcacccacgctggagtgcaatggcatgatctcggctcactgcaacctccacctcccaggttcaagcaattctcctgcctcagcctcccgagtagttgggattacaggcgcctgccaccatgcccggctaatttttgtatttttagtagagatggggttttgccatgttcatcaggctggtctcgaactcctgacctcagcggatccacccacctcagcctcccaaagtactgggattacaggtgtgagccaccgcgtccagcccagtctcaagtatttctttatagctattcgagaactaatacaattattattccaataacaagactcagcaactcatttagtaaattcaacagctactttagataaaattcttcatgagcagaaatcttcctttgcttaagccactacttaacttatattaccagatttttgcaagatggtgcccaggattaagaacgtagttcaggccaggtacagtggctcacacctgtaataccagcactttggcaggccgaggcaggcggatcacctgaggtcaggagttcaagaccagccttgtcaaaacggtgaaactccatctctactaaaaatacaaaaattagccaggcatggtggtgcatgcctgtaatcctagctactcggaaggctgaggcatgagaatcacttgaacctgggaggcagaggtttcagtgagccaagactgcaccactgcactccagcctggacgacagaacgagactccatctcaaaaaaaaaaaaaaacaaaaacaaaaaaaaccacagttcaacaattatttagcccactctcagagacaaatcctatatgctagactctagtaatatagagataaaagtagctcatagtccagcagtgggaatagtcacagaaagaaatattaaaatttttgattagtgctcacttcagcagcacatatactaaaattggaactatacagagactattagcatggccccttcaccaggatggcacaccaattcgtgaagagttctttgtttctttttcttttttttttaagagacagtctcgcgctgttgttcagactggagtgcagtgtcacaatcacagttcattgtaaactcaacattccatatttttttaagatttttttaaaaattgttgatcatcgaggaaagatggatcactcataaatagtgctgggacaatggaggacccaccaacatattgcacacaagcagaaatactaggcagattaaagacttaaatatggccaggctcagtggctcacgcctgtaattccagcactttgggtggctgaagcgggtggatcacctgaggtcaggaattcgaaaccagcctggccaacatggtaaaaccccacctttactaaaaatacaaaaaaattagctgggtgtggtagcaggtgcctgtaatcccagctactcaggaggttgaggcaggagaatcacttgaacctgggaagcagaggttgcaatgagccaagatcatgccactgcactccagcctgggcaacagagtaagactctgtctcaaaaacaaacaaacaaaaaaaagacttaaatataaaaagtaaaaaaataaaataaataataatgaaataagagaacacgtctatattcacagagtagggaaaaaaaatttatttttgttgaggtagggtctcattctgtcacccaggctggagtgcagtggcatgatcttggctcactaccacttctgcctcccagatgcaatcgattatcatgcctcagcctcctgagtagctgggattacaggtgtgcgccaccacgcccagctaatttttttgtgtttttagtagagacagggtttcactatgttggtcaggctggtctttaactcctggcctcaagtgatctgcccacctcagcctcccaaagtgctggaattacagggtgtgagccaccatgcccggccaagtttcttaaacaagacacaaaagtactaactataaaggaaaacatttgcttgaggccaggagttcaagaccagcccgggcaatgtaggaagaccccgtatctacaaaacacaaaaaattagctgggcatggtgatgcgcacctatggtcccagctactcaggaggctgaggtgggaggattgtttgaacctgggaggtggaggctagagtgaggtgatatcgtgcccctggattccaggctaggcaacaaagccagagcccatctcaaaataaatacatagataataaaggaaaatactgattaatttgactatccttaattgaagaatatgtgtttatcaaaagatcccgtaaagaaagtgaaatggctccttcccgacctggtggagcaggaggcgccatcgtgggagtcaacatccaccacagcaaggacagaaaggttgggtgcagggagcccaagagctggacatctacctacggctgttggtcaagctgtccaccttcagccaggttatactgaagaggctttttgtgaatcgcaccaaccagccacctctgatcctgaccggaaaatgaagcttccaggcccggaaaacaaaacggctgtggtttcaggcccacagctgcggctgtgtgggttcaggaggtgcccagagtaaagcctcgcactgcgtgtgagcggccagggcccagccgcatccccacggctggggcaagatccgtacctttgagcagctggccctggactcccgcaagagctgtggcaccatcttgctttttggccctcgaaagggcccatagggacactggcatttaccccgggaaccccacacagctacaccaaaccctacgtgggttccaagggccgaaattttcactgtgccagggccccatgggccagccgcactataaaaacgaaccctgatcctactctcttattaaaaacattttggatgctctattagttcgttttaccccgctaataaagacatacccgggactgggcaatttacaaaagaaagaggtttattggacttacagttccacgtggctggggaggcctcaccatcatggtggaaggtggaaggcatatctcacatggtggtggacaagagaagagagcttgtgcagagaaactcccctttttaaaaccatcagatctcgtgagatttattcactatcacaagaacagcaagggaaagacccccccgcccacccatgattcaattatctcccaccaggtccctcccacaacacgtgggaattcaagatgagaactgggtgagggcacagccaaaccatatcagatgctgaaagaaagaaaaaaaaaaaaagaaaagaaaatgaaaaggctagacacaaactggaagaagatacttgccacacacataaccaatgaagtagtagaatctggaatacacaaagggctcagaacaaaaaaaaaaaaaaaaaaaaaaaaaaaaagaaagacactgagggatgggactgagggatgggactgaagggtttacagaaggccctagatgaagaggttcccactagagagtcatcagccgtggaacagagcaacactgtggcctacaaagggactaaatttagcaacttggtctcattcattgtgaatacagatgtcagataagatataggatgaccaggaaatttgaatatcaaacaaagaataattttttttttagttttaagtatgtcccatgtaatattttggacatagttatgctaaaaatgtttgagacacacgaactaaaaaattatttgttgtctatctgaaatttgactgtactgggtaccctgtatttttatttgccaagcctggcaaccctaattatgaacttcttgttaatttcaaagaaaatgtcttttggcttgtaagtcaaaacgaattatacagcacataaaaagaaccattttataatagtaagactttcttgcaaatggcagagcagaataataccagaaaagttggaggtacaggagcttggaatggtggtgtgcacctatagttccagctactggggaggctgaggcaggaggaccacttgaacccaggagttcaagacaagccaggacaatagagacagacccccatctcaaaaaaaaaaaaaaaggttgaggtgtgaaaccagtcaaactttagtttgaaccccagctctgccacttgctaagtctagagtaacttactaacctttttatgtgttgctctctttataaataaagtgcctaccttcatggggctgttgtagtaaatgaggtaagatgtgttgtaagtgcttggcatggtgccaggcacaacatgatgtgctcttgatagtactaatcactcttacccatgcactggggtttcttaaaactaaatgctagaatagatacatagcatcttggtgaccaagaatgcatcctcatttctggaatatttaagacaaagtcagaggcagaggctccccacccctggcccctcccatccctcactgctccagattcccttattgctcaagagctagaaggcataaaagggacaagatgacctccaagatcctcccaaccctaggatttgatggtccttattttctgagtaacattaggttcctaatggcggtcactcttagtggctatgactgagggaggtgtcaaattatgttctacagtgtgagttcagttatggggattactctgaggctgtaaaacatgtatttatatttctgctctggaaaatacaatgtcctattctttctaagtcttattcatagctcaaattgtcactgaggatccagagaaaacaacatgcataattagttgcgggcctggccaagatctcagagactccaagagcaacacactctttaacgtacagaactctctctctctatcctttttctttttttcttcctgccctccctatcactctacccctatatgctacatgaaagattatttttgttaatgtagtcacaggtccaactaacaggcaattactgtcaaaacacattaattttaagaatgtgaggccaggtgtggtggctcacacctctaatcccagcactttgggaagccaagggggggcggatcacttgagcccaggagttgaagaccagcctcagcaacatggctaaaccccactctacaaaaattatccgggtatggtggcacacacctgtagtcccagctactcgggaggctgaggcacaagactcgcttaagcctgggaggcaaaggtttcagtgagccaagaacacatcactgccctccagcctgggcaacagagcgagactccgtctcaaaaacaaaaacaaacaaacaaaaagaatatgattgacaaataatgatgatattgccaatcagggggaaaaaaagtttacataataaaaaaaaagcctgtcaccagaataagaaataaagtatccaaaacagacattaccatactctgcatcagtggctccatagcataaaatgatctgaaactccttgaaggaggaactagatgggtaggtgttggtgcagctgcaggccctgaattacatggtggccattcttcagaagacaatttttcacagcatggcagagagacccagaatttaaactcagccgtcactcaggaggagtaaagaagtgacagaattgagagttggagctacacaggggcttccagtgatgtcagcatctggtgggttttcaccaggggggtaattgcacaccttgctcagtttcactctttctccattataggagcctcagacatttccgaactaatttggttgagtgctcagaaaagcatcaagctggccaggcgccgtggcacacgcctgtaatcccagcactttgggaggccgaggtgggtgcatcacctgaggtcaggagttcaagaccagcctggccaacatggtgaaaccccatctctactaaaaatacaaaaaaattagccaggcatggtggcgcatgcctgtaatcccagctactctggaggctgaggcaggagaattgctggaacgcaggaggcagaggttacagtgagccgagatcacgccattgcactccagcctgggcaacaagagtgaaactccttctcaaaaaataaaaaagaaaagcatcaagccggttttaggatagataatcagcctttctttgcaggccgaagtcctctcattcttactcagccagtcagcccacaaatataagcaagctcgccagatcctcagcacaccagaagataccccagctttacagcacaccagaagataacccagcttaatggttccaaatagtgtcacgtcaagtcatgctgcagagatcccatcagagctccagcagaactcatgaaattacataacaaataatgctctctcccttccagcctggagtagcagaaagaggtggagctgcgattaagagtcctgtgcaagagcttaactttgggcctccaccttcttataagaggtgagcaggataatccctgaggtccctcattgtttggacattctatggcgtgcactgcctcgtggaaaagaaagccctctcttcactcccagatgcagattctgatggctctctcaagtatgttaatattttgttatcgtttcctttttccttgggagaaaagaaggaaggacagagagagaaaagcctttagaaatcaacaaaattaaaaccataaaacacaaagccatgctttttagagttgctcagctgctggggcaggaataaagcagctcctctgcaatgcaagaggctgtagaagaggcattctaaggccaggcgccgtggctcacgcctgtaatcccagcattttgggaggccgaggtgggcggatcacaaggtcaggacttggagaccagcctgggcaatatggtgaaaccttgtgtctactgaaaatacaaaaattagccaggcatggtggcacgtgcctgtagtcccagctactcgggaggttgaggcagaagaattgcttgaacccaggaggcggaggttgcagtgagccgagattgcagcactgcactccagcctgggtgacagagtaagactccgtctcaaaaaaataaaaataaaaaaaggggcattctatcccatggccatgactctgacctcacctggttatcaaatccaacttgtatattcaaagtgaaatgcaggatgccactgacaacatgcctggaggctcagaggtctccagtgagctagaaaacaagacaccacattcctccctgctcctgccccagaaagatttcctggcttctcagcctctgtttcctaatctaaaaccacctctggagtgtcacttggatgattaatgaaaacatcattcatttaccgaaaatgagtgttttgctaaaagaatataagatcctgaaaactgtttttttttttttttttttgagacggagtctcattctatcgcccaggctggagtacagtggcaggatctcagctcactgcaacctccaccttctgggttcaagcaattctcctgcctcagcttcccgagtagttgggcttacagatgtgcaccaccacgcccagctgatttttgtatttttagtagagatggtgtttcaccatgttggccaggctgttcttgaactcttaacctcaggtgatccactcgccttggcctcccaaagtgctgggattacaggtgtgagccactatgcttggctgaaaagcattttaagaaaaggcaggtcaggagatcgagaccatcctggctaacacggtgaaaccccatctctacttaaaatacaaaaaaattatccgggcgtggtggcgggtgcctgtagtcccagctactcaggaggctgaggcaggagaatggcatgaacctgggaagtggagcttgcagtgagccgagatcatgccactgcactccagcctgggcgacagtgagagactccctctcaaaaaaaaaaaaaggcagagcaatccttgccaattaaggaatgtttcagtgtccccctcttcccaccaactgtcagaagagaaaagaaagtttccctgaggggtttggggaggagtttccttcttgtttccatcactacagccagacaaactgtctccaaactgcctgtgatcactacagcaatgttaattattactggaaaatgaagagaaaaatcatttagccctgggatctaggtgaccatgggtgcaacattcaaatccgcttcagttcaaaaggattttcaggggaaaattccactgtctactccccaagccatcactttcctggctgcctatcactcacccccagagcttcctcctccactcaccctaactgcccaatcaaagagcaacctcaggtccccacccaggtagagacaacatcccatgtcacacacctcagggcagcttcacatctggaagggacgaaaactggaacggtcattccggatattgtctttcctgcctatctggggactaaggcaatgtgtgtgtgtgtgtgtgtgtgtgtgtgtgtgtgtgtgtgtgtgtgtgtgtgtatcagagtgtttttcatgtttacatgaagtttccatccaaaacaaaacaaaatttctcccattaaagagaaaaggtccccaaaggcagtgcttctctaaatatgtgcctcaggatatgtgatgagcaaaaatgctctttggttttatatcaaaagacagtttagggctcacgccttaatcccaacactttgggaggctaaggcggtggatcacttgagtccagcagttcgagaccagcctgggcagcatggcaagaccctgtttctacaaaaaataaaaaaaaaaatctcaactactcagaggttgaggtggaaggatcacctgagcctggggagattgaggctgcagtgagctgtgatcatgccactgcactccagcctgggtgacagagtgagatcctgtctcaaaaaagaaagaaaaaagaaagaaagagagaaaaagagagagagagaaagagacagaggaaggaaggaaggaaggaaggagggaaagaaggaaggaggagcttaacagcatttttctttttgagggactcactctgttgcccgagctgagtgctgtggcatgatcatggtttactgaagcctcgacttcctgggctcaagcaatcttcttgcctcagcctcccaagtagctggaaggtgctcaccactatgtccagctaattttttattatttgtagagacagggtctcactatgttgcccaggatggagcttaactgtcttaaactgatttctggactatgagactttgcaggtatgtactgtgagcctccaagtaatggatacggctttcggtatcactgaatttcactggaccatggaacgctttcatcttgctgttaattatggaactaatgctcttcagaatatactctgggaaaagctgtctttggatgaggataagaatttcttcttttcccatttcctaatctctgatttattaattactcttttggaattgtggaagcaggacttgatttagaaacacaggtcaccacagcaacttgagaatctgttggatgttcagtttgggagcctaagaatcattttctaagcttttcttattctggtagctgaagaagaatagacttatttgtccacaacttcctcatcagaaaagcagcctttgagctggatgtggtggctcatacctataatctcaacatgttgggaggcccaggcagaaggattgcttgaggccaggagttcgagaccagtctgggcaacataatgagatctcatctctacaagaaaaaaaaaaaaaaaaagcaggggggtccagtcactgagccaccaccgaggactcagcagcctcccttttgagccccctcacttcctgacattccgtcccggctgcctgccttctcccgccaccgctgccttccgcaggccgtttccaccgaggaaaaggaatcgtattgtaagttcgctatccagaacctccactctttcgacccctttgctgatgcaagtaagggtgatgacctgcttcctgctggcactgaggattatatccatataagaattcaacagagaaatggcaggaagacccttactactgtccaagggattgctgatgattatgataaaaagaaactagtgaaggcatttaagaattttgcctgcaatggtactgtaattgagcatccagagtatggagaagtaattcagcctcagggtgaccaatgcaataacatatgccagttcctcgtagagcttggactggctaaggacgatcagctgaaggttcatgtgttttaagtgcctgtggctcactgaagcttaagtgaggatttccttgcactgagtagaatttcccttctgtcccttgtcacaacttggaaaacctccacagcttatgtaatgtaaccgtttggggtctgctcttaacttggactagtgtaactccttcatgcaataaactgaaaagagccaaaaaaaaagtgtcggggagcagtcttttatctcagaaacccaagatctccaagaggaaagagaccttagcattgtcctgaagcccgttactttttccaagtacctttgagaccaactcatttgaacttcctcctctcggactcctctctacaacttctctctacaacttaccagtggatatactttaatgggatacagatggggttttaattttatgcagtggctctcaaagtgcagttcccagacaagaagcatcagcagcacctggaaacttgttagaactgccctactcccagataagaagaatctgaaactctgggaacaaagactgagcaatcttattttaaaaagccttccaggtgattctgttgcatgttaaagcttgagagcccctggccttgagaaatcctcttttacattttcatttattcattctgcaaatatttgctgaagactgaggctagagtagtgttcaagacaaacaaggtccttaaccaaaggaactaaacaataaacaataaacaaacaccgaaatgagattgttaaagttagggtggtaggcaaaatgaatgagggaggacaatttaaatagagaagtccatgagagcttctcagaggaggtgacatctgagctgagacctgaagaagcagaacgagccatccttttaaggagcgggagaaaaggcattcagatgggaagaacagcagtgtcaaagcccctgagatgagaaagggtcgaaggtattggaggatgagagacaggccagagagtaggaataaattagtctggaagatgcagattcccacacaccccatccaatgagctatttattcagcaggttcaagaatctgcattttcacaagctcttaagaaattctgatgcccactgaaatttgaaagccactgtcctggccgggcacagtggctcacgcctgtaatcccagcactttgggaggccaaggggggcagatggtctgaggtcagaaatttgagaccagcctggccaacatggtgaaaccccgtctttacagaaatacgaaaattagctgggcgtggtggcagatgtctgtaatcccagctactcaggaggctgagacacgagaattgtttgagcccaggaggcagaggttgcagtgagccgagatagctccactgcactccagcctgggcgatagagcgaaactcagtctcaaaaaaaaaaaaaaagaaagaaaagaaaagaaaagaaagaaaaccactgtccccctaaagtcacacagctatagcatgtcagagccgaaggggcagcacaactaagacatgtaaaactgcagatcaggcttcatgcttagcaagtggaaacctgatattatggactctgtccagtgcccttgtcactaagaaaatgtgcccagagatcagcactgggcccaaccttgcgggatttcctcagttggtcagtcagtgaagtttgctactgggcttccctgagggagattcactgtgtgtccacaccccacacgcctgcagacatttgtccagagagagaacatgcgtgctaaacattgtgatccctagatgacccctctggctccccaaagagatctagctggagagcaaaacagcaagcaaagtggaccatagccaacgtggacctaaatttgaacaagctgggggagtagcctcggcctggactgtgacatggggaggagggtatcacttcctgagttcctgctcagagcaggggaggatccctatctcttggcagatgctccataaacggcagttgaatgttgaaagaaggattaacaaaggactgaagcagttgggtatgcgggactgtgagaggtaaagggtttctctgtgtagattagatcgtcaggtcctcaaagagaacagaacacttagtccacccacctttccaccacacgtgcccagcaagagccttagcattagcctcttgtgtgatttcatggtccctaacactgttttccaggtgctaggcagctgtgccaattctagggtgtaatcaaagaatgagacaaagctgcagagaatgaaggcacttttacttagattaagtttgctaactgtgttgcactgtataatttttcaagcatttttgcttctattagctcataattctgcctggaaagctcttccctgtttgatgggctggtgctttctcagcttacagaaggaagcttttattattattattatttttattttttgagatggagtctcactctgttgcccaggctggagtgcagtgatacaatctcggctcactgcctcccaggttcaagtgattatcctgcctcaacctcccaagtagctgggcttacagatgcccaccaccacgccagactaatttttgtatttttagtagagacaggatttcaccaagttggccaggctgatgacgaactcctgacctcaggtgatccgcccgcctcggcatcccaaagtgctgggattacaggcatgagccactgggcctagcctaaggagtcttaaataattatcacttcctccaagttaatctgtttcatcattctgcttatctccctcagagcacgcatcatagttggtggctatcttatttaaccgtttcctcgttgactatctccccactgtggaatggggaggctccgtaagggcagggattactgccatcttgttcagcaccataccccaccactaggaagagctggttccattaatgaatggaacgagtaacaattcaaaagcaggtgatagtcagtcgagtccccgaggcacagagagaaagagtgagctgcctaacaattcaaaagcagatgatagtcagtcgagtccctgaggcacagagagaaagagtgagctgcctaacccctaatgccaggttagtggcagaacctgtgctagaatttggggccttctggcccctagtaccatagtcaggaggatgctgcccctgtcctggaagggagaggagagacaatcgcatacctacaggggagggaaatgagagacagcaagacaccaaaatcagcctgtctgtcctctctatagacagtatccccaacccatgggtttcctactgtgtgatgagaacctcaagccaaggagacagaatttgtattaccattgagttaaaacctttgagcacatcctcttacaccagtaccactcactgcctgagccttgccagaacccagaggtgaggactcgggtcagtgggactgtcttagtctgctcaggctgctacaacaaaatatgggatgggcagctttaataacagacatttatctcccacagttctggaggtgagaagtccgagaccaggggccagcatggtcaggtacgggtgagggctctcttcctgacttgcagacagctgccttgtcaccatacatcttcctctttggaagatgtctcttatcctcgtagagggcactaatcccgtcatggggcctcgccttcataaccttatctaaacctaatcacctcccaaaggtcccaccatccaacacaatcacattgcgggttggggctttaacatacgaatttggagggggacagaaacattcactccataacagggacccagaaggtggcagccccagagcaaagggttgctgaatgtgaaccttctgtgatcttcagccaaagctgagaaggggaggtaaaaggaaatgagcaaggaagatggagaattctacccatgggttagtttacaacagttccaggacagttcccatgggcttgctgggctcaccaggctccactgggaaatgaaggccactcagctggaccccattagcaggcctagatttccattccagtttgccgctgacctggtgcgggctagcatgctgcccgaggctgggaaagagtgagggacaatctcggcactgagtcacccagctcagcaaccaggaagcttacataacaagatggattccacgtgtttgtacatcaggctcaggctacggggcagtcaggaaaagggtgagcttggggaccacaggagggaatgggaggtggttttgagcaccctggtgctgcatctgtctgtgccaggaagtcgctgtggactcaggagactgtgagagggcacctgacgtggcagagcccctagagattacagatacagactgaagagaacaacatagaacattagctttaaatcagtattacacaattctcatgcaccctgtcctcaaggctggggaatgttaaatagccaagtaaaaagaaacacgggaggcaaatgagtaagagacttagtaaaaacctgaactcctggactaagatttgtcttcagggtattgttactgccacagagatagcaatcacagtgacattggaacgatgtttgttgggtagggaaacagtctgtgggctagaaaaatgtgagtgggcagctgtttgaacttcactgcaaagctcttttcagacatgaccctttacagatgaaaatgaggagacaggccatgttaggagactttcctgggaattggtggaaagggggcatccttcctttcaagtctttttccaccctagctttttttatctgcaacctctgcctcctgggttccagtgatccaatcacttccaagaaagcaacccccaaacccccctaccccacacatacttcggtaacatggcctagagaagttgtctacaaataaaataagcccttctttcccatccaaaaactatttctttcatgtatattttttaatgtgcatacaatttctcagcctcttggcacaaaggaagtgataggctgttgtactatttctgctctgcgtagagtgagaagtgctttcttctctagagggagagatttcaatcagaattctagatcaccctgggtcatctacttgcctcctttttttttttttttttcttttgagacagagtctcactctgtggagtgcagtggcacaatcttggctcactgcaacctccacctcccaggttcaagtgattcttctgcctcagcctcctgagtagctgggactacaggtgtgcaccaccacacctggctgatttttgtatttttagtagagatggggtttgtcatgttggtcaggctggtctcaaactcctgacctcaagtgatctgcccacctcagcctcccaaaatgctgggattacaggcatgagccaccacacccggccctacctgcctccttgagcctatttcctcctctgtaaaatggggtgattgtagtatgtaacttcacagggtctctgaaagctaaaggagattgagatctttggatactcaaaagccctggacaaatatttataagtttacaagggtttttgtttgtgtgcttgtttttgtttttgagaccgggtcttactctgttgcccaggctggagtgcagtggtgctatcatggcttactacagccttgacctcccaggctcaagtgatcctcctgcctcagcctccagagtagctgggactctaggcacacaccaccatgcctggctgggttattttaacagttggaaatattaaaattatttctaaataaaattgtgaagaaggtatcagaaagtgaaaaggagattatgttttatcttgcagggataataaaaggacagtgtttttgtttttactgactgtttttttttttcttgtctgacaaacacaaaaagaatctgattaaagccatagccaaactctccaatgggggaaaaaaaagatatttttcaaatgcccatacaatttcagagggatcatgggtactctgagggtcactagggatctgaaaataaaagtcctattatgtaaaggatttgtgcccataataagtccatgcctgcctcttgggcatcttcagggaacaaggaggaagagaagaagtcatcactgaaaatcttgtgacacaaataggtcacccctaggggacaaatactctaacacgctttttttttttttttttaacagaggccaaagatgacttttggggactgaaagtgggttgtttgctttgtttgcttagtgaaaggctggagctggaatgggagtgttcactgctcccagatcagggctccctggctggacatgccttctagcccattgacaggagggtctgtcaggacctgtgggtgctgaggagccaagctccatgcacagtgaggctgagagaactaaggctgaacgccaaagagggagtagagaaaatacaggccgggtatggtggctcatgcctgtaatcccaacactttgggaggccaaggcaggcgaatcacctgaggtcaggagttcgagaccagcctggccaacatggcaaaaccctgtctctactaaaaatacaaaaaattagccaggcgtggtggtgggcacctgtaatcccagctacttgtgaagctgaggcaggagactcactggaacccgggaggcagaggttgcagtgagccgaagtcatgccactgcactccagcctaggcgacagagcaagattccgtctcaaaaaaaaaagaaaaaagaaaaaagaaagaaaatacaggccatttttccaacaccagatgcccagatgcctttgctctcctttctttgaagcacaatacagaaattgtggtgtgcaatgagttctcctcacacaaccatgactttgaaccctgggcccagactggccttgagtggagtgatgagacccactgtgttaataagcagattcaaaacttaggactcagagcctctaacctgaaaaatccttcagaaagtggactccatgtccttttctccttcaccctgggctgaacagtgctcagcagctaacatgtgactgcaagctcttaggtaactgagctcaacctccagaggctaagagaaatcgagagaggtatgggtaagatccaactagagcaagtactctgcacccagcagggtgatcatcaggacctcactcttagggcaagaaccaagagaggcctctttttgtcagagcattgagcttcctacataacggtgaggtccaccatgtctgctgagtgccagatattgcttcgtgatttccttctctcagtcatggcttaaaatacatttgtgaagatgtaagtggaccatgtctaaacagctcctgttcaacattaatggatttgatatcatctatcagacaaactagcaggaaacaggggtttaagaaaatgagacacaggataggtaaatcaggatggtgggcacaatctgggccatggaatgctgcccaggagaggtgagctgggtgagcttctttttgttcttttgacctgaccctagcagtcagtactaagttgaataggatttcccaagactcctgttcacctggagcctatgactgattttatttggaaatagggtctttgcagatgtaatgaaactaagaagaggtcatattgaattcacatgggccctaaatccaatctgactggtgttcttaaaggaagagggactgggcacagtggtttatgtctgaaatcccagcactttgggagaccgaggtgagaggatcacccgaggttaggcattcgagaccagtctggccaacatggcaaaacccccatctctataaaaatacaaaaattagccaggcatggaggcatgctcctgtaatcccagctactcaggtggctgaggctagaaaatcgcttgaacccgagaggcagaagttgcagtgagccaagattgtgccactgcactccagtctgggtgacagaacaagactccatctcaaaaaaacaaagaagagggacatttgtcatgtaacaatggagggagtgattagggtggtgcatctacaagctgaatccaagaattgccaacaacccccaaaagctaggaggggggcatgaaacagattcttttttagagcttccagaggggataatcttgccaacagcttgattttacattccagatttctagtctccaggcctgagggggaataaatttgttttgttttgttttttatttgtttgtttgttttttaggcggagtctcacgcttgcctaggctggagtacaatggtgtgatcttggctgactgcaacctctacctccttgttcaagctattctcttgcctcagcctcccaagtagctgggactacagatgcgcaccaccacgcccgacttatttttgtatttttagtagagacagggtttcgccatgttggccaggctgatctcaaactcctgaactccagtgatccacccgccttggcctcccaaagtgctgggattacaggcgtgagccactgtgccccgcctaatttctgttgttttaaacactcaagtttgtggcacttataacagccctagaaaacccattcataatctttgataactttttcactacgtggtatgaaaacgtgtttcaggctcatcttgaatagtttgtgacccaggcctgcagtgtttcttggctgattttaatagacagagtaggggaaaaatatatatatatatgtcaagatgaaatacttcatgagttcatagtgatgtttccaattcgaatcagggctggtatttctgattcaaattctgaaaatcctgtttctcaaggacctaaggataatagaatattctacagtttctcatctgctttatcctgcattataaatacaatagtctcagaatgaccatattaatactaccacaagtcattatgattattgaaaacagcttaaaaaattttgctgatcctatacacattctctggttatactaaatttgcattgtcagagcatataactattacatatactataccctctgtcttttaaccttcagttaatctaattctaccagtgattatatatttaatgctcaccagtcatctctatgctgattgttctcaagtcatttgggttgtctaatgcatattgtttaataaattccttaagaagggctcatgggagtgatattccttaagttcttcttacatgttgataaatttatcagtgtcctttctgctttaaggttaagtttggccagatttaaaatctttagtttacattttccttccttgagcaccttaaatatgttactccatttgcttattaagcattattgttgaaaagtctaatgataaactaattttctttcccttacaagtaacatgcactttttactgagatgccaaatggattccttcgtttcctttaaagtctaaaaattttactaatatatgtttttggcttttttttgttcatgatcctaaattttctagaactgttagatcatgtcaaaaactttactaatatatgtttattctcaagcacattatgtgctcttgcaatatgtagtttcgaatcttttccttgaggcaggagaatctcttgaacctgggaggcggaggttgcagtgagccaagatcgcgccattgcactccagcctgggcaataagagcgaggctccatctcaaaaaaaatatttttttctatcttttttttcaattttagaaagttttcttttttgctttttgttttttgttttctaacacagagtctcaccctgtcatccaggctgtggtgccatcacagctcactgcagcctcgacttcttgcactcaagttttcctcccctctcagcctcccgagtagctgggacaggaaagttttcttgagttatagtgttgagtattcattctgtttctttgttttggtttcttcttcagaactctcattatctttgtatcatatctttttgcctgtcttaaatatttgtcatttttctcaaatcctttttaatctttctgcattcctttttgattcttataattctctgccttttgactttctatttctgttgttatatttgttatatttgtttggttttgtattcattctagtttgatct

SEQ ID NO: 525 - DNA, 22050 bp, Homo sapiens
tcattctttggtccttgtcaaagcagtgaaagtttggccctcctaggtgtaggggtcccacaggaaatgccaagatgaagggtactccagaagggcatgtgattaaaaagtgacaactgcttgttctctgaagcaatcctttaagttccttctacactcttcttacgtactttagctacttccaatgaagcaccaaaaatatttgctcactgcaagagccggataaaagctcattttactgccttgtaggcaaccactaacattttttaaagtggggttggggaagagaaaaatctccatactttgagatgtagttttttcttacagtagtctgggaaataatgttttaaggcctacaaggcctgcatgggctcaggttgtgtatttactggatattcagagtctctctctcttttttttttttttggctcactgcaacctctgccttccaggttcaaatgattctcctgcctcagcctcccaagtagctgggactacaggcatgtgccaccacacccggctaatttttgtatttttagtagagatggggtttcgccatgttggccaggctggtttcaaactcctgacctcaggtggtgggagtatggcgcaccacgcctggcctgtatattcatagtccttatacctcttaaactttaacaaataagattttttaaaaaacgaaacgttggcctcatagaaacatgctcaagaattctgaaagagttccatgagtcctacatgcaaatggaatcagataaggggttgaagtttgcatgcaggggctcctacttggttccccaagcccctctgcaggagctgagaagccagggctcaccctgagatcatctcagtcttacactctgctccacttcactcctagatgcgtgttttggacaagctgatggttgagcgactttctgcagagaggacggagtgcctgaaccgcctgcaacagcactcagacacagagaagcatgagggggagaaacgacaggtaggaaccagcatctgctagtccttaacttatgatttaccacacaggcccactgagctcaggcaggcctgccactgaaaactcagaggctgagactccctaagagcttttacattatatagtgtatcatttttatgatactgaaatgaggttaatagaaaagaacctgtagttctgtttatgtccgtggctgaatatgctggcaacagatgaagaccgaacatgctggggaagatgccatttctgtcctgaactcattccatgtattgtgcattgttaggccattacagttttagaacaagacatagtttctaccctcagggagtttactgtctcaccaagataagagacatggaatgagtacagtgagtgtgtgagaactcaggctttctaagcaaccagaagtacttggtttggaagatttgggtggttttgggggttgagtttaaggtggctctagtcacttaatgaagattgtagatagctctctgcttgggtgcctgctgtggcctataggaaggtggcttaatctgtctgtgttgctataaaggaatacctgaggctgggtaatttgtaaagaagagagttctttggcttatggttctgcaggctgtacaagaagcatgctgccaacatctgcatctggtgagggcctcaggaaattccactcatggtagaaggtaaaggggagctggtatgcacagatcacctagcgagacaagaggcaagagagacaggagggaggtgccaggctgttttaagcaaccaactccttcaaaaactaatagagcggatgggcgcagtggctcacgcctgtaatcccagcactttgggaggcctaggtgggcggatcacgaggtcaggagatcgagaccatccttgctaacatggtgaaaccccacctctactaaggatacaaaaaacttagtcaggcgtggtggtggacacctgtagtcccagctactcgggaggctgaggcaggagaatggcgtgaacccaggaggcagagcttgcagtgagccgacatcgtgccactgcactccagcctgggcgacagagcgagacttccatctcaaaaaacaaacaaacaaacaaaaaaaaaaactaatagagcaagaacttactaaccgtgaggatggtaccaagccagtcatgaggcattcacccccttgacacaaacacctcccatgaggccccacctccaacactggggatcaaatttcaacatgagatttggaggggtcaaatatccaaaccatagcagtgggcaagccataacttttgggtttgttagatggtatcctcaactgttataattgaaaagtccatccttgatgctttaattcataaaccatgtatcaaattcacttgattcttctatgtacttatttgtggggtttgtttttttttttaagatatccttggtggatgaattaaaaacctggtgcatgttaaagattcagaatctggagcagaagctttctggagattctagggcctgcagagctaaatccacaccatctacttgtgagtcctctacaggtaacccacacacagagagcccttttgtccaaaaggaacacgaccagcagctcttgtactctcctgcactgaaaggcagtacgtatgctagggctgtgggaaacactggatggtaaagtgcactctgtaggggcaaggactgtattttgctcgtaaccatatactcagttgctatgtaataataaagcactcatttatgtgctcaaacttatttgaataaaggaattaaagaattgttgactggtgataacattgccttgagtacagtgttgatagtatcagagtggaccccaaagatgagaggtgatgaagatccatcggtctcctcagcagggctcttcctcccttgccttttgtgccttttacctcttccttctctttgatctgccttttacttttgtccaactatgcaaatcctcattaaacagcagttcttacatagaacttgcccccagtgctagataggaaatgctgcaagcaaaccatctttacattagccacagtgattatactcaataatgacaattttgaggacattcagagcctgggtaactaggcctcagtgggggattttgatataagtgctttgtgttaccacaggccatctctggaactgtggtttcatctttgtgtcaacaacatggggaaacatcccaggaaaatgtttcatgctaggactactcttagggcttgtcgtggagctctgggtgtggaaaatggggcctcctttccaaattggagcttgggtcaagcagttagtacactggtagggaataggcccagacattagagaatgggaatacatattctcatagataaatgtccaaatctgctttgagatacttggtgagcggcatcatccttaggcatcaggaaacaggaccagagccttctcaggtagattgaggcgggctgaaggaaaagccagcaacttttttggcttaaatgggaccagtgtggctaacacagaatccatgaaagctctgacaagccaaagtgatcatcagaggagacaaagtggaagggaggaacagaaaggtgagaaaaggctcagaggagacgttacacatggtgggtggtgatggagaaggctggtgatatacaggatccttaagactctaaaatactgacccgcagccatatgactgtgtgaatgtggatttgctctcacgtttgttttccttctgaaaccaggtgtggaccaattagtggtgactgcaggtccagcagcagcttccgacagctcccctccagtggttaggcccaaagagaaggccctcaactccactgctacccagagactccagcaggagctgtcgtcttctgactgtacaggctcccgactgagaaacgtcaaggtccagacagccttgctacccatgaatgaggcagccagatctgatcagcaggctgggccctgcgtcaacagaggcactcaaactaagaagtctgggaagagtgggccaacaaggcatcgtgcccagcaacccgcagccagcagcacctgtgggcagccgccaccagccacaggcagcgagcagactggccctcacattcgggacacctcccaagctctggagcttacccagtatttttttgaggctgtttctacccagatggaaaagtggtatgaaaggaagattgaagaagcacgaagccaagccaatcagaaagcccagcaagataaggctacattgaaggaacacattaaaagtttagaagaggaacttgccaaactaaggactagggtgcagaaggaaaattagcaccaataaagaggaaatatgaaaggattcttgaagatttccagttttgcaactgcataatagctatgcccaaggagtcaactattgtatatattgcagatttgcctttttaaaaaaatcactaattctacaatgtgccagatacatgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattgagccaaagagaagaaatgatttattaacatggggacaccaagaaaaacaaagtatgcttttattccctttgtcaagctcagttttagggttttttcttttttttatagtgacaatccatagatatagacattcctaaaagaaaaataattcagtagatatatgtcactgttacctgaatatggaatgaatttgatgttttttattttgttgagacagggtcttgctctgtcacccagactggagtgcagtggcatgatcacacctcactgcagccttggcctctcaggctcgtgatcctcctgcctcaacctcgcaagtagcttgggactacaggcgtgtgccaccagtcctggctaattttttgtagatataaggtctcatgatattgcccaggctgaatttgatgttatttcaagttgattttcatgtgtttgggagcttgtcttgttctcaactactacgcaggtagacagtcttcccccagagactcattagattgcaatatagaggcactttctcatttccctattgttcctaatacagaattgtagagctggagagtaccttcagttttctaaatctattctcaaacaggatatcactaacctctttagaatcattcctcagtatacatcaatttattgagaactgcctaatactcaagaaattaaatcctgagttcagtaggctgtgttccaagcaggaattattttcacttaccaaaatatctcctattacctcaaggtatccttgttgaggaatgctgaaaactaaattttaagtatcaagtctagaccatagagtgctttggtgggagtattttgattacctcctacccatcagaagcaggcagctaatattgtgaactgagtatttttgtcaaaagtcacagggaagagactacagaagaatgagaagggtcaaaaggacctagtgtggcttactacatggatcttgtctcttggaggtctgtcgtagaagaagaaacaaatagaggtgatgaagacacagaacaggctcagtcagcatcctcacccagagatggcaacatctattaagaccaatgcaataccttttcatcttcagcaaatgttgtttcatctgtttttgatccttggcattgtcaaaaacttaactgcaggtccagtgtatatttttccttatttttcccttttagctatctgctaaagtgagtaaatgccacaactgtacttttccaaagaaaaagaactattgacaacttatagcctgtcatgcaggtcatgtttcaaatcaaggctgaaattttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgcgatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagtttgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaacaaaaaaacttaggttttcttggagtctgtgctagttgaatcttgcaaatgcaaaccacatacgctctttaatgaaaacctttccatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatgcttctgtttgtcagatcattttgcaacaggttaactaatacttatctacataaaaacctgaaaattggcacaggcaggcattttgaattagtagattacccccatggaacagtattcagaattattttgtcttgtgggctctgaggctctgggaggtagaggtggaccctgacagtccaggtcattaacatccacattcagttgatgcctctcagacacagtccagtactggataccatttatcattctgcaaaatgttgtctacatctttcaggtgctggtcattcttagattagcttcttagctgttctgttgataaacagaagacttcaattttcaggatggatgattccaacatcttccacaagctttcactttcactaaattattttgttataaatttgatctccttcaaaagtgccttgaagtcaattttggttgtaatgtatttgtctctgacgtattcttcaaattctctttgttttttttcctgtcattggagaactgcacccagaatcttatttttactacttccatgtgaatgttaaggtactcacagaggtttcatccagaagtcttccctcttctttctggtaagtgcttcaatgtgctcattaagcttctctttctcttcccttttcaacaaagatctagattcccagtggtgatctttttgatgagttctctatcaaactatgacacatctgaagaacgtacctgaacaaccctcagggataatgcaggatttttcgagaaagttccagggtatctcctggtgtcagtatactttcagtcctacacctcaagagttttttaataacagctttattgagatacaattcataccttacatttaaaatgtacagttcagtggatttgaatatattcaagagttgtgcagcctacaccacaagctaactgtaggatattttcatcaccctgaaaaggaaccctacacccattagcagttactccattccatctacagccagcctaggcaaccactaatctttctgcctattctggacatttcgtatgaatggaatcatcatgtgatcttttgtgaccggcttctttcacttaacgttttcaaggtttatccatgtttagtatatataagtccttcgtttctttttagtgccaaataatggctatgggcatggggtagaagtgctaactcatacagcagctgtttcatcttttgaggaactgaccgtctgttttctgaagtggctacaccattttacattcccaccagcaatgtatgagggttctgtaatttctgtacatcttcaccaagacttattattatttctctttttaattacagccattctagtgaatgtgaatctcagggttgttttttttttttttttttagagactgtctcactctgtcacccaggctgaagtgcagtggcacgacctcagctcactgcaacctccacttcctgggttcaagtgattctcctgcctcagcctcccaagtagctgggactacaggcaatgcaccaccacaccaagctaatttttgtatttttagtagagatgaggtttcaccatgctggccaggctggtcttgaactcctgacctcaagtgatccacctaccacagcctcctaaagtactgggattacaagcatgagccactacacccgacctcatagtagttttgatttacacttccctaatgattgtgtccagcatctactggccatttgttagtggtttttttcttcttttaagaactgctgagacatccataaacattttcaaaatgcagggtatgtttttcagtgttaaggcaactgttctgatgtgtttttcctttgctctctatcaccaaatactgtacatataaatagtaagactgggctttgtgttgtccattgttaatcctaaatgcaacaaaacacatggagactttgaaaatccttcagaataatgctatagttaagattttgctaaagcaagtgttttttctaactccttgagctgcatattgccttgagtaatcatcatccggattgtatcctgtagaataaagtgaaatctggttatagttttacctggttaaacaaggtatagctataccattttatctgttaaaatcaagaaccaatactacctattggaactgctgccttttagaaaagctaaaagagttccacatacatacatataaaatgtacaacataaaagtcaagtgatgatgctgaagagtgtagatactcttttatctacatattttaaaatactaaattttaaaataataatttaaaatcggtaacattacaagcaatgatcaagatataccagctcagtggcactatattccaagatgtctgctaaacttaaaaaaaaaaattcactgatcaataaaaagggttaggatctgtcctcaccatgattttgttctcacctcttcggtggcacttttgtttcttctgaattcttctcttgcccaatctttcaggtatttgcgatcagaatcatttggaacttgccgaattgtttgcaaaatccttctgtagaggagaagaacttgttgccttcttacgaactgtaaaagggaggagtaaatagcaattactactgcacaatcgccagcctggaaagttctacttcagcaaaccaagctgtaaccagagtacttctcgttggtcaattttgaaaaaggcaaagaaaaacttttttttttctttttttggccagatgcagtggctcaggcctgtaatcccagcactttgggaggccaagatgggaggatcacttgagcccaggaggtctaagctgaggtaagccttcattgcgctactgcactcagcctgggcgagagtgaggccctgtctcaaaaagatgttttaaagaaagcatcacgaggttcatctgatctttttgcttactgctctgtcaaacctaagaaccattaaaaaatcaggagctgcctaccgggctgaaaagggctgccggtctcctagaagttgttattacaacgacagcactttttctaaattaacagttgttcaaatctttggtaatctcatttgctgtttgccacagctcagtgcaatagacttttaccgtgggcactgggcagctgaggcaccgggactcagggaaatcaagcgcctgacgctgtctcacgcgatcgcaccaaaccaaggaagcagccagtgcctcccgtcaggccccgcggagcgaagcaccgccccgcaggcatcgggccaatctcagagggcgcgcacgccgcatcaggaccccggaacccgccccgttggggatagggacagatggagaatccagctcagacccaggtaagctgctttggaaggcagagaaccgccggtacctgctttaacgttagcgtcgctgggggtaagcgggaagcagccatgtccaccagaggtccgccggagcctcagcgcgcaggagcggaagtggggttcgaccaaggggtgtggcgagcccggtttcctaggagacggcccgcgggttgctctcggactgagagcgcgaggcttcgggactgagccctagctgctgcgctggccgaagttttctcgtcggtaaaataggataacagtgcaccatagggtcgttttgataaagaagaaaggtagggcacttaacacagttcctggtaaagagagttcaaatgaaagtgaaggaggccgggcgcggtggctctcacctgcagtcccaagcactctgggaggcctgtaaggtgcctgtaatcccagctcctcgggatgctgaggcaggagaatcgcttgaacccgagaagtgaaggttgcagtgatccgagatcgcaccactgcactccatcctgggcgacagagcgagaccctgtctcgaaaaaaaagttaaggtttttttgggggaaagaggtgaaaacgtatttaaatgttctttcgagcctttaaaaatgtgtatagttgaaaatactaaaattgaaagtgttaatttcttttacagtttgtgttggttttttctctttctcgtttttgtcctgttcttttgtagcgcaaaggttttccgggagcggtggccttcatgatcatttgaaacaaagctttgaatggctcacccacttcagtcttaagcacttttcatcactaataacgaggagcctaacatccctaagcctcaggcttttgcttttatttccttatagttgttttatctttcccacaatacacatgcctttgggttaaatcactagaagtggagttagcgaatctttgccatattaattttccaagtggtgttgtatcgaattaaaatagaacgaaaaatgttcaattactagtttactggggacttgcttgcctcgcctgttagcatcctggggctccctattcctagctgtgttctggctatttcccctctcctggcctattacctcccctgtaaagtgaaatatagcatctacctcagttgtgtatctctaatgtactgagaacaggtcctggcacatgtaagaactctaatcattagctcttttgaactttaccaggcattgtatgaatgatgctaactgcatgatcatattatcaataatatatgccaaattttgtctaatacattagctgtaatagttaattgctaactttttaaaaggagtgaagttaaatacccctcgccatttttagttatactgtttttgtgaattgttcatgacttgggtccgtttatgatgaggacatttatatgggctctatattttttgtcatttctttatacatacagaaactttatacaatcatgtatttttgtgccttttgaggcttttcatttcccattcaggcctttgtaattcgttttttaaaaactttaatttttaaaatatttactccatctagaatttactttggtttacagcatcacgtggatctaagttcttttctagatgttaagctgtatcaataccattgattacataactcattcctttttcggggctttatgatggatgcctttttgactgtatgataaattcttttagggtctgagtaatctgtccagaattgtttcatttagggttaagtttttactttttgttttatatgtttttattatctggcaggactctagtttcttgtaaaaaatccattagtactgttctctataatctttagaaatgttttgtatcatttccctccaaatcatcttgtgatcttggttggaattttgaagtagtgttgaatctatacattaatatgtgagaaagacatttttacattatttcttcttcccatcaagaaacactcaggccaggtgcggtggctcatgcctataatcccaacactttgggataccgaggtggatcacctgaggtcaggagttcgagaccagcctggccaacatggtgaaacctcgtctctactaaaatacaaaaaattagccgggcctggtggcgcacgcctgtggtcccagctacttgggaggctcaggcaggagaatcgcttgaacctgggagacggaggttgcagtgagccgagattgcgccattgcactccagcctgggcaacaagagcaaagctctatttaaaaaaaaaaaaaaaaaaaaaaaagggctcactcttgctagacactggtaatgctgtcgtgagtcacatatgctccttgctcaaagactcatgctttgggcaggaaaacctctaagttcaatatagtgctaacaaagaatgctgcagttcatactgtgggaaattattcttcctggagggcttgtctgagctaggtatttgtcagaaacgcagaatcactaagaggattccagacaacacatggaaacactggcaggaatgctgggagaggagggacaggagagtcaagcaagagcctcacaggtcacatgaagaagcttgaatattaccctcttcacaagggagagctttgaagggattttcagctacagaacttttagaaagatcttggatgttgtgaataggatgaagtgaagcaagcaaagagaagttactggcctggccaggataccattgaagtagtccctgctagagattaaaagagtcccagtcacagtgcagtagggggagggggagggatgggacaggatatccagaagcctgactggacaagatgattaattaatttgattggggtatggatagagatggagaaggaagtaaagcagatgtataggttaagtcccaagtttgtaaacagggtggctgttggagtggtcatcccagatggggaatgttgaaggaatgggtttggaataggggaattagaacacagtgacatccagcagatgtctgaatataattaagaataccaaagagtagatttcctggacccctggatggagaattttacagtccttttgcttcagtgatggtggaggccacgggagtggtgaagaagttatccaaagtgagattttattgttgttgttgagatagagtcttgctctgttgcccaggctggagtgcagtggcacaatctcagttcactgcaacctccacctcctggttcaagcagttctcctgcctcagcctcccaagtagcttgggattacaggtgcgcgtcaccacacccagctaattttctgtatttttagtagagatggggtttcaccatatgggccagcctggtctcaaactaactcctaaccttaagtgatccacccaccttggcctcccaaagtgctgggattataggcgtgagccactgcacccagccccaaagtgagatttttaagacagcatggaggacttttgtgttctgctgtccattccttaaatatcagaacttacttacttacctatttggccaaggcctggggggttgggggaggggggggtgggcaggatagcacaaatgtcaactatcaacatggcagattaattgatcactactcctgcaagcccctgttggcagcacaagttgaaaatggcactcttgggttcctgcttcctggaattcctactgtccatgatctcatgagctaacccagggccaagggaatcactctgggcacaccagtttgaggtctaagaaagatggagcttccaaaggcagatgtaatagactgcagcattgtcataatattggtgtctttccctcccagactcaaccctactggaagattaaactccctgccccatagagggctttagccaatgaaatgtgagtgggatgcaacatcatcatttatggaggataattaatttttataagcctccttataaggctacaccaactcatccttttcattctgctgcaaagccagcatattatagctcagcctaccatggacataaatgcaaatgataacctttgtagtaagagcaacatggaagtaggaggggatcatgttagcacagcatcaactagtaacagctgactgactgatccagcagagaagatcagtcccctagcataccttttacaatcctgtcatcttccattaagaagagtcacaaattacatcaacaacagtggtatatgttttaatagttttcagaatataagctgcatagctttttagaataaaaaatgatataacttcaggtacatgctttgggacacttggttaaacaaggaatctgtgtctttgatgaccacctcaaaagggtcgcagacttcacagtgtaacttggaaacagacaaggagatagatgattacatcatgacatactgcctacaaaagaacattctgacagaacattaagtagaacagagcacacagtttcaagtattcagcactgctttctggccaagtaaaaactgcctaaagatcagtttctttcgactggaaaaaatagatggagctgctgagttctggacacagcgtttctttcccagaatgagactggctcagtccagcttgaaagcagtgtgaggaatcactcttccccttgactgttaagaaaaaaaaaaatgaactaaacaaataaattactacaacaacagggaccatggcactgaatgaaataaaggggcaatcaccttcccatcattgcatagtctcccgaagcagcaagtgtgaaagaggatactgaaaagccacttcatttttacacagcccaaggatcgtttttatagatgacctgggcacctataatgtccagttgctttatgagaacacacacacaccacattcttcctaccctctaagagaaggtagttcctttcacaataagaaaacacaccctcatactctccagaaacgagctgtcttggccacttgacagcttttgggcacacactatgggcttggcaaggcagagcttagaacagggtcaaaagggcagctccctttagtcctttatacaaaggactgtcagagtcccatgctcctggcagcatctcctcaaggcacaggtgcccagatcccctgcaaaagaaaacaggcagctgggctccaacggtggggtatgacctcctcccaggccagggcttccaaggcagggaagaaggataactcttctctagttacgagttcaggcacctgctgctgcttccaggtttggtataaaaacctcagcccaggcaaagccgggagccagagagcattctgtaggctgtaagatcacgttgtaaaataaaaatattacaataaaattttttgtagttgtccaaaagggagcacctgggtaagcaatgtgaccttctgaccacagttaagtctcactttggactcttctttctgttctatgggtggtcagaggctgtcaccaactcaaaccactgtctgagggcatcgctgagtgtctcaggaagtgcgtttacatctcgaagaatgatatagtatgggaatgggaactcttccatgtaggatcggatttcaggcatctctccaggtcctttaaatatcggtactttaatgtccaagatagaatcctgtcaacaaaagacattttgaaatggggaggcagcgattaaaccagcatccttagctagctcttctgtgatctcttttgctaacttttacatctcctgtgtcttattcctgcatatgaacctaccttttattactaagtaaaagagaattttcagaactctactaagaaggaggtagatgtctttctgagtgccccttccaggaggatggacactgaaaaaaaggaaaagggatagacaggaaaatctgctttccctacagtggtgtctccccatcatccacttggaatcattcacactaaatctttaccttcctatcaaggccttaatgtgacccacagagacaatgcttccctggaacagaactgccctataggcatatttcactaagatgattgatgcttcttgctgtgaggagctactgagacataagttaagtgtggcaacacctaatctccatttcaaagtggtcagtacccattatcaaggctgcaatacctgcactgactttgcatagagggaaatgatgacccacagaggatggtcattctgaatcttggctctcccactcattacctataacctctatgtgtttcagttccttcagtgtaaagtgggaataatgatccctacctcactggcttattgcaaagattaatagagaaaatacttacaagtgcctacaatggtacttgacagaatactatgaatgctgggagttctcagtatgactgagtgatccaggccatatttcagattgaacaggttgaagggaatccccactttacctccagaaaaggtggcttttagtagtcactcacccgtgaactgggattgtccaatacaacaaagatgacaaagatatttgcattccgggcagcctgaactgctgccaggactctttctttgccctcaaggaaaaggcctcgcccatcagagactaccaggaggagttgtgcagtttctgtagaccatataagacgaagcaagggaataaaatgaacagccatttttaataactcacaactacccaaagtaggacaaattagtgtaggctttctctgtactattaaagctaaacagacctctaaagctgatgaattctgggcacaaacctaagggacctctgatgagatctatcccttagaatgcttgagtcagagacaaggcataataagggatactaagtaagcttctgtcagtatagaagaatttctcaatagtgcttcaagaaatgttaagttctgctcaacttcaaattgtagagcaacatactgtacatgagaattaaaacactagtttatggctataaactttaaaaatgatagtactgagaagggcattagaagaaagtggccaaatcagaaatctggaactgtgtcttccaaatttcagtcgttacatataatcatctttagatttctgttaattccttgtacctaatttctatatttttttgcccttgaaatttgacttgtttaaacaaaaacaaatagaaaggaaacactcaacactgaataaaatgttttaaaatttttgctacatagtgtttccagctaaagattatatagtacatgagttgagggtgggctgttttagcaaatgttgacaggtgtgaataacttgcttccatcaaaatctgaagcttctgcatgatacactgagaacagtgagagatttttggaaaagaactaaataattggcatgtttcaagcccccaaagtaaatgtggttggattagctggtttttatattatgtccttctctactttcctctgttattaaaatattagagaatacagtacttgcagggggctggtttcaggacacacaccccctcacccccagtataccagaatacacacatattcaagtccagagatggccctggagaacccgcatacatgaaaagttggccctccatatactcgggttttgcatccctcaaatgctgaattttcaatccacttttggttggaaaaactccatgtgtaagtagacctgatctgtacagacaaacctgtggtattcaagggttaattgtagcctttatatttaattccacacacaccttgctcctttctcttataaatctgaactcaagtaagtatatactagttagtgtctagatcccccattgattataagcctcatgagtacaggttcaacaaaaatttctgaatgaatgaataaataagtaaaaatcagctccatcaatttatgtcttttcctgtggagcatacctattaaaacacagtgacggggacactgagctgaagcaagcagcttgggaatatagagtacaagaaagcattttgttaatgaagaggaaggcatgcagctcacctgaactgatgttctgcgagagctgctgagcagctgcaaacatgttggcaacagactctagaaactaaaccggaaccaggaatagacaattagaaaactatgtgaatgctcttctcattgtcaaagagactgatagtatttctgacattgaagtgattatcagataaccacctcaggtttacagaccatcaactaactgtcccttctggccgtatgtagttaaaaaaggaggatccttggatacagacattctgttttttaattattattttttgagagagggtctcactgtgtcacccaggctggagtgtagtggcacgatctcatctcactgcagcctcgattcctgggctctgcctcagcctgccgccaagtaactagcactacaggtatgtgccaccacacctggataattatttttgtcttttgtagaaatgaggtctcactatgttgacaaggctggttttgaacacctggcctcaagcggtcctcacacctcaacctcccaaagtgctgggattacaagtgtgagccaccatgcctagatgatacaggcattctcaagcacaggtgagacgtttctctaacatataacccactagagttctggaagataccccaaaggaaaagaagtgcttccctggggcataagaaatcaatactccctcaaataaaccaaacagctgtcttctttcaagaacagaaaacaactgagcaaaagagaaggcaagaaaatacaaaatgtccagggcagcctagaaaaagcaaactgaatcagagcaggacccaggagaaatatgatcccatgctgttttgaacttttgttctcttaagtaagtcactggctttacttcatatcatttcttctctaagcttaatgagggagaaaaataggtcttggcccagctgataagggtatgggagatgggtttgtttttgcagaatgttccaaactactcggaaaaaaaagtagggagctagaaaaccaatgatgcaaagtcaagtgatccttgaggaactgagaaaaagaagtcacaccttgttttataatggatgctaaggaagcttctattccagtggtacacaggctgaggtttgggactatccctgtcctaatactgtatgcggtggagggtggttctcagcccagcatggtggtaatcccaacacttcgggaggccaagaagggaggatcacttgaacccaggaattttagaccagcctgggcaacaaagtgagaccctgtccctacaaaaaataaaaattagccagacatggtagcatgcgcctgtagtcctagctactagggaggctgaggcaggaggactgcttgagcccgggagttcgaagctatagtgagctatgatggcgccattgtactctagcctgggtgacagaacaaggtcctgtctcaaaaataaaaatgttctccctccaacctacaccagtttaaaaataactgtgcagaagacattttatttcatcctcttacctgagcaatcttggttttcttttgttggaatttgcagagacgtagaatctgggacccagagtaatcactgaactgctcatgaaatgggtgtaacagctttacagattctccaaaacttgggggaggaaaaccaaatacaacaggagttattttttggctgtgtgatcaaaataaccaaacaggttgtgaaaagttttcataaaggaattacaaagcaaccttacctacacactgcaatctgacccacttccaggagggttagagcatttccaatcacagccaaagattcaaatgcaagctgtgaattagaaagttaatgattttaggaatcagaatatcctctaaaccagagcctctcaactattttttgcatcaagattcccaaagaaaacatttttttgtttggcaagtagaggaataacatcagtaaggctactatagtcacaacaaacccaaaggctttggtggcctggtaccacaaatgttgaaacctagaatccattacactgataggaatggtctgctgtagacatcgaataaaaagtgaccttgagggccaggcgtggtagctcacacctgtaatcccagcactttgggaggccaaggagggaggatcacttgagtccaggaattcaagagtagcccaggcaacacagcaagaccccacatctgtggtcccagctacttgggaggctgaggtaggaggatcacctgagcc

SEQ ID NO: 526 - DNA, 52235 bp, Homo sapiens
tgggattacaggcacctgccaccacgcctggctaatttttgtatttctagtagaaacggggtttcaccatgttggccaggctggtctcgaactcctgacctcagatgatccgcccgcctcggcctctcaaagtgctgggattactggcgtgagccaccgcacttggcagttcttttttttcttttttctttgagatggagtctcgctgtgtcgccgaggctggagtgcagtggcgcgatctgggctcactgcaagctccgcctcctgggttcatgccattctcctgcctcagcctccagagtagctgggactacaggcgcccactaccacacctggctaatttttttgtatttttttagtagagacggagtttcaccatgttagccaggatggtctcgatctcctgacctcgtgatccacccgcctcagcctcccaaagtgctgggatgacaggtatgagccaccacgcccggccagttcttttagtttttaaagcagtctcatttcagttattaatattgacttcttcattttgaaacttcaaataatatttgattcaaagctttcctcctcttaccagagcaggctggacctgtggccctggtgacctggaattggaaatgggggtgtgggatgtagggcataggtcttcttgtcacatcccattctgtcttcccaattattacttgtggtactcagaattccaagaatgactcccagtgaccttgcctatggatgatcccctcccctttaagcgtgggaggaacctgtgaatatgaggagatattactcccatcattctgttacattacatggcaaaagggagatgatctgggttggcctcatcaaatcacatgagcctttgaagtcagagtttttttctggctgatagcaggagagtaagtcaggttcaaagcacaagggtgattcaacaccctgttgctggcttgaagatggaggggagtgtgtagcaaggaatgcaggaagccttcaggagctgagagtggtcctcactgctagcaagaaaaaggggactaccgtcctacaaccacaaggaactgaatttggctgacaatttgaataagctagaaagcaggttcttccctagatccttaagagcccaagctggcccacaccttgatttaggctttatgacacctggagcagaggaaccaggtgagcctacctggatttctgatatatggactgtgagctaataatttgtgttgctttaagctactacatttatggtaatttgttacacagccatagaaaaccacacatgactcctgccatcccgataccagttggggtggcaaggaggaaggagaggaaaattacatttctttacataattgcccttcaaaattagttgcccttttattagcaggacataactgtggttcattgtatgaacaacctcaactagatcatgggaaacatttctgtccctttctgttggttgtcccagtttctctgattattaccaattgaccaccagttctcttcatctggcaggtgtccaaatgatatttctccagaaagactcgtggcatggtcctggtaggaagttgagcaggggtatatgaatgaagctcaacttctttctccctagtccagcacattctaccaatagatattctatgtcttttgcttccagggttctattacccaggtagtggccattttaggagttaccagcagaactgcttatactccttccatcttctccaggaaccacttaatctgggggaaactccagcaacctttccaccccaaagagtggggatgctgttcaacttcactacctttcttctgccagctgaatggctctgtaactttcagactagatacgatcacagatctcagatttaggtcagctgggagattataaactcttcgttccacgaaaagatgacctctattattcctggtccttccttaaaactcttaaacgtggccgggtgcagtggcgcacgcctataatcccagcactttgggaggctgaggcgggtggatcacctgaggtcaggagttcacgaccagcctgactaacatgatgaaacatgtctctactaaatacaaaaaattagctgggtgtggtggcacatgcctgtaatctgagctacttcggaggctgagacaggagaatcacttgtatctgggaggcggaggttgcactgagccgagatcaagccattgcactccagcctgggcaataagagcaaaactccgtctcaaaaagaaaaaaaaaactctcaatggtaaaagttatcaaaccagttcagcctgtattgcccttgtgggaaccagagtctcaggccaagaattgggccttatttgaacttagctttagagaattgagcgttcttaacagggcaatattcctactaaaatctctgaaatatttgttatcttctaagagcaggaactcaattatgctcccatatcattgtgtaatatttttcctcttaaaaattcagttcataaatgtccaaaaaaagagatctattgtaactaagtagaattttatctgagtaaaacaaggaaggtcaatattggaaatctatcaatataatctcaccacatagacagattaaaggagaaaagccacagggtcatttctaggtgcataaaaaagcagtgtataaaactgaacactgattcatacttttttataagctcaaaaaaccaggaatagaaggaaacttttatgtaataaagagcatctacctaaaatttacagcaaacatcacattttaaaagcatttttactaatgtcatgaataagatgaggatgcccactatcattgctactattccattccaatggttgtaagaaaatgaaaaagaggtttaaggaagagacaagttagtgatttttgcatatgatattattaacatagaaaatccaagagcatctactgaaaaactaatagtactgtataacaaaacaaaatacagcctgtaatcccagcactttgggaggccaaggtgggtggatcacgaggtcaggagttcgagaccagcctggccaagatggcgaaaccccatctctagtaaaaatataaaaattagccaggtgtggtggcacgcacctgtagtgccagatactcaggaggctaaggcagaagaatcctttgaaccagggaggcagacactgcagtgagccgagattgtgccactgcactcccgtctgggtgacagagtgagactccgtctcaaaaaaaacccaaaaaacaaaaaacaaaaacagaaagaacaaaaaagcagtattgctggctggctataagatcaaaacacaaaaatgagtaattgtttcatatgttagcaataaccaaatagaaaataaaatgttacggctgggcatggtggctcacgcctgtaatcccagcactttgggaggccgaggtgggcggatcacgaggtcagaagatcgagaccatcctggctaacacggtgaaaccttgtctctactaaaaatacaaaaaaaaaatagccgggcgtggtggcaggcgcctgtagtcccagctactccggaggctgaggcaggagaatggcatgaacccgggaggcggagcttacagtgagccaagatcgcaccactgcactccagcctgggtgacagagcgaaactccatctcaaaaaaaaagaaaagaaaattttaaaaggtgtaatttaaaaacagcaataaaacttataaagcacttcagaaaaaagccagccaaacatacaacagctttaaggaggaaacaataaagcattattaaaggatgttaagagagacctaaaaatggagtgatatatcatgttcttatctgggaagaattcatactgaaaataagtcaaattagtctaacaatccaatgcaatgaaaagcaaaatcccaagaggattctttttgtgaattagacaaactggttctaaaagttaacatccaggaagagccaaaacaatactgaaaaagataaagagagcttttcctgttacatattgaaacttactctaaggtttactattctgttgcccagcaagtcctcttataggtatgcagcctactgtccgtgttgtttatggattcataaatttacagtgaatgtataaaacacagacttagtggacaggcatcaaattgatcattatcaagagaagggaggggaatgggataaagaataacagtgaaattttaattttttaagcaatgtttcattaaaaaaatttatttaggccaggctcagtggctcacacctgtaatcctagcattttgggaggccaaggcaggtggattgcttgaggtcgggagtttgagaccagcctggccaacatggtaaaaccccatctctactaaaaatactaaagattagccaggcatagtggtacaatcttggctcactgcactcagtgtgggcgacagagcaagactctgtttcaaaaataaataaataaataataaaaaaaatatgtttgatgcaggaatgacaaatgtgaattctgggtagtggtttctttttttctttttttgttcttcagagcagaagaacttgaggcggtggtttcttttgttgaatattaattgttctgtgaatgtttctgtatgtttcagtcaaacaaaaagttgattaattttcaaagtaaaaacaaaaagtctttgtattcactacttgctgggattttgctttttattttttactttatttatttatttattttttgagatggagtctcactctcactctgtctcccaggctggagcgcagtggcatgatctctgcctcccaggtttaagcaattctcctgcctcagcctctggagtagctgggattacaggcgtgcaccaccatacccggctaattttttgtatttttagtagagacagggtttcaccatgctggccaggctggtctcgaactcctggcctcaggtgatccactcgcctcaccctgccaaagtggtgggattacaggcatgagccaccatgcccggcctattttttacttttttattttccaggacagagtcttgctctgccgcccaggctcgagtgcagtggcgcgatctcggctcactgcaacatctgcctcccaggttcaagagattctgctgcctcagcctcccgagcagctgagattacaggcttgcaccaccatgcccgcctaatttttgtatttttagcagggacggggttttacatgctggtctcaaactcctgaccttcagtgatctgcctgtcttggcctcccaaagtactgggattacaggcgtgagccactgcgtccggcccggattttgccttttaaataacactattcagttccagatgtttggaaagacataaggaatttgaactacttctgtaattttagatggtctcataaatattgtgaaactcagcattctaaacacggtttctgagctaaatcttgtttagttttcaccatgctttaaagattagttgtggccaggcacagtggctcacgcctgtaatcccagcattttgggagggtgagacgggtggatcacctgaggccaggagttcgagaccagcctggccaacatagtgaaatcccgtctctactaaaaatacaaaaattagccgggtatggtggcacaagcttgtaatcccagctactcgggaggctgaggcaggagaatcacttgaacccaggaggtggaggctgcaatgagctgagatcgtgccactgcactccaacctgggtgacagagtgagactccgtctcaaaaaaaaaaaaaaaagaaagacaaaagattagttatgactaataaatacaagtacgaagtggcccttgggtcaagataagtctgttgtagacttttttttttccccttgagacatggtctcactctgtcacataggctggagtgcagtggcaggatcacaccacaacctatccgggctcaagccatcctcccagctctggctcccaagtagctaggactataggtgagtgccaccacgcctggctaatttttttttgcaatttatagagacagggtttcgccatgttgctcaggctggtctcaaactcttggcctcaatagatcctccagccttggcctcccacagtgctgggattacaggtgtgagccttgtttgcagagtttaggtcccagagaatataaagacactcaaagtatctcaacctcttggaacacctcttgggcatcaagaacaacgctactagaaataagcagtttgcctctagagaaacttcaagtaagcacaacaaagggcaaagtgacacaagataactgtggaatgcaagcaaacagcagcagctggtctgtatttttttaaatggcaaagtcacaaacaacagcaactgcttttagagtgagcaggtagtttgctttcttttttttcaaatggaactcactttttaagtgatgacatgcacttgggggtgggtaggtgtgagttcatttgtgttttgaaatcccaaattaatgagcatgataaaccgctattgctggccctgtctgactctctactctgagtaattggtgggttccccccaaccttctcctaaccctcaccctttttccctttccattgacttgggacagtccttgtcaaagtgccaatcacagtgggaaggaggagaaggggggaggtcacagtgcatgggattcaaggtcacagtgggcggagcaacggggatcaccaggcaagtaagtcaagttcccgctgctcaagtccagctgtctgccacggtagtgcaacccttggcggacgacccaggacgcgttgacgcggcagtcgcgccatctcttcttgcctgcatttatctgcgctgtttgaagccgtgtgacccatcaggacccagaggctgtctgatcacattattgggctgtctgctgtcttcgggttaggagatcctggttggcctgaagggaagaagatcagaggaagacctatcgaggatgggtttctcctgcttctcctcgggttggcgctgcccaggatccgcttcctggcctcggtgtactcggcttcccactgtgccagggacttgactggaagggcgggcctgctagcggacttggggctgctgaccacaccgttgctggtgggcctcttgaggatgcggacctgtggagggggtcccgggggaaaattatcatcctgaatcacaatgggcactttgggagatttgaatttcctgctttctgtgtgatcttcagttttttttccagacgtctatttccccgctgtctgccgtctcctcccagctctcagcaacctcctcatattccatcttactcgccactttccagatcgcttgctttcttatttccacattttctctgacttttgcagtattcaatattattacctgattctgatttttcagacatcactatatggtccttggctttttggtcgttcctctcattcctttgctgtttcaagctctgttcccagcctaagctttttaccaccgaattctgttctgtgacccataacttaaaactaacccaacttttcattccctccagactttttttggtaagcagtatcatcatgctttaggtggacactgagtcatactgctgtggtagtgctggtacacgtagttttgaataccaggttcttgagtgaatcctttttacttctctctctctcccccacccccgcttctcccttctgccttcatttctgacccttcttttctggttccattagaaaaggactaatcttatcagttctgcctttttttttctgctctaataattttgtcaagataattttttcaaagcacaaggccaatgagaagggggaaagtcggtccagaaggcagccggcccgactattctgagtttgaatctactcttggtggtcctgttaaaatacagtttgaagcaaatcacttgtttttatgcttctaatgtctactctgtcgaaagcccaaatttccttgcttggcatttaaggagactccaagttcttaaaacttcttcttgactttcatgcaagtcaaacggatttatttattgtatctcaaacagtcctcttatattttcctttctgtattttttgataattttcttgtgcctggaatattctctgcttttatttaagtctcaccatctttcaagacacaaaatatgtgtgatctctgaggcctttgtgaactgcctccagcatttactaagcaattaattctgtctctgaacttttatagcacaaacccattcgttcacttgatatttaacaaatatcaacctctatcacttatctctttttttttttttttcttctgagatggagtcttgctctgtcacccaggctggactgcagtggcgcgatctccgctcactgcaacctctgcctcccgagatcaagcgattcttctgcctcagcctcccaagtggctaggattacaggcgcccgccacggggcccggctaatttttgtatttttagtagagacaaggtttcaccatcttggccaggctggtctcgaactcctaacctcgtgatccacccacctcagcctcccaaagtgctgggattacaagcgtgagccaccgtgcgcagcctatcacttatcttttcatgcttacattttctcactgcttgagattttctttcatccagggtcaagcactgagtctattagaaaccccactgtatatgatctgatgaagatgagattatctttttaaaagccacatattaaatctcttaagttaataatattggcaatcaacttaaatcaactgagtgaccactatgtttaaggaagtttcctttctggtaggctgggaagcgggagaagggaaggatataactttataaaaaaaaaaaagctgcagaagggaaggatataactttataaaaaaaggtccttgttcacaaggagctaatcacttactggccagagaagaaacgtgttccttctttgcaatggctgtgtttttgggtttagctaactcaattctttatgtcctcaatttatgagaccgcatcaaaaacgtttttgccacatctctgtgggaaagtaggtgagtcagaatgagtgcataatatataagtatatattttaatgataatgaatgtgtagattaacaaacccaaactttgtttttgtttttttgagagtcttgccctgtcgcccaggctggagtgcaatggcatgatcttggctcactgcagcctctgcctcccgggttcacaggattgtcctgcctcagcctccggagtagagtagctgggattacaggtgaccgccaccacgcccgactaatttttgtagtttttagtagagacggcgtttcccatgttggccaggttggtcttgaactcctgacctcaagtgatccacccgcctcggcctacccaaagtgatgggattacaagcgtgagccaccgcgcccagccaaacccaaacattctaaaagcgcagagtaaccgctcccctccccgccaacggtaaccagcatcttcgttctccaaccagaacagctgtatgcaccggtgtataagcctgccttaagtgctatttttaatcttttttaaaaacaggccttaaaataactcatttgggtacaactccagcggctggtggagtgggcttaatatattaaacagctgttaattttggtttctttttggtaacagcgacacggagatccgcatttgtcgcagtttccaccgcgggcgggaagtgtaaacacaagaaatacaaacatagcgcaacggctaaaggagtgtcacagcgccaaaccttgctggctccgcgccaggccgagccccaccctctcagctcgcggccaacacccccaccccgcctcacagcccgccgcgcccgcggggcgacaccccccactccatcatcccggaggtggtgcggccgagccccggacccaattggcggaagcggggccggttgtgtgcgcgcgcacaaatgcccggatgcgccgcgacgacccgcgcgctcccctcgggcggtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgcttcggcgcgggaggtccggatgatcgcaggtgcctgtcgggtcactagtgtgaacgctgcgcgtagtctgggcgggattgggccggttcagtgggcaggttgactcagcttttcctcttgagctggtcaagttcagacacgttccgaaactgcagtaaaaggagttaagtcctgacttgtctccagctggggctatttaaaccatgcattttcccagctgtgttcagtggcgattggagggtagacctgtgggcacggacgcacgccactttttctctgctgatccaggtaagcaccgacttgcttgtagctttagttttaactgttgtttatgttctttatatatgatgtattttccacagatgtttcatgatttccagttttcatcgtgtcttttttttccttgtaggcaaatgtgcaataccaacatgtctgtacctactgatggtgctgtaaccacctcacagattccagcttcggaacaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaagttattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtggctcacccctgtaatcccatcactttgggaggccaaggcggaccgatcacctgagatgaggagttcaagactagcctggccaacatggtgaaaacctgtctctactaaaaatacaaaaattagtcgggcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaaagaaaaagattttagagaattagaactcctgagttctcaattttactatttgattgctactggtaacttgctcaccaaaaggctctaacagtttcactcctgccaatactgaatatcaccaatctttaattattattattattattttttttgaggcggagtcttgctctgtctcccaggctggagtgcagtggcacaatctcggctcactgcaatctccgttccccgggttcacgccattcccctgcctcagcctcccgagtagctgggactacaggcgcccaccaccacgcccggctaattttttgtatttttagtagagacggggtttcaccatgttagccaggatgatcttgatcccctgacctggtgatccgcccgcctcggcctcccaaagtgctgggattacaggcgtgagtcactgcgcctggcctcttttattattattactatttttttgataaaaggtactgtaccattgtttaaattcatttttctctagtttcttggtgaggctgggcacctttcctttttgtttttgtttttgttttttttgagacagagtttcactcctgttgcccaggctggagtgcaatggcgagatcttgtctcattgcaacctctgcctcacgggttcaagcgattctcttgcctcagcctctggagtagctgggattacaggcatgcgccaccacgctcagctaattttgtatttttagtagagatggggtttttccatgttggtcaggctggtcttgaactcccaacttcaggtgatctgcctgcctcggcctcccaaagtgctgggattacaggcgtgaatcactgcaccaggcctccattttgttaagtcatttatttcttctgggacttgcctagtcttatctgtccattttccttttagttttttaaaatttttcttagtaattggagtagctctatgtgtttcaagtatatttaacttttgttgtttactaatgtagcatttaattttatgttgtcttttccccattgagaacaattctgtgaagtaaaatttgttggcttttgaatttcatatcatgctttggaagaactctcctgtcccaagatcttgcaaatatattcctatattttcttctagatttaaattttttaaatatttagatcttcacctgtaatttaccttcttgttcttcaatgtaagattacaaatgctattatcttttatagctgttttctcattaatacatgtcttttaagtcactaatatactgatggctttccattacagatttttttttttttttttttttgagactgagtcttggtctgttgcccaggctggagtgcagtggcatgatctcggctcactgcaacctctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatctgcctgtcttggcctcccaaagtgctgggattaaaggcatgagccactgcgcctggcccacacctgggtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtgcatatgtaagcacagttaaaaaaaaaaaaagtgatcagaaaaattaataattcaattctatatgtattttaaatttttcaattgttaaataatatttgttttattgattagctggaaataggcaatttttaaaaatctgtttttaaggcatccccaatgggggtgctgtcagattttaaagttagacagaggaccggggcatattaaagagaggtgcagaggtaccagtttgtgtggtagtggcaagctgtaaagatacttgagttttgcagattttgataaaccaaaaggaagggagaaagtgcatagtatattacattcccctcccccatgacaattatttttctcaagaccatttgtaaaacctctagataaggggcaggcaaatgttagcctgtcagccaactttggcctgttacctgtttttgttttagtttttaaattttttttgtagaggtggagtctctcagtgtggcccaggctggtcttgaacacctagcctcaagcaaacctctagcactgtctcccaaagtgctggggttataggcaagagccacctctcccagccagctgcctttctttctgtaaggaaaattttactggaatgcaaccatgcccgttggtttacatagtagccatgctttttacttggatagaaccatttgtatgaaaagcttaaaatacttacagtctggctctttacagaaaaaaattgacccctaatctagttggcaggctccttgcatacaggtcatatgtcttatttgtaatttcttttgcagtacctaccactgtccagtgcatagtagaagctcaataaatgtttgtcaagtagatatttgaaatgtagactaactaagaggcagcatgatatagtaggaagaaaatgctgagttgtagttgagggacctgggttgttatctctgatctgttcttaattacccttgtcagcttgggttagttagttaggttctctagccttcaggaacctaatctttagaaagagaagattgataacaggacccactctaaagatttattcatttctctttgattctctaagttagcttgcaataagctcgttggatcagtacggtaagctcattggatctcagtaatttatggttgtttgtaaggcagtaagcaggtaatataaatagctgaaggaaaaagtaatctttgctcttttggattggatactgtctgtgatcacaactgatacttgatgattccatgatacttgcataatgattagatcctccccagcattttttccaaatcccctttattgaacttgatggatatgtttgctgcagggcctatagttctgggataattttggaagtataatagcagttcttttctctttataggttagaccaaagccattgcttttgaagttattaaagtctgttggtgcacaaaaagacacttatactatgaaagaggtaagctgaatcaagagataagtagtatctcactagttacatgtagccatacttaaagttttcaagaccatgtggagaaattggccatatagaaggatttttcattaagcagcaacatttaattttgtggtcgtttggactatattttaaagctgaaaattctaattatactcgagtttcatttctcagctaggaactcagataaatggaagccccgtaagggtgcttgaccattttatgctgtcaaccctttggtagactccttcccagaatcatgtttttaaatgtatgaaataaaatgtatagaattacaaaggaaacatactaaaatacggttaccaaaatagtaaactagtttgtgatatgtgtgcttttgttattaacataataaatactaagatttagaagaagatataataaatataatgtttttttgttttttgagacgaagtctcgctctgtcacccaagctggagtgcagtggcacgatctcagctcactgcaacctccgcctcctagattcaagcccttcttctgccttacccttccaagtagctgggattataggcacctgccaccacgcctggctaattttttgtctttttagtagagatggggtttctccatgttggccaggctggtcttgaactcctagtctcaggtgatccacttgccttggcctcccaaaatgctgggattataggcatgagccaccatgcctggccaataaatattatcttgatatagtgaggaatataagtcatattttgaaatgtttgccataagtacagtatgataggaaaacacctctgatttttgttggtgatgaaatcacaggtattaatactgttgtgatttgttgcctacatttataatcgaaggaaaagctaaattctagttagaagtttgtgaaaataagaatagaattttttttttcccatccaaattaatggaccccctgaattctatccaaggacttcttgggcatccctggatcccaggttaagaacttctgcactagagatacatgagtacagtatactgatctttctgggatagaggtgagctgattcatgaccatatattctatctaatggttccagcattttaatgcattccccacctttaaatttgtgcacagaagcatgattttcagtgacagattgagcaaccttaggcagaatttcagtgtgattgaaatatgcctgttctctgtctctcccacttagtttatgggactcagattacttaaaacatttaagtttctttcttacaacggtatagtggggcaggaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagtaaaaagagcgttggattaagagtcagaagagctggggccagtttcttcttcttttttttttttttttttttttttatgtgacagtttctcactctcttgcccaggctggagtgcagtggcatgatcactgctcgctgcagcctggacctcgtgggctcaggtgatcctcccacctcagtgtctgcagtagctaggactacaggcttgtaccactatgcctggctaatttttgtatttttttgtagagatggagtttcactatgttgcccaggctggtctggaactcctgggctcaagggatctgcttacctcggcctcctaaagtgctagatttacaggtgtgagccactgtgcccaacgcaatttcttcatttctaatacagtgataataatcttatgaaatatcagaatgagataatacttataaaagtacattgtaaactgtaaaatgccatatgtatttaggtagttgttaataggtttatatctggatatcttaaaaatgtattgccaacttcttgtcttaatgcagcacagggaatataatttaacttttattaatggttcaaagtcattattttgattatttatcataatatggagtaaattgataccttagagggtttatttcattctcagaattctctcaaactgttttgtagctgtcattgattgattgtttttctgtcttcctcctctggtgacctcagaggctattgaggtttatagtatttatgactatttactaagtggctccagaccactgccatattttagttgatttttgtttctgcaacttttttggctatcagttttttattttgctgccttttcccttcctaatatgttagtatctaagtatctgggcagagttaaagtctacaaggaaaaaaacctcacattttaaggtttgcttaagtaaatagagaagcagttatttctgcttctgtcaaattaaatggaaaaggcttaaaagtagcttttttttttttttttttttttttttttgagatgaagtctcactctgttgcttaagccggagtgcagtggcgcaatctcggctcactgcagcctccacctcctgggttcaagcaattctcctgcctcagcctccctaatagctgggattacaggtgtctgccaccatgcctggctaacttttgtatttttagtagagatgggaccaggatggtctttatctcctgacctcgtgatccatccgcttcggcctcccgaagtactgggattacaggtgtgagccactgcgcccagccaaaagtagcttctaagtacaaaatggttgttctacatagttgtggatatggttcctggttgtttacccctattcagataaataggatattattaaatgtatttacaactaacatttagttttctttaatgctcagaaatcatatttgtatttcaggttcttttttatcttggccagtatattatgactaaacgattatatgatgagaagcaacaacatattgtatattgttcaaatgatcttctaggagatttgtttggcgtgccaagcttctctgtgaaagagcacaggtaattcttcagtttagtccattgtaaaaagccatctgggctaacatttcagttcacctctaccctcattcacttttgtcagagaaaaactgttgaaacatattaaagacatgctgaaacttaattttttagctctgcggcatattatttgagaacctgagctctggcatcttataaaccagtgtttgaaacctagcccaatcatttactagttttgtgactagataaattaacctttttaaacctgcttccccatttataaaatagggataattaaatacttcatgtggaggttaaagctcttgaagagagacgttgtataaaaaagcatagttttgggcacatacaaagcattcaagtattagctgtagctattataactttttattccagaaacagtataccaccacgtggtaaaggcttacatttgagccttagttattttggagatcattttcattgtcacctatcattatggcacttaaccagcagaatttaacccaggtaatatttctagaaataggcctggtgcggtggctcacacctgtaatcccagcactttgagaggccaaggcgggtggatcacctgaggttgggagttggagaccagcctgaccaacatggagaaaccctgtctctactaaaaatacaaaattagctgggtgtggtggtgcatgcctgtaattccagctactcgggaggctgaggcagtagaatcacttgaaccaggcaggtggaggttgtggttgaggtgagccgagattgcgccactgcactccagcctgggcaacgagcaaaactgcatctgaaaaaaaaatttttttaatatatatttttctaaaattattcttttttttgtttgtttgttttgagagggagtcttgctctatggcccaggctggagtgcagtggcatgatcttggctcactgcaacctccgtctcctgggttcaagtgattctcctgcctcggcttcccgagtagctgggattacaggtgcctgctgccatgcctaatttttgtatttttagtagagacagggtttcacgatgttgaccaggctggtcttgagctcctaaccttcggtaatccacctgccatggcctcccaaagtgctgggattacagatgtgagcaaccacacccggcctacatttggaattctttgtcacatttggtttagcacaggcaatccgtgttgagccttagcattcattacattaataaatggaatgaatacgttcacctgagacaattaactagcttctgctagtatttaatgctcaatagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgtagtttgttaacaaaaggtatttttaccagtcatttgtgtattatgtgcaactgtgtgttttaacctagttatgaatatagtactatatttaaatttcatctagcttcttaatttgtattataatttgtatattatatattataatatacatataatataattatatatattacaaatatatgtataattattattttttattgatgagtcacttctgtttaatatccatatatgttgtcattttatacgtggccttggtatatatggtttaattttataaattttaaaaataactatattggtatattggtgatttctttacctattgaatattgaatcttctattttttttcttttttttttgagatgaagtcttgctctgttgcccaggctgcaacctctgcctcctgggttcaagcgattctcttgcctcagcctcctgagtagctgggattacaggtgcacactactatgagcagctaattttttgtatttttagtagagatggggttttgccatgttggccaggctggtctcgaactcctgacttcaagtgatctgcctgtcttggcctcccaaagtgctgggattacagacgtgagccactgtgcctggtctgaatattgaatcttcggataatgtttggaagtatgatttccttggacttgaattctaaatgttgagagataagaaataggagaaattactgacttgaaaaggatatgaattaaaaatattgtgggtttaggttgctgtatccttattcccaaggatgaaaaaagatagttgggattcatatttcctcttaatattgagtgagaaacaatattttgtgacaaacactctcttaaatccttagtttaaaaacaaaaggaaaaatccattgtgacatcaacgaatactggggtaaatgaattatcctcctgttaggatataaacttcatgagggcatatacatttctgtttcattctttgttttcccccgtgtctggtacatagtaccagtgactggtacgtggtaggttttcagtctgtatttattgaatgaatgagtactgctttatctgttaataagtttcttttttttcttccctgagtcggagttttgctcttgttgcccaggctggagtgcaatggcgtgatcttggctcaccgcaacctctgcctcccgggtttaagtgattatcccgcctcagtctcctgagtagctgggattacaggcatgcgccaccatgcccagctaattttatatttttagtagagatggggtttctccatgttggtcaggctggtcttgagctccaggcctcgggtgatctgccggactcggccttccgaagtgctgggattacaggtgtctgtgagccactgcgcccggcctctgttaatacgttttaagatcaagaaaggaagttgaagcttgatgaaagtcaagattataatcaaattcctatttaatggattttgcgtaactcaatagtttttttggcagtttgtatttaatggattttgcataactcaatgcttttttttggcagtttgctactaagcacagagctaaaaacattcctgtttgaaaataagtatgttcaacctcttcctgcttgcatactcattttttgggggtcttctggtaaagtccaaacaaagcacatttcaggaattggtagtgtgaaatctttcagctagagagactttagtaattattaaaagtagctgtacataatcattgtgctactaattattgtgcttttaagtgcctacaagcttgccaatgataaatttggttttgaatgtgtgcagtagttcatactaagtatgtatgtagaagtctggttagatccagcttaatacaaatttttattctaaaatgtacatctcttgttattttttttttttctgtctacaaggaaaatatataccatgatctacaggaacttggtagtagtcaatcagcagggtaagttaattttgagcatcatggataaataccataaaaacgttttaaagacatttttgtttatgtgcatatgttttataattgtgattctctttaaaagttgctttaattaaatattgtaataaaagtatgataaatttattagaagtacatatgaactaaaaccacatactgaggttctaatgtaaagttaaatatcctgttagatcaatttagacttgggatatcagagttaggatttattttgaaaggtctgtaatttcaaaagctcctgtttaggagtgatctaccttgaaaatgtattgaaaggctttgggaaataatattgttacctaggtaggaccatgtgtaaggatgaaggatgagtctttttctttggttatagacaaaattttgtttaccaatttgtggaagtggaattttatgttcctacttccgtttcttaactggttatttttgggtcacatctctctttaataagctgataaaagcattgggttcttgttccagaaagatgcacatgtatatatacatgggtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatttcgactcactgcaacctccgcctcccaggttcaagcaattcttctgcctcagcctcccgagtagatgggactacaggcgtatgccaccacgcccggctaatttttgtatttttagtagagagggggtttcagcatgttggccaggctggtctcgaactcctgaccttgtgatctgcctgcctcggccttccaaagtcctgggattacaggtatgagccactgcacccggtctcacagtttgcttttgagtgctgcttagagctgtctctaatacactacactgctcctaaagcccatcctcgaactacagttaagaaatgctcttaggccaggtgtgatggctcatgcctataattccagcactttaggaggctaaggcaggaggatcacttgagccgaggagttcaagaccagcctgggcagcatggcaaaatcctaactctgcaaaaactacaaaaatcagcttggtatagtggtgcatgcctgtagtcctagctactcaggaggctgaggcaggaggattttttgaggctgggaggtcaggactgtagtgaactgtgatcatgccatccagtccaggtgacagagcaagacctcatctcttaaaaaagacaaaaacaaaacaaaacaaaaaaacacctctcaggagcttgtttagttcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggctcactgcatcctccacctccagggctcaaatgatcctccccctcagcctcccaagttgctgggactacagatgtgctccaccacgcctggctaatttttctgtatgtttggtagagacggtgttgctatgttgcccaggctagtcttgacctgagctcaagagatattctcacctcggcctcccaaagtttaggggttacaggcatgagccactgcgtctggctgttgcacttgtttatatttttgttacctgtgtcctattcaggtttgcattgtgcatcacacactatagtgttttattaatatggtatttaataaatgtgttgaattgaatacttattcttccaaagttaggatttaaagcccagaaaagtatctccattttatcccaaaataaaagtagttattaggctgatgatttggcattttattgttttaaagctctttttttttttgagctttagattgtatcctttttatttcctttttttttaattattatactttaagttttagggtacatgtgtacaatgtgcaggttggttacatatgtatacctgttgttttaaagctctttaagaaattgtgtgatagctaaatatacaattgtagtatttgtagtagtagtttgagttttctgaagtatgtaaccctgatgtattcattccttcatttgtttaaataaactttggcacattactagaaaaattgtattattgagatggaaacttacaaattacttatttgcagtctgagtttggtttagatatcagtagaattaacttcagaactcctattccatgttctcaactttgtcacttttttttttttgagatggagtctcactctgtcacccaggctggagtgcagtggtgcgatctcggatcactgcaacctctgcttcccgggtttaagtgattctccttcctcagcctcccgagtaggtgggattacaggtgcctgccaccacgtccggttaatttttgtatttttagtagagaaagggtttcaccatgttgaccaggctggtctcaaactcctgacctcaggtgatcctcccaccttggcctcccaaagtgctgggattacaagtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtctggaatggcctttcctagccctattttcatattgtcctacaaaatatttcctgattctttgtttctcagacactccctgtccctaccaaaataatgactctcctgtctctctgctaatttatctaacagtcttttaatgtcttgattatactttactcttctacattaaagttgaattattttatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgagatgaattaacctctgagtttttttcattcgtgattttatttgatttacaaattgcttatttagcaatatttttctggctgactacagcaggcacagtttactgtgccccactggagtttatagttagccaactctctgttaagatagtaggaggtggctggggtgtggtggctcacgcctggctcacgcctgtaatcccggcactttgggaggccgaggctggcggatcacgaggtcaggagttcgagaccagcctgaccaacgtggtgaaaccccatctctactaaaaaaaatacaaaaagtagctgggcctggtggcgcacacttgtaatccagctactcaggaggttgaggaaggagaatcacttcaacccgggaggtagaagttacagtgagccgaaattgcgccactgcactccagcctgggtaaccgtgtgagacttcgtctaaaaagaaagataataggagacaggcatataaactctattttcaccattattcttagtcaccttaacagttaaatttttaaattgttatttttaataaatggtagtacatacctatgagttttaaaacagaaagtaaatagcattttagaaatgaagagataagggccgggcgcagtggctcacgcctgtaatcccagcactttgggaggccgaggcgggtggatcatgaggtcaggagatcgagaccatcctgtctaacatggtgaaaccccatctctactaaaaatacaaaaaattagctggatgtggtggcgggtgcctgtagtcccagctactcgggaggctgaggcaggagaatggcatgaactggggaggcagagcttacagtgagccgagatcacgccactgcactccgcctgggcgacacagtgagactgtctaaaaaaaagagagagagagaaaatagttgacagagagaaaatagttgagaacagttagtagacgtagtagacgagaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaatttgactgttaatatctgtattacataaaaagtcttcccaaatcaataaggaaaacattaaaacttcaaatagcaaaaagggcagacagttcacaaaaatttctcacagtaaatacgaatgactaataaatatggggagagggtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagcttagatggcctggtgcggtggctcacacctgtaatcccagcactttggaaggccgaagcgggtggatctcttgaggttaagagttcgagaccaacctggccaacatggtgaaaccccatctctattaaaaatacaaaaattagccaggtgtggtggcaggcgcctgtaatcccagctacttgggaggctgaggcaggagaatcgcttgaacctgggatgtggaggttgcagtgaaccaaggtcgcaccactgcactccagcctggggtacagagtgagactccctcttaaaaaaaaaaaaaaaagaaaagaaaaaaaagtcttagagttcttaacattatcctagtaactccatttctagtaatctatcctaaggatgtaataaaaaattcaaagatttatatgtagagatactaattacagcattatttataattgcagcccggccaagatcacctttttaaaaatagggaacacaaacatgattaagaactcacgtgcagaacttgtgatctcgataaaacgtaaaaatcccggccaggtccagtggctcacgcctgtaatcccagcaccttgggaggccgaggagggaggatcacgaggtcaggagattgagaccatcctggctaacacggtgaaaccccgtctctactaaaaatacaaaaaaaattagccgggcacagtggtgggcacctgtagtcccagctattcaggaggctgaggcaggagaattgcttgaacccaggaggtggaggttgcagtgtgccgagattgtgccattatactccagcctgggggacaagagtgagactttgtctcaagaaaatgataaaaaaagtcctttcagaaatctgtgatactatctcattttaatttttgtcattctcatgggtgaaaaatgatatcatttcactttgcatttctttgatccctaggaggtaagagtttttttttctattactcaagtacatgactcaagatttttcatatgtttattagtcatttgtatttcttctgtgacttgctttttcctgtttccttaaaagaaaatacagtctatcttgatttggtaggactttgtataatatgtatactatgggtaatttttactatatatgttgcagatattatcttcgaatttgacctttgccttttaacttttgtttggtattttattttgtcatgtaaaccttgacatggtctaatcttgatagtctttttattgaggactttgcagtattatgaaatacttctccaccccagcattataagaatattttgttataggtacttgaatggttttgttctttatatttagatctttaatccacctggaattcatttttatgtctagtataaggtagtattctcatttatgtctaacggatttgtctaacattctgacccattcagagataatttattatttaaaatgaaatggaaactttttactggttttgatttctgtttaaaatatagggtactgaagagccgggcttagtggcttaggcctgtaatcccagcactttgggaggctgaggcaggaggatcacttaaggccaggagtttgagaccagtgtggccaacatggtgaaaccctgtctctaccaaaaatacaaaaattatccaggcatggtggtgtgcacctttaatcccagctacttggaagctgaagtcacaagaatcacttgaacctgggaggcagaggttgcaatgagctgagaatgtaccactgcactccagcctgggtggtcgagtgtgactctgtctcaaaagaaaaagtgtagggtactgaagaaattgaaacattaagaataccatatgagtaaattaaacactttggctcttttcggaaaaaaacagatgagctcttatattttaaagtttggttttgacagaaaaaaattcctagattttttggttaataaaaactttattagatagattaaattgtgatgtatggagataaagttctgaaagaagaatagaaagctttttaaaaatagtattctcagcctaggcaacatggtgaaaccctgtctatgcaaaaaatacaaaatggtgcattcctatggtaccgttcctatggtaccagctactcgggaggctgaggttgaggtgggaggatcacttgagcccatgaggcagaggttgcagtgagccgagattgtgcctctgtactccagcctgggtgacagagcaagaccctttctcagacaataaataaataaacaaataaataaatacacacagatagtgttctgctgtaacagttggacagattcaataaaacagtgttaacttttgaactaattttattgaaactaagtttctgtacaaataggtactcaaaacagctcaattttctaaatcacagtacagcaatttattttttttccttacatatccagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggtaatgttctcattttaagtaaggcaagactcttactgttcaaagtctagtcctggcagtcctaataaggatacggatagaatgtacatgtgtcttacgagattgatagaaaacacagtgctaaattttactttaaaataaaactactatattgatctccaccttcaacccaaggtattgtgagaaatgtggaaaatagtggagtaacaccggtattggtaaaattagtagtagtattagtaattatcaatgtcactgtatgtattagagaatatttgtggaccactgcaccaatagtacagtcaaataaattggagtatagagttgtttgagaatttgagagttacactttttaaaaaaggaacaaaaccaaaaatttggttcagttaaatattttagcattttaaggcaaatttgactatttagagtaaaaatatattttattacagccatcagcaaaaaagtcagcatagtctgaacttaacatttgccaaataggtctagacatcaggtaagttctatttacttatgctgtaaaatacaggtttatactgggctgggtgcggtggctcatgcctgtaatcagtactttcggaggctgaggcgggtggatcacctgaggtcaggagttcaagaccagcatggccaacaagatgaaaccatgtctttactgaaaatacaaaaattagccaggcgtggtggcgcatgcttgcagtcccagctacttgggggcctgaggcaggagaatcgctcgaacccaggagttggaggttgcagtgagctgagattgtgccactgcactctagcctgggtgacagagcgagactccatctcaaaaaaaaaaaaaaaaaatgcaggtttattattgcatggatgacgggagagtatcagtactttctcattactaatacagacttccaaaatattagtgagcagcatttcttaagagatgtcactgaaagaagtttggtaaaaaatttttttgttaacaagaatgcttgacaaatggaatattttgttttgtatgtctttaatcaagcttgtccaacccatggcctgtgggccatatgccaggatggctttgaatgtggcccaacacaaattcataaactttcttaaaatattatgatttttttttttacaattttttttctgctcatcagctattgttagtgtattttatgtgtggcccaagacaattcttccaatgtcgcccacggaaaccaaaggattggatacattttttggtaatatggcagtgtctcatggccattattctgggtattagtaatcattgtatagtactctagaagatgtaggaagtggaaccaattgtgatagtaatcctagtcttttacctattcttgttacttcctgtattatctttttttctcttccaaagcagtgattgtatgaacgcatacctgccctctagagttactgtacctaacggagctgttacttatgtagaccgctagatggcatgatgagctcctgctcagtctgagagcaggttcttcatttgtagatatttaagtttataccaaattccatacagttgagatggcactgcagatacagtggtagtcaaggtagatatggttcttgccttcattgggagatagatcattaatgacaaaaatgaaaacatttaataaatccagtggaaaaaataggctcttgagcggaaatatatgtgataaaattgaatccaattaaaacttgatgagtatccaacctacaagtttggttaaaaagagaattattataccctatttatttatttattgagattgagtctctctgtctcccaggctggagtgcagtggtgcaatcttggctcactgcaacctccacctccccggttcaggcgattctcatgtctcagcctcctgagtagctgggattacaggctcccatcaccacacctggctaatttttgtatttttagtagagatggggtttcactatgttggccaggctggtcttgagctcctgacctcaagtgatctgcctgccttggcctcccaaagtgttgggattacagatgtgagccacctgcccggacccctatttaatgtatagtttttgttaaagttatatcagaattctagctgaatgatatttagagtccttgttcctgctttgtacctgggacactgccttgttactgatatggctttgaggagtagaggaacaccaggttttttgttttgagttgaattagataaaacgacacggacacacgtggagtggttttaaggagcagagcgtttaataggcaagaagggagaaggcagaaggaagaagctcccccttacacagacagagggaggggggctctaaagctgaaagaggagaccttacattctgacaatactagccagttttatgtgacggctggagggggtggtgtcttatttgcatagggctcagaggattggtttgaccaggcatgtcatttagccctcaagaaaactggccctcccaccccagtcctttaatacacaaatgcaggatgccatgacattttacacacggggttatgtgggggcggccatgctgttaggtacctgatggagcaagggcaagaggacaacggtgggaatcgccatgttgggtggaccctcttgcatttgcatcttaaaggttgccagcctttaagagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttggaaggcccaggcgggcggatcacctgaggtcaggagttcaggaccagcctcgccaacatgttgtgaaaacccatctctactaaaaataccaaaaattagctgggcatagtggcgggcacctgtaatctagctactcaggaggctgagacaggagaatcgcttgaacccgggaggcggaggttgcagtgagctgagatcacgccattgcactgcagcctgggcaacgagaacgaaattccatctcaaacaacaacaacaaaatctcgtttttcaggttaagtccctagttgtgaaagcttttggtagggccagtttttttttcttcttcgttttaatttccctcatttgagaatgttgtagtcatcattgggtgtcatcattcaccagtttgtgaagggagttaaaggaaagtgcattcctctcccatcttttctttctttggggtttaataaattgtgggaaactaagactgtgttctagactgtacaccatgcagtttatattatgatcttctgtcatctttgcagcctcagattccatttttagctaagactggggttttaaataacttgtttaaggttcctacaactaattgtcacaattggaattcaaacaattctaggtatttttgactacaaagatctaagatctttgcagagcaagcctatctgatgcttaaaaaaatatatattttttaaatttttgagacagtctctcactccgttgcccaggcgggagtgcagcgcatgatcatggcttactgcaacctcaacctcctgggttcaagcaatccttcctcctcagccttgagagttagctgggactacaggtgtgcaccaccacacctggctaattttttttactttttttttttcagagatgagatcttggcctgttgcccaggctggtctcaaaccgctgggcttatgtgattctcctgctttggctcccagagtattgggattacaggcatgagccaccacctccagcctgatgctttttaaatatatagtatttaggtctggtgcagtggctcatgcttgtaatcccagcactttgggaggctgaggcgggcggatcacaaggtcaggagatcgagaccatcctggctaacacggcgaaaccccgtctctactaaaaatacaaaaaattagccgggcgtggtggcgggcacctatagtcccagccactggggaggctgaggcaggagaatggcgtgaacccaggaggtggagcttgcagtgagccgagatggtgccactgcactccagcctgggtgacagagcgagactctgtctccaaaaaaaaaaaaaaaaaaaaaaaatatatatatatatatatttatatttaaataatgtataaatatataatatataattataaatctattatatattaatgtatattatatattacattgttatatatatttatataattatatatttatataaatataaatatatatatttatataaatataaaaatataattatataaatataaaaatatatatttatgtaaatataaatgggcaggcacctgtatatattatatatattactatttatataaatataaatatatattttaaatatttattttatatattttaaaaatatatatagagagagataatttaatagtttctggggcattcttttgcgaacattagccaaaactttaaaaaccactcccaatattgcattttttcatggtattttttatagtatttttatagtatcctaggacaggagttggcaaactttctgtaaagagccacatagttaattatttgggctctgccgggccatggtttctgtcacagctactcagccccgctcttgtaatgcaggagcaactgtagacaacaagtcaacaaataggcatggctgtgttcaataaaactttatttataaaagtcgatgggtgatgggccacagtttgcagacccctaccgtagagtatgttttctgagatttaatgtttcttgtgatttacccccttattctaaaattagtgcactaaagactttagttagttgaagtatttggtttgttgggttactttgttagtgttaattgtatcctaacttgacttgtgattctaatctgattggtagtagagcccttgttaggaatttgagctgcaacttgatgaatgttgcttttactctccttcctaacattactctaaaaaagtcttttgatgtcagaggctgtaaaataatatactttgtttctgtttttaaaactgatacagatatggaaatcatttaatctaagctccttttctagatgaagtagctacagcctttagaagttaaatgatatgggctgggcgaggtggctcacaggtgtaatcccagcattttgggaggccgaggtggcggatcactagaggtcaggatttcgagaccagcccagccaacatgacgaaaccccgtctccactaaaaacataaaaattagccgggtgtggtagtggacacctgtaatctcagctacttgggaggctgaggcaggagaatagcttgaaccccggaggcggaggttgcagtgagctgagatcatgccactgcatttcatcttgggtgacagagcaagactcttgtctcaaaaaaaaaaagggccgggcatggtggctcacacctgtaatcctaacactttgggaggccaaggcggttgaattgcttgaggtcaggagttcaagaccagcctggccaacatggtgaagccctgcctctactaaaaatacaaaaattagccaggcatggtggcatgcgcctgtagtcccagctacttgggaggctgaggcaggagaattgcttgaacttgggaggtgtaggttgcagtgagctgagatcaggccactgcactccagcctgggtgatggagcaagattccatctcaaaataaataaaataagttaaatgatgttgtttaaggttaaattagctacttagtggcaagtgtagaataagccatatcccgacttctagactttttccaattgtagccttctgcttatatatgctcctacccttagccactgacagcaaatattattgccctgaaggtcttactaggttcttatacaatttattgaagtcctgaaacgaagaatcagatgagcagctacagaattttttttaattgtctaaaggctctttaaaagaaaatctcaaagtttattaaaaaacataagtatctatgactcgagacatttttctaagaaaaaaaacccataagtattacaagtgttgtgtcttgttacgtgtattctaccaatttggacatagaaagatgagtgacaggttttagctcaaagtatatataattcagatgagaaacatgcctgcaaaattatgttttgcataatttatgtgtgagactatataattcattattatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgttttaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtagtattttttttcccctctaattatattggaaaattattaaatattttctatgttcattgactttgagattgaaataatattattcagatttcacttgaaatctttacctcttgatttgtttaaactaacacattggtttgtggacttgaggatttcatagttctttatcatctgatttatattattatattactactaattgccaagaagtcaatagacctcaatgaacatgcttattataatggtctgttcacttttaaaaacatataattcaactactgttttaatattaacttactttctataaaagtaaaacatgcatacagttaaagtcaagtagtacccttagagatctgtttcccagaagtgactgcctttaacatttctagctatttccctattatttaatatctccatattagttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgttattttggaaaatttcagtgtatctccagtatactcatcacccagctttaactattaccaacattttgccaaccttgtcaaacgtaaacttttttttttttcaattgagatagggtcctgccctgtcttccaggctggagtgcagtgatgtgatcatggctcactgcagcccccacctcccaggctcaagtgatcctcccacctcagcctcctgagtagctggaataacaggtgcatgccatcacaccccagctaatttttgtattttttgtagaaatgtcaccatgttgcccaggatggtcttgaactcctgggctcaagtgatccacctgcctcagtctcccaaagtgcaaggattacaggtgtgagccatcacacccagccaaatgtaaacatttttattactgatttgtattatagaatgtggtaggatttgccattaaagaaattaacacttaaatgtttacatctcatgcatacttcactgagttcctgaggtattataggtttttttaaaactattgtgctttagtttttgttcttaatattgcctttattatatttgaataggaaataaattccattttttctgagttatagacagttactaattattcaagtgcaaaaaaggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaatgaatagtctatctttattgctcctgtcttaacatcatttgtgaggcaatctcaaaatggttacggaaatacctcttacttaagagttttcacttgttaaatgtcctcaggcaagaaccatgcttcagctaaggcaagaagataggttatgtaaaaaggctggggatgtgggagagtttgttatccaaattgcatggtggaaaggtttgtgggataaaacgttgggaaaaggaagaagcattgagcagttacaaagatgagaacacaggaaaggatagacaggtaaaggaaaggatattacggttagtgaccaaggatgataggttttagcagcaatacttgctgtgaaaaatgttttagcatttctcttgtggatggagttagggaatactcagttaagccatggttttagagtacttctaaggtagttctagtcactggtggattaggaagtctttctcgaggaggcaggtttcatctagattgatgggatggactcttggaatagcgcctagggttgagcctttaagggagtggatataggctgcatgacagagtaaaagatcccatagacttgcttcaactaaaggaagcaactgcatttgtatcctgaaacagataactttataggtacatgattaatatcacatcacagttaatatatttttagtttagaatttttcaggatggtaagggtgaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccattatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactctttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcatatatttgggtaacaaaaggcacaagtctgaatgtgtttctttttctggaatggccatgcctgcccactttagaaatacaaatatcactgggcagcttgaagcagttgggagcctccaatgagagcaacttgagagaatgatgttgcaagttagtaggagtaagaaatgctgtgttctccctgtcttctcttaggtcacatggcagcctggcctaagtgatcgtgaatggtctataagggaggtagctgggacagggaggggagtttgggctagccaccgtaccacttgtcagcgtgaaaagtaagattgtaattgcctgtttagttttctgcctcatctttgaaagttccaccaagctgggaacctcttgattgtgaggcacaaatgtaagtacatcagaaaaaaacaaaaaaactggctttaaagcaggagcttgtgggcccctaagccagacggggactagcttttggcattatataattaagattttttaaatccttaataagggttttattttatttttatttattttttgagacggagtcttgctctgtggctcaggctggagtacagtggtgcaatcttggctcactgcaacctctgcctcctggctgtgttcaagtggttctgcttcagcctcccaagtagctggggttagagcaccctgtcaccacgccccgctaatttttgtatttctagcagagatgaagtttcactatgttggccaggctgggctcaaactcctgacctcaagtgatctgcccgccttggccccccaaagtgctgtgattacaggcgtgagccgccacgcccagcctaataagggttttaaagataattagtgtgtaggtctgtaggcttatgatggtaaccacaagttgttaatggcattgtgaaaagtttttagttgcgctttatgggtggatgctgaattacattttgatttgatacttataaaaagaaaaagtatttcttcagcttaaaaaattgtttaaaagtttgtgatcatattgtctaccatgtagccagctttcaattatatgtaagagggactttttgacatttacaaataatactttgaggtagatatctgaaagcaccagcacttggaaggtgttcagaagtaacaaattataaaatgagctaacaaacgaaaggcaaaataaaaccgtaaagcaagcagatgggaggcgtgttcagtaacttattcataatgcatctgaaatgattgctgtactcaaatatttaacgttagagtaatagtattttgaatgaaaaccatagttgattgtctttagagagaggagtggtactgaaacatacttgaattcgtattgctttcctttaaagctctcctttaaagactttaaaaaaaattcgataggcattttcatgtttcagtcctacaatcccacatctctgctgccttcagaatgctacaacttagatgtccagccaacagcttaaagccaatttataaaaatagcatctttcctaattccaaaatttcaccttttgtttgttttgttttgagatgcggtcttgctctgtcgcccaggctggaatgcagtgctgcaaacatgactcactacagcctcaacctcctgggctcaagcaatcctcccacctcagcctcccaagtagctggggaccacaggtgcaagccaccaggtccagctaaccttccccccacctcccccgaccccgctgccacccgccctgagacagagtcttgctctttcacccagactggagtgcagtggtgcaatctcggctcattgcaacctccacctcccaggttcaagcaattctgcctcagcctcctgagtagctggaattataggtgctcgccaaccacacctggctaattttttttgtatttttagtagagatggggtttcagcatgttgtccaggctggtctcgaactcctgacctcatgatccgcccacctcggcctcccaaagtactgggattacaggcgtgagccaccgtgcccggcctaatttttgtattttttgtagagacagtttcaccatgttgcccaggctggtctcaaactcctggggtcaagtgatctgcccgtcttggcttcccaaagtgctgagattacaggtgtaagccaccacgccaagcccaaaatttcaccttttaaatttattccatttattttgtaggtgaatttcatttatttctcagggttaaattttagcgcttttgcctgtgtctatttttggttcacacctccccagcccactgtcctgtattaagtaggccttccttcaagatcacagtaatatctccctaaatggatttcactacgtttggtcctatttttggttcagttatagtttacagataccatcatgttgcttccctgatttaaatattgggggaaaaacttgctttttggattttatctctgatgttctactggattattttagacttttagaacactatgaaatgggtgcttgcttttcacttttcaaaccttttttgcttaaacaaagttcataagcttattgtagtgggaagttcaaagtcacagatctggtacttactcgcctagtgaccttagagacaataaatctatagagcctagtatggggtctggcaggtagtaagcacttttaatgaatggaagtttaatattctgtttgcatccactcgaccataatcaccccaaatccagcttaggtagccttgaattaacccctactccaccttgaagttttttatttgttttttgctgagacagggtctcattctgtcacccaggctggagtatagtggcgcaaacatgactcactgcagcctcctgagtagctgggaacacaggcctgttgccaccatgcctggctaatatatatattatatataatatacatatattacatatatatatataatacatatgtgtttatgtatgtatgtgtgtgtacattatatatatatatatactttttttagaggcagagtcctgctatgttgcccaggctggccttgaactcctgggctcaagcaatcctcgtgtcttgaccttgacctctcaaaatgctgggattacaggtgcgagccactgcatctggtgaattaagccttttttatacactcaactctgaggtattctgttcataccaatatgttcctttgtatcttcttgccatagcaggttgtaacatccttttgtatctcctttctttttttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcctggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgtatctcctttcaaatgtcaaataaatacattgtgtatacagtagtaaaggatgttgattggcattgaaagcaactatcaagttcttgttgatttagaagacaaaaagacaattttaaaataacatcctgggccaggctctgtgactcacgcctgtaatctcaacactttgggaggccaaggaaggaggatcacttgaggccaggagtttgagatcagcctgggcaacataatgacaccctgtatccaaaaaattgtggtggcatgcatgggagactgaggtgggaggatcacttgagcccaggagtccaatgttacaatgagctatgattgcgccactacactctgcttaggagacagatggagacttgtctcttaaaaaaataaaaaataacagtatgttcattaaacattaatctcactgattgtgattttttgtttgtttttttgagatggcgtcttgctctgttgcccagggtggagtgcaatggcgtgatcttggctcactgcagcctccacctcctgggttcaagtgattctcctgctttagcctcccaagtagctgtgttatttcagctaattttttcatttttagtggagatggggttttgccatgttggccaggctggtctcgaattcctgacctcatgtggtccacctgcctcggcctcccaaagtgctgggattacaggcattgagccactgtgcctggcctgattatgattttttaaagtccccccccaaattattgtttgtgcaataaatggcaaaaaagaagcattctaagaaaaaagtagtcttaaaagttgatatggtgtcagaattgtaagagagagggtcttggctgaaaagcctttttagaaaaaattgctccctacaaaaaaggccttttctaccttttctcacatttgtttctttttataggaggcatctgagaagaccaaatctcttcaaagttaagctttttgtttttttgggggggacgaagtctcgttctgtcacccaggctggagtgtagtggcatgatctcggctcactgcaacctctgcctcctgggttcaagcaattctcctgcctcagcctcccgagtagctggaaattcaggcgcctgccaccatgcccagctaatttttgtatttttaatagaggcagggtttcactatattggccaggctggtctcgaactcctgacctcatgatccgcctgcctctgcctcccaaagtgttgggattacaggcatgagccaccgcacccagcccaaagttaagcattttttaaccacaaggtgggaggtggaagtatctcgttggaagactaaaggtgtccactaacggtagacccttttttttttttttttgagatggagtttcactgtcgcccagactagactgaagtggcgcgatctcggctcactgcaacctctgccccccaggttcaagtgattctcctgcctcagcctctagagtagctaggattacaggggtccaccaccacacctggctagtttttgtattttcagtagagacggggtttcaccatgttggccaggctggtctcgaactcctgacctcaggtgacccacctgctttggcctcccaaagtgctgggattacaggtgtgagccactgcgcctggccgtttttttttttgttgttgttgttgtttgttcgtttgtttgttttgagacagtctctcactccaggttggagtgcagtggcactatctcagctcactgcaaactctgcctcccaaggtcaaatgattctcctgcctcagcctcccagtagttggaattacaggcgcatgccaccatgcatggctaattttttgtatttttagtagagacggggtttcaccatgctagccttgaactcctgaccttgtgatctgcctgcctcggcctcccaaagtgctgggattacagacatgagccaccatgctagccttgaactcctgacctcgtgatctgcctgcctcggcctcccaaagtgctgggattacagacatgagccaccatgcctggcaaatttttgtattttcagtagagatggggttttgctatgttagccaggctagtctcgaactcctgacctcaggtgatccagtcgcctcggcctcccaaagtgctgggattacagatgtgagtcactacgcttggtagactcttaacagcgctgagagaccactccaagagagcagagaaataatagttctattctcagttgtcaaacagcaaacaaaaaacccttggctggggggtgatggctcacccctgtaatcccagcactttgggaggctgaggtgggtggatcacttgaggccaggaattcaagaccaacctgggcaacatggtgcaaccctgtcttaactaaaaatacaaaaattagccaggcgtcatggcatgtgcctgttaattccagctgctcgagaggctgaggcatgagaattacttgaacctgggaggtggaggttgcagtgagccgagatcccaccactgcactccagcctgggtgacagagcgagacttcgtcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcacttt

SEQ ID NO: 527 - DNA, 145982 bp, Homo sapiens
aaggagatgggagacctcctacttcaccctgccttcagtgacagcgcttctcattttctttgccttctgctttctgatccacgaagtagaagtgagaaaaaaaaaacttcacaaattaatatactattggattatgctgccacttaaatggctaattgtaatacactgtgagataggctaaattaggaatatgaagtgccagtgggaaaacagatgaggcaacctgtcagcctccccagggagaggaccagtggtggaagctttccagggttaggcttggaccctgaaggaggaatcagggtgtgccatgcaaatatttaagaaggaaggccatctccacggaagagactgacaaggccgatgcctttgcctttgcctgcaaagctgcaacactgcctctcttcttgggctaggaaacacccagcttctccttcactggttttggaaggcaggcaaaaagcaaaacaaaaacaagaaagaaccaccagagcacacacctttctaggtcaaatctcatttcctaataccaacaacaagtttgacaccttttcattaccagccttggacttaaactccaccctctctccagagtgggagtggacccagatgagcaacccaatcgcttattctagggtctgggcagtatcccctactcagttccatgtttgatttggttacggagggatcgtcattgagccagtagcatcaggacctctgttccacagccgctctttctacaagagtctatgcactcctcccctagaaggacaccatctgccagcaggaggaaacctcttttcctgccactgtctgccctggtcctccttccctatctctgaggcatctgcaatctttcatgcctggctctctagcctagatagttctagaacactggaatatattaaaacattcatacacacacacaacttctttcaacagcataagaacctaatgttgaattttcttgaggtttttttttttttttagctctcctgataattgctcatgtgtggacatattaagatcatcattccgcactagtgatcactatccgaaagtcagggaaaaaatcagactgtcaaaatcaaaacaatttcaagtaatgaaggttttgggtataaaatatgtgtttaagggattttgtttaaaaatacactttggctgtcactttaaaaagattcgaccagggaagaaaaaccactatgcatgatatggaagtagaaatttattataggaattggaacttgcacaattgtgggaagagcagggaaggtaaaattctgaaaagtggagttaaaacggtagagaaaagccacagacgactcagaacttacagtgattcctgggagccagcacgtcctgctgccggagtgggacctcaaagcctatggaaggttgttggttcttcaggtctacggcctctgtgaattctcagcaaagcatctggtagaaggcctggtagaagacctgggacaaggtcaccatcaggagggaggggggtgcgaggacaaacaggaacctgctaacacctctgtgtctgtttctatcaccaacaggtgctgataaccttcagaacatggcagctgctttccttctgcctcccagaactcacaacttccctttggaccaactccaatctgaaattatgtagaaagggagagtctgaaaaacatagtcccaaacataaccaagtagacaatagaacaatctggcacattgattggtattttgacttaaccgccagatcaccagcagctcattgtaggcaggcgcaagtaaatatctcacctcaaatgcaacaagtacaaaatgaatgcatcatagtgtcccaggcttccattaaacaaaaacaaataaataaaacaaacaaaaagcaatcttttatccctcagctttattaatgcataactaacaaataaaaatggtatatatatttatggtgtacatcatgacatttctttccgtgtatacaaaaagcaatctttctgagtactgctcagttaccactacctctaagtgatcctgtgtattccacaccctaagtgtccatctgaccttcctcactgccctgtgtcccagcagtctctgccttctatcaagctttcctctttgctttcccgcattaatgaagtgctcctctctcttgccaccctgcctccaatctcgccctgctccaaaccttccattaaaccacatgaatctttctaaaatgtaaaattctgcttattttacttaaattattttagtgactccgtatcacctatcatatacatctttcttggtgtgatatgaaagacccctcatatatattctgacccccacctacatttttagcccctctcctgtcctaatcccaaatgcactgtgccccaactattttaaactatttgtaaaaccctgattataggattatgtcaacacaggagtctgtgtgccttcctccccttgcaaatacagttgcctgacaaactccttctcatcccataggatttgactcaaacatgaccttctttgtggtgtcctccttgtttcctcaccttctcccaatccccaaagtcagtccataacattctcctaacagtggatagcatgtgccatgctgtaccaggtctgctgatttacatgtctgtcttctgtgctagttgtgagctcctcaatgttaaggaccacatctcattcatctttgtagtcccagacactaacacttcccaggtgcatggtaggggctcaataaacatttggttaagaaattaattgatgaatcacaagatctgacatgtttaaatattttattccatatttatagctgcttccatacaaattatgattcccataaaacataggtttacatttaccaaaaaaaaaattaatttgggggtaatccaatacatgtacatggccaaataatgaaattcagtttaaatcttgaaatggccctaaatcatatgacctcattgatcagattaataagattatttctaaatctcaatttcaccagtgatgtttaaacatatttttgacctgccattggaatacagaacaacaaaggaaacatctggttgttcttaactttggggagacaaatccatttgttaacagtagcaataggagagctgacagaacctgataacagctccaacacagggagctcagcccacaacagatggaccagacacttcagggaaagctttaaaaagatgtcttttctaattcaggttatacactccttgaaagttccttcaacataagcatgaaagtttgcagatgattttatcaggtctgacagcttttttctagaggttagtttgcaattgcctctcgggaatagtttggttgaatttcactggattttgtaagtaaaggcaggaatgtttctaataagtcaacaaactgaaagtcctaagcagtttgcatcactgccaactttctgagtgcgacccttggctggtcagagtttgtctgtgttcttttttttttttttttaataactcttcatcagctaaccaaggttaacccagagttattgctatttcttctacatgttttggacatagtttaatagtaattatgtttaggctctaatgatgtaaaaaaaaaaaaaaaaagaaagaaagaaagctcaaaccctggccagtgcaaaattattggaaagcattttaatacaactatcttaatcatatttctaaatatgttagtcatgtataatagttacattgattctaatcaaactctccaaacattctatcccttttcaatgccataagacctatatattccctcttaaactgttaaattttgtagccatttttaaatggtctaatttacttttggactcaccaaataaaagatgcctaagttgattattaaatcattcctattggaatagaataaagtacttaatcatatttggacaaggcagtagttaataagaaccacacactgaagtactttctaatataatgtccccttacatacactacaattagtaaattgtttggtatattggctttaaatggactggcttcagtaaaattttggttgatacttaatattttttaattattttcaccagactttggaactgttttcatagctggagaaactgatccacaggggttaaataccaaagcacacatcaagttagccataaaacctagaattgcagtaattacacaaactcacacactcacagacacatttttaaactccatccttaatgaaatgctgatcgatgaaaaaaaatcactttatttttcttggcacattattttccaagataggttattttagtgtcaaagtttaaattaacagatggactggataagttcatttggaaatgatgctatagtatgctgcataaaaatgaaaattttctttcccaaaatttaccagaaggtaaaagacagagaaagaaaagaaaaataaatgaacatgactttggagatagaggcatcgataggtcaaagagttatggaagcagccttccaggactttttggaagtcttggccttaatttctcatcttccaagaggacagagattctccaaaatatcctctcttaggacttctcactgcctgtcatctggtttttcctttatttctcacattccctaggttcccaaaggagagatcagaaattgagaaaacagaggcactagagaaggaacattccagtccctcttcacatcccacaggtctgagtcctaggcacctacagcccaccacttaggccagcttgactgcctaggaccctggctccgacctgtgcagtgttctacagatggacagcatagcacctttggcctgcactgcaacatcagtccccaatgatcaagccagcagagaagtggccatgccttaggttgtggctgactttgcagacagagaaggaaaatgaaagagtgccttaagttctacttctcaaaaaaaaaaaaaacttttgggtactaggcttaatagctgggtgatggaataatctgtacaacaaacccccatgacacgagtttacctgtataacaaacctgcacatgtaaccctaagcctaaaataaaagcttaaaaaaaataggtctactgctcccagttaaacgactgcatcattcactacagaaccggagacaatttaaaataattataacagaggccgggcacagtggctcacacctgtaatcccagcactttgggaggttgaggtgggtggatcacttcagatcaggagttcaagaccaccctggccaacatggtgaaaccccgtctctaataaaaatacaaaaactagcatggtggcgggagcccgtaatcctagctactcaggaggctgaggcaggagaatcacctgaacctgggaggcagaggttgcagtgagctgagatcacaccttcgcactccagtctgggccacaaagcaagactccatctcaattaaaataaataaataaataattataatggaagtgcagtcattctggaaagacacagacttaagacagctgtgtgactttggataggttacatgatctctctgagcctcatttccctcaatgtaaaccgagaagggtgatacctattctggagttcttttaatgaggatgtaagcagagctccagactcatgatgaatacatggtacacatttaataagtgacagctaaatacattatacctttgcctgattttaggagagaggtcataagctggatgtgaaaatgaaccaaatcactaacaaaattgcagcaccctgttggagacggtaattttttcttaatttttctgcctacaatttcctaggtcttctaattaacattgtgatactttagcttgtagcctagcagtcttgttcttgtcctcaatattaagtatgctcagtcatatttttagataacttaacattgcatatttatttttagacagcccagccacacataaatgaccaatacaaatcaacataaaagcagttcatatccaaagtgcccagttttaaccctctgtagctggcagttccatttttaacgcgaagtttcctaaaatgtataatctataaaactaattttatagaaaattgacactgaagatattaagaaaaatcaaagcattttgtggtcaattaaattggggagatggtagggtaagcaaagttaagaagggtttttttggtttttggttcggttttgctgttttgttttatcacatgaattttcaaaaccttcaacattcgaacatacatgacatagctctaaaaaggtaataggagtcctacatttccaaattttatctgtgctcagaaatgacattaggtgacattacctgaattcttctattgtctttttgtagagacatttgccataggcacaataataggggtgatggggcaggaggaagggaaaaacagagtgaaagaaggagttccagagtaactactctttaaggcagggatcacagatcctaatgcctacaggagaaagtgaaatcaagatcagaggtgggccagacacaacccaagagaagatggtaggtcaatggcaaacagcagatcatatggtctttctacctcaattcacacttttaaaaacattctgtgcacctgtatatgtctgtgggccctattcaccatacattgcaagcatgaagcccctattcttaggagactgctttcatttttatttcaaaaacagcaccaacttcaagagtgccttcaaagacccaaattttaatgtgttaaagggagggaaaaaaagatagagcatattagagcaggaggtggctgttcctctgtctctttgtcacagctatcactagacccatctcaaagttaagagatgggatcctgtttgtagttcaacattatgttatccacaggtggatggataagacctgcttatgcctttggatcatttatattttaccagacactgttccatgtgctctacttgtagctcctcattttatcctcacaataaccctatcatgatccccatttcacagatgagacacgagagagtttaatccactggcctgtagctacacagctagcaagagacatagctgggattgaaatccaggttgtttggttctaaaactcttaactattatgctcaactcagtcttggagatgttgttcccaatttgaggggtctatcagttttaattgctttcagctgcaggtgacagaagtcccagctaccagtgtctagaacaagttttgtttttgttttttttccacaaaacaagaaatctggaagcaggtgtctactggcagtagggctgtacctcagcaatgtcagcaccaacttctgcatgctggtcacaagatggttagttcttcactgggcatcatatatgaaatcaagaagcaagaaaggaaaaggggtggcaccagccttaaaccctttcccacaaggccccatcagacttcaacttatacctcattaccagaatgacatcacatggccatgtctagctgcaaaggagtctgggaaagcaaatatttctcttttcaagccccaagagtggaggcaggaacaggaaaatctcgttgggaacagatgctggcttagccagccaacagtgtggaccacaagagatttggtttggttaagaaaataccaacagaacttcatcatacagtgtatcacccatgacatgaacccaaggaaagttaaatagcaacaattaaaagtttgctgcaaaaccaaaattgaattatagaactcctattaccttttaaaatatctgtttccattcatttccaaaaatctgaaattatctgtaaacattttcccaatcaaatctgtctaggtagtgtgtaaaaattacttgaccttcacacacccagatacttttagttatgctattgttagttatgttatttcataaaatgttatctccttatttacagttgataaatgaaatgatgattttcaatacagtttcaaaactggattgaaattttgttagttattagaaactagaaagtttcagtgctgaaaatacacaacgggttgtttgtatttatcatctattttattttccagtttgcattggcttttctgggtctttctacaactttaattgtaaattttttcttttatatttttatcatggcactcaaactcagaaaacctgttaaggcaactacataatgtgatctaaaaatccagttaacatattgctatggaaaccaggaaatagaaacagcactctaatcattcctttagacaactatggctctgtgtgtgtgtgtgtgtgtgtgtgtgtgtgtgtgtaaaactttttaaattcattaatttattcatcttttattgaaagctgttactgaacccaaaatctgtaattgatctgtccataaataggcccagtgccttattaccagtaaattagtgttttttaatgagctatagtcattgataaattatgccatgccgtatcaggaaatctccagtcaggccgcgttgtttatttagcctgctgaggcctcttggtatggtgtgaaggacacctgactgggctgaaagctaagttctaactttgcccctcttactaaccagctatgtgactctcctgggaacttttagggactcagtttctttacctgcaaaatggttcaatgcaagactttagtaacgtaatgggaactttccttttccataaaactggggaatcaagaggtaatctcttttgaggactgaaatcactcttatgtaacctctggttacattatcatttccaagtgcctggcacttgggaaatgataactattcttactacatttttctatgtttcattctgtagtaaataagaactgaacctgcatagtaactgttattttaacccatgactttcaataacgaagatatctatgtctcattatctattgccatgattgaacaagttggtatgagagccggaacgaactcaagttctaaccggcaatgcccgttccttagatcctattacctttgagtgttcatttactcttgtaggtgccaatttttatagcgaaatacaaagttatcccaacacaattactcctaatagagttcaccgaggccccaaaagctcttttttaaaaatcatcataagatttcaacattcaagaattaaacttttgttctgttgtgcttattcatcgctatttgcccagttatttaatcagcctgcttccggctatggaaaaaaaaaaaaagaaaaaaagaaatggaagtctcctcagggttaaactcctctgttgttcttccttgcagaaatttgagttattatagtagaggataatcgttgcataatgaaatcattgggacaattcgtccatccacttctacctccgcctctaacaatgaactccttgtttctgcggtgcccaaatctctctaaacccgggtgggcgcggggcggttagcggagacgtgggagaggccgagagcaaagctcgcgcccttcccggggtcagcgagcggggtgccaggagggtgcgcgccctgcatctgagcccggggtgacactcgcctcccaagcgccaggagggggagactcggtcccgcttatctccggctgtgctaacttcagactgcctgagctgggggaggagagcgcgcagccagggcgagaaaacttctccacctagaaagtttcaccttgtcgtgggcggggcagaggcgggaggaaacgcgacccccgcggggccaggcgcggcgcggacggcaggaagggcgggggccgatttccctctgggtggtgccagtccccacctcagcggtcctcggaacccgcggactaggggacggacagcacgcgaggcagacagacacgtgctggggcgggcaggcgagcgcctcagtctggtcgcctggcggtgcctccggccccaacgcgcccgggccgccgcgggccgcgcgcgccgatgcccggctgagtcactggcagggcagcgcgcgtgtgggaaggggcggagggagtgcggccggcgggcgggcggggcgctgggctcagcccggccgcaggtgacccggaggccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaaggtaaaattgcagcccctttcagatccagtacccaatccctcgcctcaggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatgaagatgatctgaaaatgatgtacatcatgtttctctgtgctacagggacataaattgcatttttatgtaaacagtgtaagtggtgcttggattatttacaggtacatagctttccttccttgatctaagctaattgagctttgttttgaacgtgtaaacttccataatggaacataagtgaggtactttggttcctatcatttgcaagtctgtggtgtattcaatgttcattctttttgaactgctgaataacagagggaaaatttacatcattcataagaaattttggtagtacaaaaatgtgtctgatagcctataaaatgtactgctgttttaaaaattctattccgttttcaaacttaatggtgtataagctatagttattaacttaaatatattttgcttttaacatgatggaatttgtggcatatagaagacagtctgccgactactgctttttcaaaattgctttgttcttgatacatggcagtaggggtttacattagatgtatactacatgctttcaaaattagttgatggagtttatcttcatgataaaaaatgtaccagattaatcatagccagtcaatacgaaagctcataactaatattttcactacttttaaacctataatagagaaaaatgaccctttgctaagcaggagaaatacccatattttataaattccttttaagactatgtaagtatatgccttgcattaatcttgaaatctttaaaaaaaaattgtcttaatgagggctagactaagaaatacatttcaaaaatcaatttccttagctgtttttaaaatagtgtttgaagtagcattagtcatattatccttctgcagatctacataatagtctcaaattaactttttctcaaatgtggtcatctcaaaacaacgtgaataactcagaggagctaacatcctctaactggcttattttctccaagtggctgcaccaaagacatggcaacacccccatggtgagcacagttcctcacacattcagattacctcccatttctctgtcctcttcctcctcaaccctttcccttggtttggtcagagctgctttcaaggccttccgtgcccccatttctccagcccagtttgctcgtttcttctttaggcattaggcttagtgattctcgccagagccatctacgctttcttttccgtggtctaaatccctaagatttccttggtctgctgtgtttattcataggatactcaatttcctcattgtgccctcttaaggggagaaaatgtatgtagaaactcaagtgtccggaagtgagccttcttttcctggctggtgtatgctgaaactagtgtttttgacaccaagcccttagggcagagtttcttcatgggttttgctcagtgcaaaataaatagtcacttctcagtaataaatgatagatacactgactaatgttagttcagaatcactttgatgatgtgttctcaactgacactgagttgctgctagatccacatttgcctgaccaaaaatagctaggacctataggtagagtatcatatgtgctaggtactacagcattttctttaaaagaaagaaatggaatctgcccttgagaagtttatgatctagatacacagacaaatatcacatattaaatgaacacaaattcataattattaagaggacatcacatgagaaacgctttcaaaatcatcctatttgctatgaaataatagaatttttttttaaaaatcaaagtttggaacttaaaaaccttaacattttcaagctgtttctgcatacatcacctttctgataccaaaacgaccttacaagataggcaagtctgataacatcttaacattcttatgttatagacaaggaaactgagcttgagactagctccatgctatttcaatagcaccataccacctttcctcagccatcaactattggaaacattttccatggaggcatcattagggatgcttaagatagtggtaaatgatgaatataacatatctagtccctggagtttttgtcaccttctctttctccagttctctctctcttttttttttttaatttcttttcttttctttttttcttttctttgtagtgagacataccgagaaaaggtttcattcatatgtgtggggcattctgctcctgttatcagattaagagccgtgaataattttgtaatctatccttctatcagaaagcccattctcagatatcttttcagctgtgttaaacaggttagtatattccgcttgggatttgtttcaataaaaacatccagtaaaatctgactactttgcttttcatgggacaaaatgaaaaaagtgcttttataagctgtaaaacttaattgagagaaaaaatcacgtgtggcatttgtagcaggaggtatgagctcagtgaaataaaaaagttaactttgtaatcacatacccaggtacacatatttctctctgtgattgcataaatgtgtgcaagtatgtttatgtaggttactcccattgattttaatttctataataaattatgtagctatagggcccacaggcgattatataatgggcaatagaatttgaaaatgtatctctcctaatataattaaggatagcaattatgaaatgtgcttagagaatcacaagttatcgtgaaagccaggttcctgtactccaagaatgtgaatgaggatttagtcattcattcaggacaattttttgacaacctacgaggcatagttctaaaatctggcatttccacagagtataaaacagatgaaaacctctaacctcatgacactctgttctattgagttggcaaacaataaagaaatacataactgaaatgtgttgtatgtcaggtgatgataatagcttcaaggtagaataaaatggaaaagagaatagtgactgtcaaggataagagagagtgggatggtgattgaaaaactcaatagtgaggtcagggaaggcttgtcttcaaaggtgggctttgggctagaatctgaaggagataaggaagtgagccaggcgcatatgaggagcacttctcaggagtgctattctcatcttgtttttcctgaaattgtgcagttcacagcttgcacaactgtccatagactccctgattttggagggagatacctgaatagtgcccctgtttttgtagggaaatacctggacagtgcctgccatcattagctaccatgttaaagatgaagatacaggagtggcccacatctcttggtttatgagacatggaagaagaagacccagagtgttgttttgtttttttttttgtttttttgttttgttttgttttgttttgttttgcatccgcctggtcccatcccatactccatcctctatcagagatattgctccattcagacaattttccttcttattttccacactgtgagcctgtcacagtgggatttgttgagaaggatacccatggcttttttcactgatcccttccatagtataaatctaaagacagcaagaggcagttgctgatggtgtgcagcttctgtctgctatgcacttctttctttccccctcgctctccttccttttcctttccagtattaagtcactgcattggattttcttcctcttttcttccttttcccttattcccctatttatatcctgtatcaagatttgcaaacaggtaacttaaatgaggaaaactaaccatttcactagggattgacaaactgcttaggaaaagcagaggggcagtcactgcttggcgtgattagagctgttgtgaggctcagtgtatggcatgggcccatgtggtagtatctttcagattttcaagagaagctaggactctcccaattttaaaatgttgactcagtgtctttaaaacaccatacagcttacagtggcagaaagtctgcaagccagattgggctcctgatggtcccaattgcagcagcatgcatggcccgagagccccaggactgcttctacaaaatattttattttctaaaattctcagaaaattaactaaacaaattttttaaaaccaatattttatgtcagttcctattggcacgtggttatttttctaaactcatcagcccacatactttacatcaaactatgtacgtttctaaactaaagggtaatctagttatttcattcttaaactgaagtagtagttttctgaaacctgaatccatcatggctttatgcatcaatttcatttccaagttctctgattcaggataaactccccctttggaatattgtctttctctctctctctctctgtctctctctctctctgtctctgtctctggaaatgactgaacttcacccgttgttattaccctgccattgaaattcaaaacatgcactgccctcctggtttccagtgccctttaaaagcaatcagatcagtgttaaaatctatttttccaaaggaataaaagctcacaggttgtgcactaatttgtttcctttaatcctaaaatctcagtgaaatgcccaagctagcagccctccagaaggccactgtgttagaaagggagattatgtactgtatttcttcctactattttaaatgcaaatataataatatatcatgaaacagtgcacatacagtatacatattaagatcagtggtctattcctgttttgaaatggtctcctactccttaatagttggaattctgaggcagcacctagactctcaggtccaatttgaaaatgtatgtttttttttaaaaaagaatgacttggggaataactgtttgataagaccgtggaagatttctaatttttaatattttattaaaaatgtaaagaaagacattcaaagctgagacctttgaaataatatggtctttgcaagtcagagaaaaagagaagtggtaaatttattagagataggttgcctcctttgaggcctaatcatgtgggaaaggaaaacccagccaaggtttgggtccataagacaattcaacctagctttaaaaataggttttggctttgcttgggaccagcattgggaccagagtgtatctagaccagcattttagctattaaattttaaacctaggggtcttttaagggaaatttaatccatgtgtctttgattcactaaatcttaaatcattactcacaaactgtatgtccctctaagctctttgatgtccaagagatctctaaaattgtgtaaggcctttttgttccagaaaaaaataggaagttggtttttgctaagcgtcaataaacagcatcctcaaaaatctgattaggtctaaaatcttgcaaccatgacagtatggatgtttgaatgatgcaatgtgaaaattttaagcactttttaaagtccttgtttaccagtaatactcagttgtaatccttactaaccccaaggaaattattttgacacatttcctctctgttttgtaatataaatacaaagcccaaatattcatcattttattctggcacatagtaggtactcagtaagtattttgtagagtgttgaatgactctttcttctgcccagaaacttctagctaatgtcagttcttctattcaatattgatatccatctgtcataccttggaataagatctattctaagtcagtgaccttgttcgacaaatttttaaaataagccatctaactaaatatatgacatttattgaaattcattttgcaccatgaagcaactgccttgcaaagagtgctgaaaataggaaggaatttctagactaatttgattaaatattcagttgttgccatatgctttctgaaaattgattttcccccttttactattcctgtcatccttcctcccaccttgacatgcttactgattgaaagctatgcacagaaaaagggcaggtcgcttgtatgtataagcaagagcagcaagtccaaacaggcttagaaaacgtaatgctataatcacgagttgtcataatataggagaggggagagaggaatactcagcaataagagtggtgttgggtattgctccaaattacatggatgacacatctttgaactctattgtgtcgggggaaaacaccttcttgctgtagttagatttcctgtttgtgaatgtgtattttctggtaaccagacttcctatatgaatttgacatagctttaagtgcatttcaaatgacatgattaaagaatggctgctttggagacagcagctccttctctcttaaagaaataaactatcatgctaaaatataggcattgagatctttcttgataccatattgtgaatttctaatggctcatcacatttttatcctcagaaaacctttcctggtgaaaagcatgctgttttagtatcacatttggggtgatggaattggcaatttcttatatcttgagggggcgggggggtaaaaggaaaattgtgttaatagggtcttaaaatagagattctcttaggttaacctgaagatttactaaatacattatcattacagcttgttttgacatttaattgtagatggcactgtatcagcactgacttatttatacagctttgtttagacatgcctaatttttatttcattggtggaaccaaaccatcagtaataaatcatatatcagtgtttttgtacacattcgtatttacatgacttttaaaattccaatgtaaaggtctcacaacttgaaaaatgaatgaatgcctgagtatttgaacagttgggaaaatgtagttcaatttaagaaagattttttatgacaattcttatgccatatatagaaaatagataataaaggagaaggcctggaggtttagatgggatattggatcaatgagcaaaggaaggggaaaggtgggcgggatatgctgaagggtcatgggcttgagtgcaccctaagtcataaagagggtgtcccattaagaatcaggctgcctgaattctaagtaggaaagaggcaggtcaaaatggtgtataggccaggcacagtggctcacgcttgtaatcccagcactttaggaggccaaggtgggtggatggcttgagctcaggagtttgagaccagcctgggcaacatagcaaaacccccctcttaaaaaaattacaaaaagtagctggacatggtggcgcacacttgcagtcccagctactcaggaggctgaggtgggaggatcacctgagcctgggaggccaaggctgtagtgagccgagatcataccactgcactccagcatgggtgacaaagagagaccctgtctcagaaaaagtgggggagggagggtatggaataaagtaaagctcatgggaaaatggtacctttaccattttcccaccttgggaaatggtgggaaaatttagacattgctttacaaagtctaaatttctgccaacttgtgttacatgtggtttgattctggagaaagatagactatcatctatccagtcctaaattgggcctcttagtctgtcctcccctcagttaccaggaagaatagcaggaatatgtcacagaagcagagaaagcttttattctgagtgtcagaggcatgttctaagcactctgttatctactcccaggcactctaaatgaaattccattttctctgaggaaatcaaaatataaaaagaaaactcaggcaaatttataaaggttttacaccattttcatgactgaaatattctagcatatctagctcattataatctataaattcctgttgggaccaaaagttatggccctaaaacctgttatctgtaatccttttccactgggatattgtctctggggatatatattagctttccttgaggatactaccttgaaaccatttctttggtccttgactatacaaagttcatactagcatggatgtaggaattgtatttttctattctaaatacgaatttagacagtgatataaagattcaaggaaagcttctatcaaggcctgccttcactacttgtcttttggctcctctgagggtcttaggtgagccactttcatctgattctgccctcacttcaggcagaattcatatggctccagccaatggctacactgtccaaagtgagactgtggtctcacaaccatctggttaatacaaagacagcaagccaatatgatcacttaggacctaggcaaacctttgggcttaaaatattaccttagctattgttgtttttaatgagtatcaaatagtatgatatttgtaatttgtattatgtaaagaagtaaccaaagcagagattgttgacaaaaaaaaaaacttcctcctaacataaatgaatatgcattttggacttttcaaaaattccctttctgtcttgtcaaaattaagatatttctaaattttatttcggtctcactaacacatacttggattattgttcattgaaatctgtacgtcaaggcccagtgattttaaacattcttttggtcttcaaagaacttaccaaaaaaaaattgttctttaaatcaccagaaaagtgcagataaaatcccagacagtttcattaatgacaatgaaaggtgacagcccttgaatctatgtcataagttgattaattactttccaaacattattaaagatattagacgaataacttagactggtatccaggatcaaggttccttcataatccctaaatgggttttaattttcagagttagatgatcattatatgtgatttatttctttaacatctttagactgttggctttattgaaaagagaggagagtatctgtttcaatgtgttttcttttccctgaagttattccttgcagaattcaataaaaccggttttgaaataaaaataattaaatgctggcattttctgttaataagggcccatagacctgatgaattatataaacattacaaggaatttaccactgagttcataattatgtaaccatttaatgcccaaacctgcctactgacagtgaagacgttcaatgagaatggacattgtgcattaggataaggatgacctggagtgaactttcattcttgttttggttctttcccattttgcccaattcatagcacctgattctcttaaccagcaagtctgtttgcatgtctccagtccaatttttcgccatgcccactgcagtgattccaaactctcaccatttcttaagctcttgcatcttttgggctctccttattctcagtataagatctttccttatagtttagagagtaaacacaagcccagttgtttccatgtcacccattattacctctttctgtctcaaaggatgaaacagtcttttctacctaagtcttgaccctgttgttccccacacctgtgagcacctcctccctctatcctacccaccttacaactcttcccgtgtttaaaatctccctcaccatttttcttttttaaaaaaattatattttaggctcagtggtacatgcgcagatttgttacataggtaaactcgtgccacagggtttatttcatcacccaggtattaagcctagtacccaatagttatcttttctgctcctctccctcctctgccccctcaagtagaccccaatgtctgttgttcctttctttgtgttcataggttctcatcgtttagctcccacttataagtgagaacatgcagtatttggttttctgttcctttgttagtttgctaaggataacagcctccaattccatccatgtttctgcaaaagacagaatctcattcttttttatgtctgcatagtattccatggcttctctatttttcattcacctcttactcaacttactgattcttctagaaagaaataaaacacacacatcaggcatcctgataggatcttgaatacacaatttccttaagtagtcactcctgttttcattttagcctttaaataatgaattcttgaaaataaatgtctaactcagtttctctactttcttcattcccattcattcttaagtcattcaactcaagcagtctgtaccacatgcccaagaaagtgtcctcattctaatcaccagtgccctcctcatggccagatctgatggacactggtttttatcccttttgacccgtctgtagaatttgacaccatacattttatttctcccttctcgaaagttctccttagcttatctctccacattttctttgcctacaattgttctttttaccctttaaaacataaaggttagattctagtcttctgtaaggctccatctgaattcctcctttctacttacaaaacacattcacaagtgatctcacttcagtgacttccaatacaccgatggacgagtggttcacaaaccgctctctctcacttcctcttttctctagaccaccactttcatgttgtcagctaccttacagactccaccacttagatgaccagaagctacatcagggttattaactcaactaattacttttaccctcaaagtctcctctccctattttccttaccttggtttatgatacccagatagacaattttttagccattcttggcttttcagtctcctctacaatcaaaatccatattgaataattcccacataatttttctcactttaatatgtgtataatctagtccttcctttctttccataatgctagaaactttgttcaggaacattcttttgtatattgattgattctgttgtccattcattcaataaatgcttactaagtgccatgtaatgacactatgctaagggctaaaagtggagcttacactctgatgggagacacagataaataagttactatatagtgtggtaaaggctagataaggggaagacaggtttgatgtttgagcacataggagagttcctaattccttactagaaggtaagagatgcatcagagaaggcttcccagaactgttccctaagatgaggcttgaagagagaggacaacttatccatgtgaagttgagggcaagaatatccataaagagggatccacatgtgctgaaacccagagtggctgagcacatggcttgcttcaagaactggaagagggcagagtggccagagcctagatttctaatggtgtgatggcaagaggcaagactggagagtggggcagaaaaaaatggtatgtggtttgtaagctctgccaaggggttgacattttttttcagcaaagaagtgacatagtcaaattgtcagtttagaaagatatctctggtatgctagggggcagatgatcagggtgagaatggagagggaagaccagcgaggaagctgttgtagtaatccaggtatgaagtgacactgccctgaccatgggcatggaagccaataaggagatggacatgtttaaaatatttgtaggtgggtgtcaaagatgatgtcctagaaatatgggacatgttcagcactgaggtaggatacagagagggagaccaggttttgtgggagtagatggagataacagaaggatatccaactgctccttcttggtctcttgtcccatctgtctttgtctcctgacctattagctttggtggcgccatcactcagtcctcctctcttcattctctacagtccctctcctcggagatcccatccactctcatggcttttcatgatgtctacatgctgacaacttcttaatttaaatctctagcccagacctttctccttaaccccgggactcaaacatccaactgcatgcccggcatctccacttagatgcctaaaaaatgtatgtcaggctgagtgcagtggctcatgcctgtaatcccagcactttgggaggctgaggcgggtggatagtgaggcgggtggtggtcaggagttcaagaccagcctggccaacatggtgaaaccccgtctctactaaaaatacaaaatttagccaggtgtggtgatgtgtgcctgtaatcccaactactcaggaggctgaggcaggagaatcgcttgaacttgggaggcggaggttgcagttagccaacaccacatcactgcactccagcctgggcaacagagcaagactccatgtcaaaaaaataaaaataaaaaaacctccattgtgggcaaaactacattcctggtctcctcatatcctacaaacatgcttcaccaaccagagtctgcatgtcggtaactggcaaagccattctctctgttaaaaaagtcaaaatccttggcatattctcctttttttctcacatgcctcagatctgactccatcagtaaatccggatggagttcgatctgaggcatgtgacaaaatagctctgtcttcaaaatagaaccagaattcggccacatctccccactctccccttccttcctggcccaggccaccagggtccccctcctggaacaccactggagcctcccagctggcctcaccactccacctttgccctgaactgccccccagccactagcagtcttctctcccatatgatcgaggtgaatacattccaacataatccccccttgttcaacaccctgcaatgactccccatttcactccaataaaaacctgaatctcccaggggcctacaaggccttacatgctctgcttctttgtccttttgatctcagctcccggtcaacaaagtccaggcttactggcccccttgctgtgcttcagacacaccaggcacatttagttcttccttcttgcctctgcccagaaatctcttttcccatctcagacatctgggtccacaaaagccaccttcccaatttccgagctacaaacctatccccatacctctcctccaggcagttctgatgccccagccctactttttgtttttccctgtaacacacatcaacttctgaaacactacatcatcagcttgttatgggtattaattgttgtccccagctaaaaagtaagttccacaagagcaggggtgttgggttttgtttactgatgtatcccaagcatctgatgcatagtaggaccccagtaaatacttgtcaaatttggtcttaaatagctgttgcatagacaaaagtgatattggagagatggatttcgggattctctggagatccttcaacaaaacatatcagactttctttaatgtggccacagcctaatcttatacctttttccactgtcaacccagcccacctggcctctatgccaattgcagcttcctggacaaccctgcatcttctccccaggtgcccgtgtgtgagtccactccacccaaagtgtctgtcccctacctcagctgcacctgagcagctccaacttatcctgcaagacacagctcaagtagtatcccctctgaaatactccttggccccgctttctgtctgcatagttagctcttctcccccgtgctgctccactgacatgcgcacacctttacagcacagcctgggcgtgttgcaggtggaaggtggagattcccagtcaaggggcaacacctgtatggttggaaaagttgtttgttttaatttcttgccctctcttctctcttctatttctttcctctcccataaatacacataccgcctatatacacacaacctgccctgaattgttttccttgaattgatgagttacgtaaatgcaatcctaagcacagttgttttcaggttgtcctaaccttttgctttattgatttttcaaggatccagagtgtttactgagtttcagaaattggattctgtacttatttttctgtactatcctagttttatgagaatctatttgctcagcattctctattcttttaaaagtgtttaagatttttgtaaacagttttgtttggttctttattttctggtgacatattgatctcaacataatgctattcatatacttttaattcttcttccaacactgttaggattgcattatgttcacccaaggaatccacatctgtacaaaatgtggccaggtttggctattccttcacattcacagtattctcatgatttctaacaattcttgtctactttgcctaaataagaaaatgtcatatactgacaattttgatcgtgaaaaagagaccttagttcataccagtgtcagagtctacttgcaaacattgatttccaagaaaatttctcaggtgtgagcaaataagcaaaataaattcagacctaagagaaaatagcactacaaggaacgcccagctcattcaaacgctctgcattttgagactagagggggcttggcctttggcaccctcacacctctcccctttgtctctctgtccctgggtgctgatttctctttctttgtgtgacagccactgtgaaaagaatggggttcactcaccacctgcattcctccacagccatttgatatctgctttcgataacagcagaggaaactgatcagtcatataaatccaatcctgagcatagttcctcgtttggaattgtaccatgctttatgccgaggacattttcaaacacggagggaggggatgtctgattcattcgtgagtaatgtaccagcttcctctccaacttgtctcccttcagtggttcacattctgactattcagtcggtttatcctttccaaacccagtatttgaatgcaactggcaaaggttgattgcctctttttttttttaatatatagacttggaaagatgtttctcaaatgtgatttgcggatttatgttattcagtcttcctggattaattgaacaaaaactggtaacactgctacacagtctgaatcacaaaattatgtccatccatttggctgaaaaatacgaaaacaaatacttgtataagttttcatgcattttagcactttctttacattggggaagttcaaccttcacactttcaagggcaatgaaacatttttgtctgacctacaatttattaatgggacaaaagcccatctgtcaatcagggctctgagagttcaatgtattttctgaacaatattttttacattatgtacaatggtaaaaacaaatgtccatttattcttctttccaagaagttgagtactttcaaccattcttaaaaggacaaagatgtttgctgacagaatatgaatttataaaggataatcttgaggatataatggcattctattctttttatctttactcttgccatatcagagttggataatagtctcaatcatatgttacaactagaaaatgcacaattggctttttcttatgctaacaggcagccattttcaactttttaaatgattataggactaagaggggatgcaaaaacagataagaatctgaataaaagcactatctgtcaaagaaacaacatttgtgtaataatcaagaaaccgtttagagcaccccctggaaacattaattataacacatgcaaatcattcctgtacaaagcttaacttgtttatctcctatagccacctgtatttgaattttttaataagctcatttattataaataaagcatgtaaatcaatctgggaataccttttctgtttcagaaatttcatgtaaatgacaggctgccacatacagtacaactatagaggggaaaaagtttctttactccctttcatatagttataccttcatatgacacttaaaaccacctgccaggaacttttaaaacatgttttagatgcacagaagcaaacccaaatgaaaaaatgctatgcagttttgcaatacatatataccacagaaagctttaaaaacattctaccccaacagataaatagatttggcccaaatctttttaatgtgagttttgtgggtaaaaaagattattgttcccttatttttccccatttgctgacgactaggattgtcatataaaatacattcctgggacatgcttatactaaacaaattatccactgtttatctgaaattcaaatttaactcagcatcctatatctttacttgctaaatctcagttgggatatgggcttactctttttttttttttttttttttttttttgagacagagtctggctctgtcatccaggctggagtgcaatggtgtgatcacggttcactgcagcctcaacctccctagctcaagtgattctcccacctcagcttccacagtagctgggactataggcacatgccaccatgcctggctaatttttttattttttgtagagatggggtttgcccaggctggtctcaaactcctgaactcaagcaatcgtctggcctcagcctcctgaagtgctgggattgctggcgtgagtcacagtgcctggcctgagctaactcttttttaaagagttaaaatactggttcctatttgtttttacttctctagtatgggaggctgttactgtggcttctgtcttggggggcaattttcgaagggcttcaagaacttgaaccgaggttagaggaaaaccacaagatggctaaagggtgggaaaagaagaaataacactatttaaactttagatgagaggactaaagtgatgaaacagtcaccaggtatttggagtggtctcacccaagggactgtgccaacttcctcattttttatgagggcaggcaaaaactggccaaaacacaagttaggataataagcatagtagctattattaaatgctagggtgtgctgcataactgaaggacagtgtttctcacagtttatctccaactctcatggccaacccatgagatgtatatcattatccccacgttttgaatataagaaactgacactcaaatcagaaggcatgtcagtgaaaaaggccatattcacatcccatctaagtctgtctgacactaaagcccacactctctccactacactccaccttgtctccagaatgttttgggctgtttaaatgtgattataccaaagagcagttgaatgcactgaaaaattctgaagattcctcctgtcccttcgattcactgttggaaaccattgtcaaggtagtgtctggctacgatagaagggatttttgacatggcctattgttttatctttttaaagtaaatgtaggtgcttttgatgatcataacactaactgttaagtctttaggcataagaatcaagcattcaactaagcatgtttacaaatttgctttcagcccagtggatctatccacttttccatttaggttgcacatttagatttcggagtttatcctgttatcttcaaatccacggactgtacactctttgagggaagaaactcttagtatctagtcaagtacgtggcatgcaatgggtgctcccaaatacttgattaatatcatatgatataatgtaatatgattcttcataaacagtgagtgtttataaatacagtattttaaatgtcattaggaatcttctattggaatcttaactttattttaatagacctacttttaaagttaataaacataatataaatgtggacagggctaagatttttccctaagatttcactctggcaagtcttcctggagatttagccatggctatttttatgactgtaatttccttaatatggggcctcagccatattccatcatcataaatccctttcttgcacttaaaagcaatgttgaaatattttccagtttctatatcttaactctttacttagatccattatttccattttgagattatcttatgtaaatattgtagaagattttagaattatataataagaaaatactagtataccacctcagaaatcttaactaatagatatgttctcaaatgcaaagtgaaatatttaaagtaattattcaagtaaataaagagaccatctttgtcccaattacttgaatattttacgtaaagttggttttatgcacttgactttgtgtttaaactcaagtttgtagtattgtctactggacattgttagctcaggaccttttcaggagcaaggaatgaaagaatcatttttaaacttatttaaaaaaagaaataaggaagaaaagaagaaattttactggctcgccttagcttaagacatggctggatacagatgctcagacaatcacatcaggagcctgcctccctccgtgtctgggctctctggcctcttgggtcagtttcatgctcaggctggctttctccacatagtggcaaagatgggcatcagacatcccaagttaacatcatctttagtgctcatgctgtcagaatgaaagaggccctctcccagcatccatattaaatctccaaagagattctgtttggccttgctttggccacatactcaaccctgaccaagctccgtgtcaagagaacagagttcgttgaaaggccagcctggtttgcacactcattctgtgttgaaagatgtagaccatgtgattgacagtcccaggagataggagagggagaattttcaaaagagttgccggtataagagacagtggattctgggaaggtaaaaagaggtatttattaaaatactgtgcctttggaataaaaatcttttccaggaaatgcaaataatttaaaacaattcaaataaggatcatacattttaaaacaattagaaatacactcagaagaactgaattgctcatttagtagatttcagataatattttctcctctttgaacctcagttttgtcatctggaaacacaggataatgcttaccttataaggtaatcatgattagaagagatgatggagctgaccatatctatttactataaagtgctatctacatagttataaattatgacagctaagaaaattaatccctaaagaaagcaaaattacctatgtcacggtttagaaagtctctctcttaagaagaaacttattctattgcctctgttgggttttttcctgaggaatcggtgtttgaatgcaatatacatttttgtaggctctgcaatgtttttatgatgaggacagtcatagtgttgacaattactcaatgaatacttagagatttgaatgtatcgctagatttctgggaaatgaaaagaccaatgtaagctagttgaatgagaaaaccagaggtgggcagatggtggacagattaagtcgctggttttaaaggtaggctgaactggtatttgtaactattaataacagccatcttctttaaaggaagtactcctaaatatcaatagtttagtggccaaggtgccattgagatgatcactcccaggaaatgttttgccagtgatattaccttaactttcatctgaaaagaaataaagaaatgttttatggatgattcactttcacctgatatgtgcacaacattttaagagaatgaattagtcagtctgtttgaatcatctttacgtgttccttttagcagggaactcaaagttggttaaatggctagctctatttcagaaagcaaaaataacagaaacagtgaaaagacagtctatattgaaagcctgatccagacacatcatgggggaataaatatatcaggacaaaaatatatgaaaagtgaaagtatttctggagtatttcactaccaatataaatattaaaatgctcacacagccagatctggcaagttacatagatgaggaagtgaaagcaataatatgccaagtcaatggcattggtgtaaaatgtaatcatagaggaacaatctcagagttgaaaattattagaattggaaaacactttgaagttctttagttccacccaggagtatgccattaaatatttaataaccatccctctgcgggctttaataacaagccctgatttgtagtgtttgccaatttctatggtgtcaatacagccaccatggctgattttaggctaccaagatgaggtcactgaaacacaagttgggaagagatgcacatagtaggctgtcatgagccagcacacagctggttcagcattataattttcaaataagaaagcagttgacctcagaggagttgggtgacttgcctgggtcatacaaataattagctgcactgccacaactaaacctaggccctctccagtgtttgacctcagaattgtgaatgcattatgaggaaagcaccatgattgattgattggtaagcccacgtgactttctgtcctagttaagttcccctttaagggcctccatagacatttctacattgagtttaaactatagtctgcctatctccactactggcctgagatctcactgacatttggaaagcgttttatttatctttgtatcttcagcactctgtacagtatctgacacttagatgcttataagtgtttgttgggggccatgtacgaacaatagagaacatgcattgacctgctatgtgccaggcagtgttcttagtgatttacatgcattaacttattgaatccttagaataactctcacaagtgaggtaggtactataatcctgcccatattttagatgagaaaatacaggcttagacttacttgcctaaggtaacatggacagtgattggatttaaaccctaaaatctggccagtgcctgtgcacttggcctctcagttgtcactcatttaactagcagttatcatcatagtgcccagctcagcgccaaatacttctaaaaggtctccctcctttccttaggaaggacacaaaacgtttcccagaaaagatctgatctgaccaacacacacctttgttaatggggaagggcctttattaatgggaatgatcaaggaaatggggcgtttttggtgattacattttctcattatctgaggtttaaacagaaacctctagtttaattaaaatttctgttgctgacaataggccctagtcccatttttttctttaattaaaaaagttaacctttttttgatgtattcacttgaaaaatggcatcaccatatggtaacagataatgtaaagaaggtgtaggagattaaggtactaactccaactgtgttctgtgagggtttttctttaaatagaaaatatattcttcttccccactgattttccatttcatcaaatgaagtaacaaaaagcctatttctacatgtgtacattttcttggattcttgtccactgagatttagtacagtgtgtgacttatgtgcgaaccttaagatatgaatcttattttaaaaacataatttaatataatatctctaatttttttgtttttgtttttattttttttagatggagtctcgctctgtcatcaggctggagtgcagtggcgcaatctcaactcactgcaacctccaattccctggttcaagagattctcctgcctcagcctcccaagtagctgggattacaggcatgcgccaccacacccagctaatttttgtacttttagtagagacggggtttcaccatattggccaggatggttgtgatctcctgaccacgtgatccacccacctctgcctcccaaagtgctaggattacagattattttgaaggctccttcaaaaagcctagaagaaaaaatgtcattcacacttcacactgcattaatggacatcaactaacatgcaaattggttacaatatttttctcccttttggcaataataattcgtttcctttctttcattataatttctacagaaaatacagcaataaattatatattaagctcaattttgttagatacactgataccatattgataagtgcagttaacttttcacataatatttatttttcccattgtgctctagatggtttagatacatatttgcagtttggtttacagtttgtatttgccctctagtacaacaaattgtccctaatccttttcttctatcccttgttattccctctaccagcaccaaaaatttgctagtacattgcaaaacaatgagaattacagataaaatagcaagcatttatatatactctatattgatcaaagtgctttcagagatgagatctctttttgatccttaaaatggtcacgtgagaatatctgaccctgggactcagaggtgggtgattgcctggagtcacacagctagagagggaaagggctagaatcagagggctgattgtctgacttctgttctagtgcatgctcccacctcgctttggaagctgcttcggcatagtgaagcacttaagagcatggatgggttcttgttagccagacgtggaattgaatcttggttctaactgtgtgattttagcaagtttgcttatctagaagagaaggataataatacttccttcttcacagggtggtgatgaagagtaaatcaaagagtttagcagaatgcttcccatatggtaagcactcaatacatgttcttgttatttttattattacatggctttgccttactgaggcttcatcttgtcctctggtccaactacagttctctagcttggcttatcccttcataacctgtacccccagtggcacgatcttggctcactacaacctccgcttcccaagttcaagcaattctcctgcctcagcctcccaagtagctaggattacaggcacctgtcaccacacccagctaatttttttgtagtagagatgggggttcacagtgttggtcagcctgggttcaaactcctgacctcaagtgatctgcccacctcagcctcccaaagtgctaggattacaggcatgaaccaccgcgctcagccaggaattttcattctttatcctcctttgagactcggctctagcatcatttccagtcgagttggtctcccttcctctgcattctgataactgttaaccatcaagtgacttgagcttcccagggaagggcatcatgtctttgtagacatccaataaatgttagtagaagaaaggggggtcctgccaataatcatatgtctttcccacaatttaaactccttttcaccctgttactactttttgcttgtcttccctttgataaacattctacttcttcatcacccattccctcaatttaacatctgatactactatagaaactactgccttgaagatcaacaaacgggttccatgtggaccaacgtcctccttgagaccctcacttggcttttgtgacacagtgcaatatttgctctcttgatgcctcactgaccttaaccttccttgactcctgcatagatttctcaactgtgggtatcccctaagatttaggccatttgccttctcttctttcatctagtccattcatgaacacacccattcctggttttaaccatcacctctgtgcagataatgtgcaaagtttatttctagtcggagtggagtctctgttactctgccaatcaagttctaaatttttattccttctagtgcagcagtggcaaatacctgacactcatgtgtctcactcaagacagatactgtttcacccaagactgatcatgccgctttcccagtcaaggcaggcttctcagaatccttctcatttccgcctctgttctttggcactaatgctctgtctgcccagagttttcattcttcacttgttccaggcacctgcttcctggtgaataatgtaaaacctgctagtcatccttataggagaatatgcactcatttcccagcagcacacccgactcaacgtggttaaaaccaatctaccattcccatatattcagcctaacttcccagtgcagtctaccctagttttataacttgttctactttttccagataactgctaatcatctttgtttgtctttgctttcttttttgcactgtgtttgatatattagggtatcaaatcctacttattcaaatatgtcccttattcattccttctatccttggtgctaccatatttgttctggctcttgttacctcattatgggatataaaaatagcctgtcaactggtctttccattgccaggatctctctgttctaagccaccctgcctccagatcaatcttcctagagtaaaaccttcattgtatgacggtctagctcaaaattccttaatgattattaatcacctcttaaagtccccaattcttagactattagtagggtaaaattatttttgatttggagtcaaaaaattttggacgcaaattttggctactacacttaaccattatgtaacttcgaatttcggcttaatttttattcatcatttattcagtatctatttgtttaacaccttctgcatctcaggctctgtactaggtacttgggatacaatgatgagccaagcagaccttgtccttgctctcctggacctcacaacatggtgaacttgtctctattgctcatgatcataataatcctaagtacaggctgtgcttttttcccttgatacttgtagcttttggtttgtgctatgcagggtattgtaataccatttgcagtgccacaataatcagcatatatgtgttatcactcagccacattgcagcttcactgaagggcaggggctatgtcccatttctcatagcgcaagcacagtgccctgcacataccagctgctcagtgatttctgatgtggtttttgtagatccagggttagtctttggcagtcatgatgcctagtatgtttttagaggctccctttgtcctatcagaattatgctatttaaaaaaaagtcatacctatttagtttatattcattctaaggcctctcctttccaacctactaccctgcctataactattataaggagaactcacaatgtttataacttgtgcaccttaagttttaaatactgaataacaggcccattcatgtttcctcatagaaatactgtctatatgcatacaatgaaatgttaaaataatgttctttttactaaatagctttttgacttggtaatgaacaatatgttgtttttccctgagaagtagttctaggactttagttctgaagattatgttgtattttatacattttcagcctcctgtttttcagttcccagtgatcttacattaaacatttgtctgtctaaaacaataggttaactatagccaaattataaccataccattcctctccacacaaaatcctataaacagcatgtgatcatattgcttctagaatttatgattgttttcttccaaaaggaagctaaatttagcctagtaattctacatgcgctcaagaaaacaatgcctgctgtgatttctagaataaatgaatgtgaaccacagttcctttacttgactaacagagaaagtttaaatatcaacctagtcattaaccacagttattaaaccacgttaaacaaccagcaaggggttaagaaagaaagttgctatgttttttctttcattgctgaatgagtctaacttagttactgtatcaaccttaatacagaacattgtttgcatctcaatggttctctaaaattattcgttcatggcttgagttctaaaattaaactatgtggagtcatgtccaaccgcacaatgcatctttatgtgaaacttgctagagtttttgttttccttctatgtaaaagtccagttgggaagctttatttctgatagattaaatggtataggtctttcagttttctcttcatttctgacaactgaactgctctcgccttgaacctgttttggcagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaatagggtaagtcacatcagttccccacttataaactgtgaggtataaattagaaataagtatcagtctcaaaaagaatatccagggcttcttttgtgctttgtaaatggtgtttatccaaaatagttgcagattttttccaagaaaattgaggaattgaatcttcatttacacctaaaattatatctttaaaatgtaaatggtaactaaaagaaaaatgtttttacaattcagatttgcatgttcgtgacatttcagattatattaaagttatttcccatataagcttttttatatttacacagattttatcagatttacacagattttatcagatttacacagatttttatcacagcagcaattcccataaaacataattattgacatttctatataatctctgcaacatttacaagatgttcaagctaatttgtatgccttaaagaattgttccttatgagattatattctctcactgatacacaactgattaatctatattcttgacattacttaaaggaacttaactttaaaaaacctcttctgaaatgctggtaaataaaacatttttaaatgagctcgtatacttctctaaataacctgtaagagtagagaggaaatgtttgttcccaagtccttcctttagagcttgactttaatcatggacttccttctggaaaagacttgtgtctaccaagttctagcttggcactttacctggttggtatttgttatttataagcataaatattttggttgatgattatttatacttatatgaaatggtattttcttaggagctgttagagatattcttggtgctgtgatttaaatatagtaacagctaccagctatacctggagatttatcctgctagtcagttgatcacctggtctgagtgtttattgtggctttgagtttcttgatctgggccagatttggaatacggacctgactatgaccatcattgaatgaacaaatagtatagcttttctaaagacagtttgactttggcatggtatgtttcacttactttaacaggtttcaatctaagatataaaggttataattgcaatcaggtagaacattaaacatgtcctcagtagcataaagtatataatttgctgaggggtaaaggcatatgaattcagagacatttggttgacttttgctgaaatgtctgggacacttctctagatggaaactatagttaactttttatgatgctaggaaaatacttccaagaaagtcagttcatcttttggtgaactaaaaacaaaacttccttcctctctcttccaaagtctatgaatatacataacataaatgcacatacattccaactaagacttatttccccctacatacatttaatatatgttgcaaagaagcaatagaattccttatgaagctcccccttttctttactagaaactacaaaagaatgaaaggaaacaaaatgattttcagaaacctgggattaggaaataaaaatataatattaatagcattacagagaagatatttttctgcatccagtaagttgattctgagacacaagttttaaaagagtctattaggaattcctccagggctcctagagcacatggatttgctatttaaatctttctttgttaaaaattaaaaagaagggtagggcaagaaaaaaattaaaaagagaattcataaaggtatattgatatctcattttttaaattttgtacatttcaatccttagatgtaaaaatacttatcaattctagaaattctcaaaacacatctgaattttatcctacccttttgacttttttagtgttccaagggagacaaacagacaggattagccaatgaaattcaggtcagttttatcgcccaggaaaaattcccaaaatgcactagccacacctgaaaccattatcactcccatcacaaaaattcttgcgggaaacaagatggaacttgccaacatagtcttcttacaaaggaagccaacttttacactggccaaattccatagacaaataccttcaaacctcctctatttatttgcctgtttatcttctctggttacaaagatcaaaattcttctgagactgagactacacatattctctctctccatataccccatccagacctcagattgttccaataatgagcatataatcatttcctagcttaatgccaaaatgaaggcacctagagccattcatcacacacaaaaaaaacaaaatgattacaagatcaaagctgtttagcaggactctcaagcaataagatgactccattttgtcttggcagatttacttggccagaaatcaagtgacccttttaataatttcttggaactgagtttttactttggcatcaagtttggtgaaaagacacacatattgtagttttgttattaacatctctaatacatttataaagggactcttgtggacaaggttaagaaagctgagctgcagcagtaactttctacttatgcttctgcccagtcctcagtgttgacacattgctgaaagagggatttcctggcactccaagagctctccaccatgtgcaaaaagtgtttctatcacaagatcagataatgggagtgccagggacgggccttttacattttaggggtccagcaggtgtaccaggcctgacttgcttgtttaggatcacatattttgttgcttttcccagtctcacatttcatgaaatatgtctatgcaaactcttcacatgcatcttctcatattgatgacatcacaaaagccctcttttgagtcatttgataattcccagtactcgtcatcttcacccataagctatttgtgcttcagaactctttgtctccacatatgatgctgtttctggaaacttatcccaagccacaaatgcccacttatagaataccagtgttgttgactatgtcagttgttctataagaatatattcttgatcctcacaatgtgtccattttttatgttgcttttgaaagtgattctaaagaatttgtttacagtgacttccaatattgagtactatgagattatacacccacaaataattactaaatctgtttaatatctttacctcctcctttacccattcatcaatcaacctctataagcatcctaaattagtattgattgaagttgttttaggctaatgcatattctctaaatagcatattattattcaaaataaaataattgagaaaattgtcccataatatggatggaacctttgtaaaggcccatatgtagggagaaaaaaccctcatctctatttgaggataagcagtagcaaaaatttcattaacttgtttaaaattaagtggaatttaattttaagactgtggaatctctaacagtcttttacatataagggattgattaatgtgacaatttcaggaaaaaaaggagaatcagtacacattggcccaatctcctacaaatgagaatcaatacagaataagagaattttttaaatccccaaatcagcaaagatcctgttccctaagttatagaatatttattaaaacaagtgaaatcgtacattttagaaaaaattttaatcaaagttgaaattagaaaagcattcttgaaatagctctcgcctctcagaaaatacaattagcacacaacactgtttttcttgaagttctattatcaaagttttgctctatagataagcatttgaaagacctgtagcaagtattttcgccaacatcttgatgaccttaatgaccaaagttggatcaagtgaaggggaaaagcatttggtgccagacacacctgggtggaagtcctggtttactgcataccaaccatgtgacttctgccacattacctgacttcttggaggctgagtctcattggtatcatgcagataacaatacctacttcacaggtttttgtgaaaatttgggataatatatatgaggtacctggcacaagatgactataaatttagcccgttgggagacagcatggactaatggaaagagactaaaatcagagatgttggttcaaatctgaaccccaccgtcttctacctggatggccatgaaagcattatttaaactctgaacccatcgtcctgcgtgcaggactatagtgtggacaagtatattaataacatctgtaaaaggtcccaacttggtccttggcacaaaataaatagcagctattattgtaaggaatacttgcgtaaagaaagacaaattcaaatgattggattattctctggaagaggcacattctggttctattgtttacaagtctttcacttccctctctaactgttatgagtgacctacctccataatggttaatttgtgttatgttgttcttaagattataatagttccaaaaaagagatggggtgaggagtggtggtagtttgagggggcagaggatggggagaaagacaattgaatcaaaactgtactatagtcaagttagaaggtataaattgttctccttcctctcactttcaatcctaactatccatgacctaagatattactcttatgtactttgtcatatcttgcattcaagaatttgcagataatgcagttttagaaaaagtcaacctcataggttgtttgtattgggcttccttgtttttaaatatcatttatactcaaattcaaagagtagccaactgcttcccaaaataaaggaaacttaaggtagtaattttccatctccgtttcacagaatgccaaagttaaagagtcactactcagagccatcaaaggaagaaagcaaagtgattagaacaattttaaaggaggacaaaaatcaaaacaagatgcaaacaaggaataataggaataggcagaaaaataaacatacagtgatgtttctttattatgattataaagatgatagatgagtaaaatcgagttacatttaagttgtaatggaagaaaataattgcagccttccatcaggaaaccacaaggaccgttattgatctgtcatcctcagggcatgtctcgtaatatttaataaaataaacaaagatttataacttttataggccatatatctataatctcccacaccacttgaactgtgaatgtggagtcaatgttacaaataacatccatgtgattatactggtttggcatgccttattccaacaatctagcactctcaagagaatgtattttgtattagggatgaaaaatgtgaagccagattatagagttttttacttattgtgctcaaaaatgagaaaatgttatccaatatgaaaaatgttgttaaggattcttcattcttaatattagacagcctttcaaacctaaatattaaatatcttggccatatgccaaatgtaatagctaccaaagcaaaatcttgcaagaaagaaaatccttgaggtataaagattcaatgtactttttaaaaaatgtaagtaaaaggttattaattttacatttcatttctttttctttcctagacactacttcatcctctcataggctcagggagtcactgcttcctaacttctttattttaattatccatgctactcattccacgaaaagtggcatattgcattattttattaaaagaaatttaaaattagtttctttccagaattttgtaacgccccctgagatcactgggcacacccttggggtgttagaaaacatgttacaaaatgaacctttaattccttttgctttttcccttcctcttgctgactgctctttaaaccattacatggctcattcacaagtctctctaccccaggaaagatgaaaaagcaaaggcatgatgtttttataacctaatagcaagagaacacagtgctgaagctgtcaccaaaactgtgggtaggttttacccgtgggttatattaattcatgatatgattgataatatctctcacttgtgtggggaatgaagcgttaactatgccgcatgcattttaaattaatttgacattattcttaatgtcctttcaagcaggtggcattataacctgtgtcttatttaggtagttgatttctacacggagattcatctgataaaactgatatcgcaaacgggaaggagtttgtacaaaatgaaataaatcttaaagttgatttttgtaaagcccaaatgttaattaaaatctttgaatccacaactctgatacatgatattttcattgacataaacatgattagcgatttctggaagcatgtgggatgctgcattgataaggatatgaacctccttgagtaataatgtatatttttactccgaatactgtttcacattttgggtgttacatccttacttcagacttctgccttatcagtggccatcccaccctatgttcttatctcctcagtctaaaaagaaaaatggggacccatcagaatttggatagaagaccctccaggaatttctgccactgcttattcatgggttggcacagacactgattcagtgggcacacagagttcagaatgattcagagcccagatatgtgccctaagtcacatctccagcgtccagggaggactgtaaagtgctcgttatcaggaaaatgaaaccaagggctcagctactcctgaagtcattaaaactccttcccttgatttttttttttttttttttaaatagtatatgtggtaaccgaatctaggatcctggatacattccagtctgctaattacatatttttttctaactaaaatgttccaggcaggttcatttgcatgtgaattacttgctgagccatgttgacttcctattctaaaagcctcactctgccttgggaagcagtttactgcacttcaccctagacctagtctaatgttggagcagacaaagtgtagctacccatatatacttcaaaaatattttccagtctccccacaagaggaaagaaaaatgtctagcaattgcatgctaatttagaccaaagctttgttttaaccattcttggtgatcacaaatggggaaaaatgatttatgaacagtataactataaaacaaacaaaaaaaaaccattgtgaattcagagtgaagtctgacttcatttgtcttatttgggtaaatcagcaaaatgttcatcagtcagaggacattaaaatggtagatgatacttcaaatcgtgccctagataaaaggagagaattaaggttagttttgatttgtaaaccattctcttcgaaggctgattttataaaaattaagtttgctgagtcatcatctcaaaatatatagttattcatgattagttaaaatttgtgtctgtgtatcaaagaagtaaatttgtatgatattaaattttctaacaatgttttaaattttaaaatgtccgattaacacttgcatctagcaaccagtctactaactaaactataggtgaagtcatgctcaggaaatggggaaaatgcacagattaaattggtctgttagctctgagtgaatcaatagtatttagtgctaatgcactaaggagattacaagcactaatgcagtagcagtcaatagcgaaaactaatatctctaaaaaatatcttgacaataaaatgtgcaatattttccatttatcttaagctaattacattacctgcttgttctttcatcttattagtttaagccaagtgctagaagcctaaccattttatttagtgcataaaagggccaaaaccttgtaatcattgttttcagcaggagacagaggaaaggattaattcatgtaaccaagattcaaccagaaattcaacagatatttatttagtctctaaacctgatagtattacaatggagaatgagctagactgtacctgtcttcaacaagcagatagactagtgaagatgacagtaaacattcagtcacaccagtgaacaaatacatcatgataatttatgaaatgtgctgtgagggaaataaacatctgtgaatgcaaatgagagggaatatctaaatttggtagttgagtcacaaaaggctgtcctgaggaggtgaaagctaacctttatataaagcttaaaactttaaaaaagcaatacgtctttagtacacaggcaaatatataaactaaatatataaactaatagtcattacttatttcacaagctttacatcttaactacaagctgctacattaaatcagctttcttaagtggtttgtggtcattagtgcatactatcttacacttagaaaaacattgcaagaagtagtacaatgctggagaatttaactttttaaaacatttcctgccttaaaataaacagcagtaaatgtgtttaaacattcttttgatttctaaatgaattaagttactttttattatgtggttcttcttcatatgaagaaaataatatgtagattactagaagctaagaacatactttagatcctgctcacactcactgcctttcctggcctgtcaccttaatcagcttctttgaaaatcactgtttcttacataggccaggttgtttcttccttgtttccctcttcttccttctatggccaacccttgggaccccgtttgtcagaagaacatgttcctctttggggaggaggggattgtccttttaccaataagttttatgaccaagagaaacataagaatctgagaacacacaaaataagctcttttgaaactatcaaaattataaacattaatagaattcaagggaatgtgatgctgaagtgatcccaagtcacattgtctttctgcctctgtgcactgtactctgcacaattgcatccatttttagaccatttccttctcatgagaatcatgtgcatggagggccaaaggagagacaagtgctcacaaggatatcatgagcacttatgaatgtacaaatgagtgctctccagtcagtgccatctttatattgttccggtttataggcaatgccttcatctttacctacagacacatgttgcctttctgtttcattttaatcctgttcatctatacatatttaatcacacaaatatctaaataagtttatgtcttgtagggaaggcactttgtcatgcttctttgtacctaagcatatgctttgcaaatcataaacaatagtgttgattttatttgatataaaaacttggattctcaaaagaaatctatgtgttcacacgataaacagagaccatctgaattgccaaagtatgactgaatcataagcagtattgttttagtcatctttacagaccaggaagatttgaaatacaggtgtaaaaagatgtgtgaggcatcaaaagaaatattcacctttctttgtgttcattttttttatttttgcttggccgagaaagaaggggtgttttccaagggaataggaggcttcagggcttattcctgtgcctacaagtcagagaggtcactggcttgccccttcctgaaggctgtaattacaggcagaggactatttattttcccgtaaggcgaccagaatcttgagtgtaaaaaactgtttacaagagtacactgtgtataggggttacacacaacctcaggaaaaataataggaaagtgagactatttttcttcatgtattcaataatatgagaaggtccaagactctggaaatgttctaaagtacaataatagagatgaatatgaggtcaaattaggtgatcctggggcttaaggaactgaattaaatgaataaagaagaggaatttctaatagggcataatctaactgataatttgttaaatgtaaacttatttgtggctccaacatcatggtaaacaagaatgaataaatgtattagtaagagtaattgagaagtatttctaatgtgaaaaacaccaattacattgggtttatctggcgccaatgtggaaataaatgagcaatatttcttactctcaactaaacttactctcactttcagaactgttataggaaaggtattgattcaagtagagttgggcatgcaaagcacaagatcaattctgttactggcctgatattaaggatattagtcagtgtttgaaaaaatgatttgtaatatataagtagtagtttaacaaagtaggtaaaacttgtaattaatttcaaaaggtcaaagcagagattattgacatgtacaaagaggacccgctttatatgtgcctgctttgaaaagtaataccgtagtatggtaaattgtgactaattctgagattttctgtctagattctttttaaaaccaaatgcttaagaaaaaaacatgagacatgagtagcaattacattttttaggctgagtaggtagcataattgcctcatgcctgcctcctgtctccatttgtttttagtagattttgcacagaaaaacatgttgacctcggtactgaaattttggagttcactatttgcggcacagttacagatcacagaaaaaaatgtacaacaggacttcaccacacctaacaaaagaaagttttcttattaaaaaaaaaaccctccaaattattgtgagatctagggtaaccatggtgttaactatatgctatttgatatcttataaccctggtgataagataacaatccaattgaatgcagatgaactcatgaaaaaagaaggattatgaaatatttggaaagtaaacacctaaattttcataagtaaatattaattatttgtgtgatctttagatatgaaagcttcccctgcatgcacttggctcttggaaccagctgttaaaactcccagcaccttagttaataccctgtatgctggtggttcaagaactagttaagaaacagtcacattttctattttcactgccaatgtataataaaatctctgttccagtgaatggctggccaattattttaataacgatgttggcatggcttcattttacctttcttgctattagcaaagctttccttttgtactctgaagtacgggtaaatcacaaattaaactgagctgttgtttgtttaatgctgtgtttcctgctaaccttattcttgtctatcaacctgaacgtagttccccagtggctcagaaaaccctcaattgggattaagtaatagtttacacaaccttgctcagtcattaacctgtgttgactttctcattcttgtgttccagcctcatttaagagtttcttaagcactctatccagttgctggtttggtgacaactaacaatacctatttaatcaagaaatttaatatttccaaggaatcatttatcgtatctcagacttcttcattaacataatctaattcagtcttgtattccttcttcaaaataaagcctggtttcattcatagtaaatatgaagcttaaaaatttttacttcttttcttctctatacacacaaagcagaaagagaaaattgtatattatcattccagacaggtttttttttttgtttagtgtattgacattgatgccaataagataaaactagacctcagtggctcctcctcaactccacccaatctatttgtctccaaagtgctgttggagtaagtaatctttgttaagagcaaacctatttgtatatctgatgataatctgagggataataatatgatatttaaggagtttctgtccttggccctgactatttcctggtcctccttcacgcccagtgatgtgctggtaaatgttaaactctggggggaggggcagcagaagcccctaatttgtagcatttgccaatttctatggtgtaaatatcccactgagccagtttcaaggtaccactgaaacagcgttagtcactgaacaacaatgaggaagagatgtacacacttggctctgtgaactgttatgagatggttcaagcacagcactgccaccctgtcctacacgcaacctgtcattcttgtagttcccagaatccatcagcctccctcacaaccctgccttaacacgtgtagcttggtccacttcagattccctttaacactcattttgtcaagtgaacactttttccctattctttaaaacttccatgctggcattttccttccccaggacatttttccctagccttcaactcatcccctgccccccatattctggatttgttgcgtttcctgagcacaccagtagcactctgcttatttctaccatgtctcttatcacactccgtggtaatgtgtccaacagttccatcgttagccccctgaggggatgaactatgccatttatctccacagtcccagcacctaatacaatagcttgaacaatatatacatttatcggatgagcaaagaagtatgacagagccctgtatgtaaaatatattactataaatagaatgctgattcataaaaataattatttagataaaacagtttttccgtctctcccctaaatccctaaaaactaatttatagaattggggagttttcaagagctaaattagcactggagaaaaactggggagttttactcactattacctatgcccctcccgtcccccccacacacaccctccttcattcaccagtctgcaatgaagattgatcaaagaacaaagaagaagaaaaatgaaagaaaaaggaaagattaagatagggagggtgaatagataggaattccagagttttgtaatcgaaatttggaactcagaattaaagtcattaaaaggagaaagagggaatactttctctgctcccgtaaggttttctcaagcctttcaacagcactcaccctttgagcgggtgataccatctgtaagagggactttacgcaatgctttagtgggcgtggcttgagcagtgacaccagtagagatacccccttgaaactttcatttgaagtccacagattttcactattggtcaccaatccatgatttcaagttgaaaatgatatatgggttaaggaaaagaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaattagccgggggtaatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaggaaaagaagttaagggcaaaggtctttatcaacaccatccttcctgtggccacaggatcgtaatcccagtggcaacattcaaaggcaccaagtacgtgcttggtacagagagaagctttcctgagcttggccttggtgtagatgcagtgagaactgagtaagggcctctggcagggaccttggctgctgagaaggggagcccacagatggaggtttctgatcaacaggtcctatcagaaacaaggggagcagataagtaaagagtctcactccacggtggcaagatggaaaggagggataagaggtcatgacagttggattaatggcaggctagaatatagtcatgggcttgaacgatatattgggacacaattgaaggactcttgtttcatccatcgttcatctctcctggccctctgtgaagacatttatcacctgtttctattgaatgtgacactgttaggcacataaacagaccatggctcttaccacctccaagaagaactacttctgttttatttgttagtgcagggtaattggtgttgtgtcttctgaaaatctcttatacttctatgagtaagtgcattgaaattgtttctgttaactaagtagaggaaagcagaaaacctctttgcactaagcattaaaaccttcctaacttggaacaattttctttatgaatcactctgtcactcctggctatgattgaagtgcagtatgaaggctgctaaccaaaaacacatggacacagtctgtttcagatctgattcaccttaggaaatgatgataaagaagcaaaagttttaacacttagaattccaaggtccatatcattgtagaattgattcttttgaattgtggtggtacctcaagagaaaggatttatttatttcatttatatttaaatgcgtttgtatacatatgtatataaacccatatacacatatacataaaatatattctgctccaagtatttatctctcttttctctttactaatccagcttccattaagaactggctcaacttcgacctctgccatgagccttctccagctgtttaagcccacacagatcttatttttttcctagtcttagaggatttactgccagtacagtgttttcagaatgtaactatcaactgagttcttatactttgcatcagttagctattgtacgtgtcaatcttttgtctccctatgtagaggctagacccaaggtagaagcatttgccaggattgacaaacgatagcctgtttttatattctcaacaagtgaaaacttattttgtttatatttttttccctttttatacagttaaacactcacatgcacgcacacacacacacacacacacacacacacacaggccacagggaccctatggccctcaaagactagcatatattctatctagccctttcccaaaaaacatgtgccaacccctgcattagagaatagtgtaaaataatagtggacagataacaggtccacaaattttggagagccatggatgaccttacttatgaacttaagtaattctcttcaataggtgtgagtgtttccattttacagatgatgaaattgaggctcattgatctaaacaattggattttgtcttcataggcattatgagggcttactagaccaacaatagtgataataataactgtttagttgcacaaggcagggatttatgtcttttttatttgctgccatatccttcagcacctagaacagtctgtcacatggtatggtattatattcattttccagagctcccataacaaattaccacaaactgggtggctgaaaacaacagaaatttatcctcacatggttctggaggccagatgtctgaaatcaaggcatcagccagggccatgctccctctggaggctctagggaggactccttccttgcctcttgcaattctggtgtcccaggcatcttaggttgtggcagctttactcccctctctgcctccatctttatgtggcagtccaccatgtctctctgtgtcccctcttcttataaggacaacagtcattgaattcagggcactcactaaatccaggatgatttcatctcaagatccttaactaatcacatatcaaagagcctatttccaaataaggtcacgatctgactttccaggtggacatgaattttgggaagacattattcggcctactgtaggtcttctaaatgaagtgaccatttaatatgtttctggcactggattcatttcatttaagcctcaaaacaaatctgttatgtagatatgtgttttcccactttacaagtgaagaactgaggtttagagatctaggaatcctaaagctgcacagccaggaagggcagggccacccctgacccaagttctctgctaggttagcatggttgtcacaggacaagctgagaaggtatttagggagcattacactaaaaagttgtagaagtcggcttaaggaagaagattctaaaatcaaaggaatcagattgtaggaggccatgtaggcaatttcctttaattcaatagaagagagtataagaatcagccaggcatggtggctcatgcctgtaatcctaacactttgggaggtcgaggtggaaggattgctagagcctgtgaattcaagaccagcctgggcaacatggcaaaatcccatctctacaaagaaatacaaaaattagccaggtattgtggcacatgcctgtagtcccagctactctggatgctgaggagggaggatctcttgagcccagaagggaagaggttgcagtgagccaagattgtgccactgcactgccgcctgggtgacagagccagagcctttcaagcaagcaagcaagagggaaggagggagagagggagagagagagagagagagagagagagagagagagagagagagagagagagagaaaagaaacggagagagagggagggagggaaggaaggagggaaaaagagagaaagaaagagaaatatgaaagaaagaaagagtaaggaaggaaagaaagaaggaaagaaagaaaaagaaaagaaagaaagagaaagaaagaaagaaagaaagaaagaaagaaagaaagaaagaaagaaagaaagaaagaaagaaagaaagaagatatgaacaataaaggaaagactcaaagatggttcagatctcaaacttacggagagggtagctattgatgcattgagaaataggaagctggaagaggaaatcagtttggagagaaaagtgatggctttgaacatcatcaatggcgtattcaaacatagcttgaaggcatttgcagagacagggctggtcctcggaagagatggcaacggggtgtgtagagttaggtcatcaccacgaggctgtgagggcagagccacagtagcttccatcaccttgtgaatcaccagtgctcagcccgtggctggctggccggatgcctgcttatgctgtgctcccggctgtctggctgcacacacaaccgcagagcatgccctctctggctagggcagaaagaaattgaagcctcttaaattttgccccccccagctttgctcccttgctaggacttccaggccatgactattgaagccatagggcaggattacttcctcaagaggcgttagtggaaacagatgtgttgaggaagcctctttcttttcaactgtgccctgagcacatcagatggagtcctcttcatagcacaaaacaacttggtcagattcttagggtttgaccacagcaccctaacagcctggccgtgcattaaggaccccaaagagaaggatctgctttgccagagagctgactcttctgtattttacagacaattctgaattcaatgtcaacatcttagacatctcagtacagacagtaaagagttaaaatatgtctataagaaacagcgccagaccctgaaattgaaagctctgtgcctccctgcgtgcagtcagttccacactgtcctctctcccagttctatttaataaaaaaaacacatgagtgaaatttagggaaataagaattcctgaaattaaagcaattaagttttcagtcaactgtatgaaaagctctagacaaagaggtactttctatttcaaaatatgtatttcccagaaaaccattaccatatctagctagaatttctacaaagaatgattatgaataaagtatatattcaaatgcttctggtaatttagtcatggtcaaagaggagagaaaggtgatacaagtgaactggcaaagattttacaagatagtacatttttaaaaattttatttgcaagactgatttaaattatctatagatgagctaaatctgtcctatagatcaattaaatgaatcactattttaaatatatcacattcttaattacactgaattaaatataattacatattcactgcatacatcataatgttaattaggggaaacattttgaatcaaatatattgagatatatagcacttcaattttctttttataaaaaaagctatatgactaagtcaggtaaaaagaatctggcaagtactcatagaaagctaaaggaagactagattaattgatgtatcacatcaaggcttacaaattgtagaggaattcctattctttaactctatgacagtatataagactttgggctaaggaagcaagtttgcaacaagtttttaaaaaataataaaacaggaggcagggcacggtggctcacacctgtaatcccagcactttgggaagccgagacaggtggatcacaaggtcaggggttcaagaccaacctggccaaaatggtgaaacccagtctctaataaaaatacaaaaaagttagccagatatggtggcgggcacctgtagtctcagctattcaggaggctgaagcagggaattgcttgaacccaggaggcggaggttgtagtgagccgagatcacgccactgcactccagcctcggcgacagagctagactccatctcaaaataaataaataaataaaaattttaaaaaataaataaaataaataataaaacacattgtttaccattgtttctcagagacatacgattattttagaagtggataagccttttttttttatactttaagttttaggatacatgtgcacattgtgcaggttagttacatatgtatacatgtgccatgctggtgtgctgcacccactaactcatcatctagcattaggtatatctcccaatgctatccctcccccctccccccaccccaccacagtccccagagtgtgatattccccttcctgtgttcatgtgatctcattgttcaattcccacctatgagtgagaatatgcggtgtttggttttttgttcttgcaatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgtcgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttttttcttgtaaatttgtttgagttcattgtagattctggatattagccctttgtcagatgagtaggttgcaaaaattttctcccattttgtaggttgcctattcactctgatgatagtttcttttgctgtgcagaagctctttagtttaattagatcccatttgtcaattttggcttttgttgccattgcttttggtgttttggacatgaagtccttgcccatgcctatgtcctgaatggtaatacctaggttttcttctagggtttttatggttttaggtctaacgtttaagtctttaatccatcttgaataaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtagttttttccaattctgtgaagaaagtcattggtagctttatggggatggcattgaatctataaattaccttgggcagtatggccattttcacgatatggattcttcctacccatgagcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttaacatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattctctctttttctattgattggaatagtttcagaaggaatggtaccagttcctccttgcacctctgatagaattcggctgtgaatccatctggtcctggactctttttggttggtaaactattgattattgccacaatttcagctcctgttattggtctattcacagattctacttcttcctggtttagtcttgggagagtgtatgtgtcgaggaatttatccatttcttctagattttctagtttatttgcgtagaagtgtttgtagtattctctgatggtagtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttcctcagttctgctctgatttagttatttcttgccttctgctagcttttgaatgtgtttgctcttgcttttctagttcttttaattgtgatgttagggtgtcaattttggaactttcctgctttctcttgtgggcatttagtgctataaatttccctctccacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggttttgagtgagattcttaatcctgagttctagtttgattgtgctgtggtctgagagatagtttgttataatctctgttctcttacatttgctgaggagagctttacttccaagtatgtggtcaattttggaataggtgtggtgtggtgctgaaaaaaatgtatattctgttgatttggggtggagagttctgtagatgtctattaggtcctcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagctcttcctccatccttttattttgagcctatgtgtgtctctgcacgtgagatgggtttcctgaatacagcacactgatgggtcttgactctttatccaatttgccagtctgtgtgttttaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatatggaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctctcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttcttttcctttggtttgaatgtcctcccgtagctcagagtaatttgatcatctgaagccttcttctctcagctcgccaaagtcattctccatccagctttgttccgttgctggtgaggaactgcgttcctttggaggaggagaggcgctctgcgttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaagtctgttggagtaccctgccgtgtgaggtgtcagtgtgcccctgctggggggtgcctcccagttaggctgctcgggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgccccgagaggtggagcctacagaggcaggcaggcctccttgagctctggtgggctccacccagttctagcttccaggctgctttgtttacctaagcaagcctgggcaatggcgggtgcccctcccccagcctcgctgccgccttgcggtttgatctcagactgctgtgctagcaatcagcgggactccgtgggcgtaggaccctccgagccaggtgagggatataatctcgtggtgcgccgttttttaagccggtccgaaaagcgcaatattcgggtgggagtgacccgattttccaggtgcgtctgtcacccctttctttgatccctgaccccttgtgcttcccaagtgaggcaatgcctcgccctgcttcggctcgcgcacggtgcacgcacccactgacctgcgcccactgtctggcactccctagtgagatgaacccagtacctcagatggaaatgcagaaatcacccgtcttctgcgtcgctcacgctgggagctgtagaccggagctgttcctattcggccatcttggctccgtggataagccttaaaaggctcaatactttttaaaaatttcctataaaatccagaatctatctagatttttgagcagcctgtagtggttggaggaccatgattgtttactcatttggtcacctaaacatcccaagcaatgatttgttctgacagcagactgataacagttttttttactccttggaatcggaaaaaaaatcagcaagggaagcttttggaagccacccggtagagctggaagagaatttcgaaatcaattcgctcaacctctccctttacaggcagaaaatgtgctagattggaggtgaagaccctggagccagagagcctaggcttagtcctagccctgcactgaaggtaatgtgaacactcagtgcctcagtttccttctaggcttcttgttctgagattccatgaattaatatttgtaaaatgcttagaactgtgtctaacacattgtaaacactaggaacaaatgctaaggtcatgcaactcatcaatgcctccctggggtagaaccagccttggcccatgggcatgctcattcttcttttagacaaggctcttaggcatccctagagtgtgggttggccttcctatgcctgtacgtaagaagtatgatgtaatgtaaggaatataggattcaaaatcaacaattaggattcaaatgctaatatttattgactcaactctctgaatcttagtttcttcatctgtaaaattataatgatcataacaaacccaagtcacagacttgttcagaggagcaaatgagataatgtactttgaaaaccataatctactctgcaaatgttatgtaacattataattgtgagttcagcaaagccatgagaatgtttcaaaactgtttaggacatcaagaagttggggtggggaaaattcttaataggttttctccatatcctcattttccatttattcattgttttaaaatttatttttcttatgatatacatatatatatatatatatatacacacacacaaaagaattatgtacggtcctgcattgcttgcattctgagaaatgcatgaataggcaattttgtcattgtacaaacatcatagagtgtacttatactaacctaggtgatatagcctactacacacctaggctgtatggtatgaccttttgctcctaggcaacaaacctgtacagcatgttactctgctgaatactgtaggcaattgtaacacaatggtaagtatttgtgtatctaaatatatctaaagatataaatatgtctttataagtatacaaatatatctttaaatatactagtatatatttatagatacaaatgtataaatatatctatagatgtactagtatatatatttatagactagaaaaggcacagtacaaatatgatattattagcggggtgtggtaattcatgcctgtaatcccagcactttgggaggctaaggtgggagaattgcttgagccctggagtttgaggttacagtgagctacgaacacatcactgcactccagcatgggtgacagggggataccctgtctctcaaaaaagaaactaaaacaataagatagaatcttatgggaccaccataatatattcagtctatcactgattgaaatgtcattatgcagcacatgactatatatatgtatatatatatatatatatatatatatatatatatgggatataaaacaaatactcatatctctaccaccaggctcaaaaagggaatattacctttgaagtcccctgaatatcccatcctagcaatattcctccccctcctggaaaagtgggtaaacaacaattgtaagtcatgtgtttgtctttcctttgcctgtagttgcgctacacaggtgtgtgcccagaaaatattctttattggatgcatggggtttccttcttgactcagagatctcaagctatacggtatcttcctgcagccttatagtgtccaccttattctttgtcactatttccctttcccagccaataaagcacattacctctgtcattcaaatgaactcgtaaagagagattttagaaaagagctggttcacctcaggttcacctgagcaaggaatgggtgtcagtgactgtggaaagtggagcacagctgccagagcagtgcaaggacccaagaaatgggagggtcttgactcgggataaccactctgagattcattggatgtcctagattgtcaccttgccttacaccttaagggagaaaaggataaaaagataaggcagatgtgaaagctatactaaggagcttagacttttcctgcaggcctttgggaagcaactgaagctttgaagaagggaatgacagcttgagactgcttcaaggcagaagagataggagaccagaaggccagtgaggaagcacttaggctgggccaggggtacaggtgtggctggaagggctgcccagaagcaccactgtggaccaggctgagcaggactgagtgactggttagatataggaaatgccagagaaagagaaggtggtgatgactgaaatttcagagttacctaaatgcaagcatggtatgttcataaccaaaataggtagcaaggagagctaggtttgagagccaagctgattagtacagaatgcgagtggttatctctgctgtttccagaaaataaagattaatttcagccttaaagtcagggacttaaatgagatgatctcgaaagccctttccatttttgtaattgtgcaatcctcagaacgttgcccagaatagtaagcagaagcaaaagaaattcaggagtttgaacataagagagagctgttctctgatgcctgctccaatgggaactgggcactgtgactgagccctcggctcactgagtctcctcctgaggagtgtgataaaacctcacagggctgctgtgggtcttattatacatgaaaatacccacctcagtgcctggcacattctgggtgcaggaaaaagtttgatttcctccctcccttccttccttccttcctttttcctccctttgttaccataggagagagtcaggctggttccctgcgggtgctggtgtgaaacctgctctttagactcttctgcagttccccaaagcagctactgtcccagagaactgctttctgccagcaatgctcagttttaccctaagacacgataactcctggctttgagggaagcacaggtagcaaggggacccctgacagcaaatgtgtagttgttcttccagctaggccccagccccaccttaaatgccacatccaggcactgtgtctacagtgctgagataaagcaaccccgtcttttccacacaaatgagcagcaaacatatttgctgattatctttgagggacataatgaatcagactgagatttagtcatatttgcacaatgctttacatctgagatactgaaagcttaatccaaggtttccctgttagttgaagtcctactgttagggctcaaagacagggtgcagctctgtaagccagtccctgatgccttgatcccaatcattgagtttatcaggattctccataggaagacacaaggagcacctctgctgcagcaaatgctggagtgttagtttttcctagaggctagtgcctcaacacctcttctgcagatctcagctatggagaaaatgaaaaagaaaaaggttagagtctcctggcttatgaaatttgaatgccacttgaacctgacatatttattttttagctctaaatcacacaagatcaagaagttctgcagatcctattccaacattgtgcaatgtctctatatttacaaattttatttgatggggggggcaatagagacataatttaatcctattagttcttgaggagatactatttagagatctcactaattcctgtcctgaaggagaagacttgaagtgtgcaatataaatattgcattaactctaatacagagttctacatttacgccttacatgtgtgcaaacaggtgcacagaggctaaagttctggttgtattgctctccctccatttacaaaagatcagtgagttcctgcttgcagattctctgaggagacccttagtttcatctcctcttcattcttctgctggcctgattcagcaagaccaaccacaaagcaaactgagtaggcaaatgggctttatctctggtgactttgcagatgcactaatttttcagcaggctgtcattaaatgcctactgggtgctaggcataatacagggtcctggggataaaagatgataagacaattcctgtcctcttgttgatagaaggcaggtagtttgtggtcaaagactctcattcacacccaccagattgtttttatatcccagtgaatccattatgtctctggcagcaccacacaccaggtcaagtttgaggctttaaagttcccaggatgtcacctagacttagagatgaagaaacactaacaaaagaagaaacaagacaaccacaaaaacctgagcctgaagagctgccacctctataatggaatatttcaaatggccttagatttaaaattggtctttgctcctttaagcagattcccttagctctggctatctctgcaaaatggatgattgatcaccaatagaaacttaattatcaattaatcggttgctatcgaattgctggtacatctcagttatctgctactcctcagagtaatccatagtactttagtgaagaaatacttctaattaaacagggaaatagcacttgctaatatatcaaagtaaatgactagacctaaaacattagtattaattacaagagtcagtgggtttagcatctctaagtttctatttgctaatttattgccactgaaaatgaagaaatcgttgttgatatataaaatagagcattttaggtggtttttaatcataaaagtcagtagatgtaaaaactctggattgcatgtggcagacatttgaccttaaggaataaggtcgctatacagaaggataactaaacttttatttgtttgttcttaaacaataaaatgatttgaaatatactttgatcattttgtgattattatcatatgggatgataatagagaatttcttacttcctaatcattttcctacacttatagttacatacaaagatgtaatgaaatttgctctccttttcttccaaggtatacatcattttccttaatactttctcccgtccccatcgtctaccccagatttaccaattcccagctatctccttaggacagtcaagaaccaaatactcccatttgtcccttataaactcttttaacttccccaatttctggaaaaacaaaaagctttaataatatagttttatatctccatactcatcccccatctacttataattgattcacttgttcattcattcaattaatatttactaaacatctactatgcatgatagttaatcaactactggcaataccatggtgaacgagtagggtccctgatcgcagcgagctgcttgggagaagtttcacattatcttataaatcacgcaagcaaatgttatgttgcagcttgtaactatgttacagctatgctatgggtacacaggtaaatgatattatgagaatctacactagaagcatttgacttagatagtggggtcagggcaggcctcctgaagaaatggtgataagctaagatctgaaggagatgtaggagttaacaaggtgaatgaaggtggaaggagcatttcaagccgggaaatagcatctgcagaggcccttaatgggagaacacgtgacatatttggagcgctgaaagaaggcctgctcgctggagcactaagaacacagatctggagaagttgggcaggggccggatgatgggaagggagccatacagtccatgttaaaaaaatgttgttctttatcctaacagcaatggggaagcattgagtgttttaaatagagagggatatggtcagatttgtgtttgaaaaagaaaatcctgctgcagtgtgaagaacagatcacctggcaagggtaacagtggatgtggtgggtctagttaagaagccgccgcagtagtccaggaaggaatgaggtggctaggatgaaaattgggaggaagggcatgaaggagaagactggatgggtctaggaggcatttagaaatgaaattgttgggaattggtgatggactgtatatgggggcggagggagagggaggaattggagatgacacttagatttctgacttgtgcacctggaggaatggtagagccattcactgaggtgtgtagtgtcctaaggtcaggcaggaggaagattgtggtttctaggatgggcatgttgttgaatctgaggtctctgagacatgtgaatggagatacttgagtgatgttatctacaagtgctgggctctttgtttgtttgttttgtttttattgcgtgggaggtcttccagaaaacctgctagacaaattctaaaagaaatataacactcatgctgggttctattgtgagagatttatataaactagcttgtttaatagttacacaagctctataaggtaagtactatttttttagttctctctactttacagattagggggaataaaacacagaaattacatgattttctgaatacagaaagattattacataaagcaagtaagcattaggggccaggatttgatgccagcacttgggtcagtgctctgtggcctcccagtgagttatccgttaaccaccactccctaccatctctctgcacaagaatgcacaaaggcacacatttaaaaatataatgtcagaacatgcctctaacatttattattattccagttgaaattcatctcatcagacttgcctgctagaagcattacctttgtgtcaagggctgagacatttaaaagttttgtttttcttataatagcagcagctaagttccatttttaggcgtgcacatattgaaccatggtgtgaattgcgatagtaaggttttagagtctataaataatgcctagtgaaattggagccattcagtccctagaaatatttatgcctatctgtggctatttgtctatttgcatgattatccttgccattatcctccaggctctgaaaatacacactgaaaggtttcttaccagcttgttcatgtctggattcacattaactctatgaccatattttattccagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggtaagtgctttctgagagtagctgtgtctgttctatctggtattgtgcaattaatttgttttcgtttttgcagtaaggtatttgcaaatactgtaaagtccaaatcatagtagaaactggaacacagactgaaagccaaacaatgaagcctggtctactttctgttaaatgtgtggtctctttttattaagttcttgaagctttcagtttgaatctgtttgctttaattttctcgtccagaatggtgtggcattttttttccatttataatttctgtcacgtgattggaaaataaaatgaaacaaagcacttctaggcaatttttttttatttcaagggaagctacagatcaaaggagagctattgtgtgaaccatgcatcttcatgagaagaaacattcacatcattgagaaatattggcaggagttaggaagggacaacattatcatcaaaatcccattgtaactcaagctctcctgattctgtaaaatggtagggttggatgcaaataagttcagatacaaaaaaaatccagattttattaagaaatggttttaatggatagcaacagtatttctgtacaacaaaagtttccatttcaacttactgtgtttcctagatacaagaaccatagcactttgcagaaattaaaagactctcttgttgggttggtttttgctgttttgtagttattggtgcctttaacatgagttgttagtagattcttgatgaggaaagaatgacaatagcatctatggaaatcttgaacttctgtgaatactagaaatttcttttaaagggagatttcgtaattgtctgatgtagttagtaccctcatcagacaataacctctagtaaaccaactgagaatgataagcttttcctataacttgcctgtctatacatcctatatgtgtattcttctacaaaacatttttttaattaccactctctttatagcagcctggatattgatcattgccatattttaaaacctgtaagttatgtttttcttgtactaaagggcatggtggaattttttcaaggtcaaaaaccatgtaaataaaaccttcctagctcaaaactaatcatacaggtcctgttatctaattattcccctagtaatctcccttctattgcttcacattgaactacgccttttctccccctttcctctgtccattccactgtgcttgtttatccaactcatccatcttgaccatttaattctatccttaacttctcaaacctgaaggagggaagccccgcccctcccacagagacatgcactctaatggatttgaaatatgctcatatctattatgtgtaaaatgtgtagtattgttctgtgtttatacatgtttttaatttacatcaatggcattctatacaattgcaaaaatacaaagaaggactagaaaagctggcatctattgatttcctaatgtgttcattatgttgatttgcccccttttatctttatttctgcttttttttttttcaaaatcgtccattacctcaccaatccagttttgtatgaataagctttttatgattactttagctccgactttttttaacatcaaaagttccctggcctatttccacattctaaagttgtaatacaattccttatttaaatatgttgctttattaactgagtaaattctgctgtgtgacagagtcaatcgcctgagggatatgtcacgcatcagtctcattatagaaacgctgtagcaaatgttttattcttgtctcctagcctttgtgtaaaagaaactatattttgcctattaactatgcatccaaaacaaaaggtaaaaaaaatgcttattttatgaaaagtactggtatcactgattttttttaaaagtggcttttaatttatcaaataagtatcaagaactacctaactttgctttactatacaaacgaatgaagcaaaggaaacagtgacacagaacttacctttaagaaattaaattttagtaggaaagatacctgataataatagtacctacagacaaagggctattcgaaaccacagagaatctatttctctgacgcttgcctaagagaatttcattccattaaattttataaagaaacctaaagcatttgaaggatcaaacaatcaacatcactgaagtccatatatttacagtaaataatagtgcgggaggagtcaggagtggagcacagatatggcaacctcccactttaatctgtcagagcagtgacttcctacaaagttctgtaaatgttttgactgcaccacagtgttaaatgtatggctaggcctgagtttctacaactcgtgttttagtaaatacgatgaagtttctgttacaaaatagaatggacattttttttccccccaaagacagctgccctacacaaaagggaacagaaagatgattttacttccttcctaccctgaagcctaatggcaaagttgctttgcaaatttttttctcccaagagtttgcagctgtttctgtctttcctattgtgcttatgttcagctctggctgggaacacaagctacagccccagctgttgggtgcaaagtgaatcaggtatttcacagtggtcatttgattagaaagaattatattgtttagctaacaacattttgtgtatggcagggaagacatttttgacatgttcctaacatttaatgatgtgtaacttatcttgtacaggtgcagctatatctgaaaatactgatgcatacatatatttaagtctcaatatctgcagagccatgtcaatgtagatgaagatttaaaaataatttttatttgcatgatcactctcttgggatacttcgaagtaaaatagtaggataagcaatgtttgagatagtgtaagtgaacaatgagaacgtgccttcttacagactggggaaggagatgtagaacagagtcagacttgggaacattaacacagtgtacacagctacgtgggagagggaagagggattctcatgaagatcacaggactaatcacagggattgtccacgtctcccttctgagcgcctcgtctaatctacatccagaacaatgcttccttgattttttttaacagcacttgtataaggcttttaatctctaaatgcaaagcattgctattaaaatatttgtgcatgactgtcaggccagggagagtgagtggatcagggatgcgagagggggtggggaggccctttcaagaattgtttcaagttcagctccacaaatactcactgggcaactactatgtgcactacactgtgcctgctcccaatggccacagcctgggcactgtcactgctgctactgggctccgtggttccatcctagctcttcccgcatgcccctttcgcctctccaagttcctaaatgttgttaccacccactcatcactcctgttctcttctgcctcttaactggactagttggatcttaagtaagaaacccaaggaggtagagatcacctaaaaagatgtcccatgttcaagatcattacttatgaccactacttaaaggactgtgttagtaatcagtgaacctaagaataattactcacttccaataagaaaaatttgtttatctgttgacctcctgtcttcaaattccttcagttcccgtgcccccatcgtggcatgtcagtgctttctgtgagaagcctgtagtatgcatcatgtttggaattactgccattttagagtatgtagatgcagatccccaattcgtcaatgttgtgaacatctggcagagacacagctgaaggaagcttcaacttgaacaatgattctctttagggatttctaacttacccatctcttttataaaataatcagataaaaatattatctgcctttttgtgtgtgtacatcattaacttagttttaaccctaaagaatgttagctttggctttttttttttttttttcacagtgtctcgctctgttgcccaggctggagtgcagtggtgcaatcttggctcactgtaacccccacctccagtattcaagcaattcttgtgccttagcctcctgagtagctgggattacaggcacgtaccaccatgcccagctaatttttgtacttttagtagagacgggtttttcgccatgttggccaggctggtctagaaatcctggcctcaagtgatctgcccgccttggcctcccaaagtgctgggattacaggtatgagtcaccgtgcccacaagatttggtatatttctttagaggaaaatacactcaagggttctgaaatttcttttgtgtaagaaagaactttttataaataataatttcagttatgtccataactaaaaatcaaggattccatttatatgaaatatctagaataggaaaacctatagagatagaaagtagattagtggtagtcaagggctaagaggatatggggagactgggaatgacagctaagggatgtggggcttctttttgagataatgaaagcattctacaaccctgtctcaaaaaaaaaaaaaattaaaaccgttcaattgtccactttaaaaacaatgggggaggtatacagaaactgcatacaaacatcttatcttaaattgtattcatcattcttaaaatttaattctattaataaaacggtttaattaaagataaaactgtatatgggaggtaaggagatatggcctttacatatttgtggatatctcacacaaagttactttgttcaggtttacagatttgggggcctagccacaacagttttatttgtacatgtatttcttccccatgtcctatctacaaggggctatgtgagatcaaaaccacaaccatttggtaaattcagattctgccctgccccaaatgtattagtcctgtattttcaaggccattaaagaaaaaatatcctgtgacctaattactaaagattagttgttgaatagtaggaactcaaagataattgttggtcttctattttatgcgaattcttctaagattcccaggttatttatcataagaattacatttacatggcaaatttagttctgttcctagaaatatctccatgacaaccaaaaggaactcctaatttctggcacacattacttcaggggtattttgagagttaaagtggttaatcgattatttagaatcctagcaataagagaaagaaaagaattaagggtagaaaaacatttatagcagtaggtatccctgcagagaacgggctaatgatcaactaaaaaggcatttgcatctgtggtacagcctctgcgcaaaattccaaatggcattctcacttccaagtcacctcacttctccatgtgccttcctgtcttctcatcttcatcccattttctatagcaagcaacactcatgctaactcgtgatcaaaagtagagcttggcggagtgtgctagtaacattttctctatgccctcaaaaactagttagatgcagagactttctccttaggcacacttaacttgtgcagcaaaaattactgaaacacggagtaactggcgaggcaaatatattgtgaaatttgttttagtacttttactcacgagtggctcttgggagctcagagttgaagctttttcaatggtatttactctggtgctccaagagcctagcagttgagtgtttaagaggtcaagcacatggattctggcctcagataaagctctgtggaaatctgactcatgtactttctagctgaaattctatgttgtattttttttaaggaaaataatagtacctaccttataggagtattgtgaggagtaaataaaatctccatttaaagcacttggcacaatatgtgactcagtttcctgttatgaaagtacaaacatttggtgcttttcagacaaagctttttaacagaggatacacatatcaatcaatccaagtccagaggtgcaaagagcttccgaaaagaaagagaaaggttaattctttctgggaaaggactatttggatgggcttcagatatttcataaagtcaaagatgatgacctagtaattaagaagggattgcttattatagatttgggaaatggtattaaaaagagcaagaaggtaggagaaaaaaagggctctaggaggtgattgttatgtagccggtctaagtagaacggaggaaaccagggagacagacacaaaatgcaggtgtccattgcaaggttcatagtgatgaataatcttcagtgaagtgcaaagcatagaatgagctggaaaacaaagtcagggtattaagacagactggtgttctgtgttgcttttgacctgtgtgtgagaaaaggagtttttttgcttttgtgtttttgtttttgttttgttttttgttttacctttgcagtttgaagtgattggcaacagccaaagaaatatggggggtattgggcaggagtataggaaaaatgagatgtgatgagcccagaagggagttaagattgcaaaattgggtaaccaaaatctggagaatttgtaatagaagctttagaagtctaacatctgatattctgcttgtaaccagtacccaaagggaggtgggactggtaattgaatttctgttcactttgcctgcaaaggtcaccaatacctattgggccctaactttaggaaataacaatagtttccaacctttcccatcctgaccaagtgacccttcatccatcacttaacttctgtgcaaatataaccaccctttttaatggagatgttttgaaagcgttgagtgtttagagtagaacaaacattagagcacaaatgtcatgatgtttaacttttacagctgtatgtgagcttggttagtttctctatcaacaatccactctctgagaacaaattaggtactttgagaatcttcccaaattgcttcaggatacttggctcctttgttatgctgaagaaaaaatttacaattgttccccagaacatttatatgttgtatgtgtttgttagagtacaaagcagttaattattgctgtaattttcattcccattatacgaatgagaaagctgaggtagagggagtgactatgtaatcgtaatctcacagatgtccatgtttgtcctgtgatttcatacccatcgcgagtaaatgcatgttcaatgcaatgtaaaaggctattagagatgttgggcaatttcacaaagtagatttcaagtctagggctgtgctgagcctcctccaccttcatgtatatgcaacccagtggcctacttaagagtgaaagtttctctgagaactccaacaccctcctaaaaatctaagtgttcatgtaagataatcatttggattttatcccaattgttgtcaattatgctctgaactttattattactgggttctaggaacaggacagatggaaattagatagctgggaaacatcccaaattttaaaaacctgaaagcaaaaatgacatcaatcatcaaacctcatttcccgggcattgttaaaaccatcaggccttattttaaagccagaccaagaagcagagttttataatccaagtaataatatattgtgggacagtggtttataaaaaaatacaacacatcatttcaaagtagctgggggcctgttttgacctgaaaagatctataaatgtggcttaagagtagcacagctggaactagctccagtattccagactccgcgtccactactcttaaccattacatcaagggaaactgcctggcagggaggattaagaggatatatttaaaaaataatccagattcattgtagcatgtgtggtgtcttctttctggagagagttttggttcctccattttccaatacaattgcagggatttgtctgtatgtgctgccaattgattgaaagatctctttcccttgaaaccattaaaagatcataggcaaagtctgtcttgggggttcagataatttggcttcaaggcaagagattagaagatgacatattgatttacaatgaggggaactgttgggtcttcagttcaaacacccacaagccctgctaatctgttattaccattatcatctacattttccacttatatttaaactgagcttgttggaataaggatgttataacttttttgctgtttaggttgtggtttctcgatcaggaccatcaacccctcatgtgaattttctcctggactcccatccagtgtctccagaagtgattgtggagcatacattaaaccaaaatggctacacactggttatcactgggaagaaggtaagctgttcccacagggaatttccatagacgtggtttttcccaaatgcatatttacaaccagtgtcacttggccctttataatgtctctcttcatcttaaatttacccctcctccattaagttctttagtgagtattccagagatcttctgaaatctagttaatttgttctccaagaaagactagacctaagggaggtctttttcaaaacttctccttttgtcctatatttctcaacaagaaaaataaacacacagaatgagaattacagtcctaatgacagagctctagtgcaggcagataaatcctggaaatgtacattggaatccgactccaaccaataatcccttttctcctagagaagaaagtgcatcttgatgccagaatgacatgcaactttacttagaattttccagagattcaagtgtgttttcccaccacttaaattatactctcttgttattttaaaatcatctcagacagggcacaatgtccctactatgtagaacctctaacattgtgtggcaatgctatgctcactggacaataatgttactttttcacatacctgctaacaataaaggaaaggaaggaatcagatttttaaaattttaatcaccgttatgacaggatttgcacacatagttgctaagtctagaaaattccatcaaatgatatttacatgtaccttttgtgtacttactttataattaattaacaaactagatacccctctggaagctctttccaccccttctcttcacagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggtaggaatctctaacagctggcatacatgtttttgtttggtgttttttttttttttttggtttggtttggtttgttttttgtttttttagatacaaatcccactaatgaaaaaaatttaaaaatcaatttactcatttagctgtgagtcatcagctaaagcaccatctctctcttggctttatccctcgggcagggagggggtggtgtttgggcatccccccaagtcctgcacctgaagtgcttgcttcacattgtctaggttctatcgctgggcagctgctcacctttagtgccgtgtgaataaaagagtggtggtgaataagcaacagtgctccccattttctcacactggggcctgttccctcctgactcacccactctctgattcctcgccacttcctatataggccaagtgcccagacatgagcctccatcacagaaacagatctgttcatggcatatcctggaaccctgagctgaatcctgcaaactggtgatccctgccatgctggggcacacaggacagttttcttcctgtccgatgcatagatggtggccttgtctgttcacagatgagactgaagattatttcccggggtgaggtgggcaaggcaagtggagggtcaacacccatgggtggctgtgagtcttccttcagtgttcccagaaaaaaaagcaaaggctcaacggatgactatactaacatctatacttctgtaagccatgccactctttaattcattccaaaaatatttattgagtgcataccatttagcaggctgccctctagtccctgaggagatatagtccagaacaagatgagcacatctcttgctgatagagaactcagtttctggcaatggacattggctctaacatcgcagccatgctaactgtgttgccttatttgcttaagcatatattcggcactatgaaaatctccacgcaatttttaaaaatttcttagtccaaaacatcttgcttaaaaacacttccctggtgagaacccagtgtgtatttttctctgtgtgcatgtagaaaagttggactttagtaaatagttcttatgaaagattcaagttaaaggtctcggtcacctggttcatgcccaagtaaacaaaatgtgcgagtcagaacaagaaccacccccaagtgcatggctgttttcatttagttacggtttggagcaagatttgtagtgggtgactgggttttaaaccaagttattttctgttaggtgtgacacagttattaagacttagcttgattgaccagagaataaactaaagacagtgacaaaacaaatttaaatctatactgtagtatttgtgtacttttttgttgttcagtatacttttggaaccgtatgcaattttatacttttataaacaaacaacttcagcaatttgagacactaggaatctgaactctgctattccatgaaatagatatggaaaatatatgtgtgtgtgcccatgcaattaaatcacaacaatttcatttcaaaaataaccaagctggtattttaagtaaagaaaatggtttgataacctgtacaaatgaaacatttaatttttactaatgtgcttccttttactaagcataaaagctatactaaaatgcttaaaaataaagtaaatatttcagaattttctggaaccagagaatctcttgcaatatttaaatgtccctcctctctcacccttcttaactctagcattctatagttgatgattctcaaaggttgcgtgctaccatgcacaagtcagtgaggcttaagctgcagttaggaaggcagggcagctgagtccataaatccctctaggttcatagttgttaggaagatttcatgctgcaccagactgtgacagttagcattcttcctgcaaaacataagacagactcgaggtgggtgttaagatggccgagtaggaacagctccggtctgcagctcgcagcaagatcagtgcagaaggcaggtgatttctgcatgtccaacagaggtacacggctcatctcattgggactggttagacagtgggtgcagcccacagaggttgagctgaagcaaggtgggatgttgcctcacctgggaagggcaagggattggggaactccctcccctagcaaaaggaatccttgagggactgtgttgtgaggaacaatgcattccggcccagatactacacttccctatggttttggcaactaacagaccaggagattccctcatttgcctacaccaccaggaccctgggtttgaagcacaaaactgggcggccatttgggcagacaccgagcaggagttttttttcataccccagtggtgcctggaatgccagcaagacagaaccattcactcccctggaaagggggctgaagccagggagccaagtggtctagctcagtggatcccacccctacagaacccagcaagctaagatgcactggcttcaaattctcactgccagcacagcagtctgaagttgacctgggatgctggagcttggtgcagggaggggtgtccaccattactgaggcttgaataggctattttcccctcacactgtaaagggtacagcttcagcagacttaaacattcctgcctgctggctctgaagagagcagcaaatcccccagcacagtgctctagctctgctaagggacagattgcctcttcaagtgggcccctgacccctgtgcctcctgactgggagacacctcccagcaggggtcgacagacacctcacacaggagagctctggctggcatctggtgggtgcccctctaggatgaagcttccagaggaaggaataggcagcaatctttgctgttctacagcctctgctagtgataccctggcaaacagggtctggagtggacctccagcaaactccagaagacctgcagcagtgaggcctgactgttagaagaaaaactaacaaacagaaagcaatagcattaacataaacaaaaagaacgtccacacaaaaaccctattcaaaggtcaccaacatcaaagaccaaaggttgataaatccatgaagatgaggaaaaaccagcgcagaaaggctgaaaattccaaaaaccagaacacctcttctcctccaaaggatcacaactccttgccagcaaggaaacagaattggacagagaatgagtttaacaaattgacagcagcaggcctcagaatttgggtaataacaaactcctccaagctaaaggagcatgttctaacccaatgcaaggaagctaagaaccttgaaaaaaaagctagaggaattgctaactagaataaccgtttagagaaaaacataaatgacctgatggagctgaaaaacacagcatgagaacttcatgaagcatacacaagtatcaatagccaaatcaatcaagtggaagaaagaatgtcagagattgaatatcaacttaatgaaataaagtgtggagacaagattagagaaaaaagaatgaaaaggaatgaacaaaacctccaagaaatatgcgactatgtgaaaagaccaaacctacatttgattggtgtacctgaaagttacagggagaatggaaccaagttggaaaacactcttcagaatattatccaggagaacttccccaacctagcaagacagcccaacattcaaattcaggaaatacagagaacaccacaaagatactcctctagaagagcaacaccaagacacataatagtcagattcaccaaggttgcaatgaaggaaaaaatgttaagggcagccggagagaaaagtcgggttacccacaaagggaagcccatcagactaacagtggatctctctgcagaaaccctacaagacagacacaagacagggatgccctctctcaccactcctattcaacatagtgttggaatttctggccaggacaaacaggcaggagaaagaaataaagggtattcaattaggaaaagaggaagtcaaattgtccctgtttgcagatgacatgattgtatatttagaaaactccatcgtctcagcccaaagtctccttaagctgataagcaactttagcaaagtctcaggatacaaattcaatgtgcaaaaatcacaagcatttttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatggataggaagaatcaatatcatgaaaatggccatactgcccaaggtaatttatagattcaatgccatccccatcaagctaccaatgactttcttcacagaattggaaaaaactactttaacgttcatatggacccaaaaaagagcctgcattgtcaagtcaatactaagccaaaagaacaaagctggaggcatcatgctacctgacttcaaactatactacaaggctacagtaaccaaaacagcatggtactggcaccaaaacagagatatagatcaatggaacagaacagagccctcagaaataataccacacatctacaactatctgatctttgacaaacctgacaaaaacaaggtatggggaaaggattctctatttaacaaatggtgctgggaaaactggctagccatatggagaaagctgaaactggatcccttccttacaccttatacaaaaatttattcaagatggattaaagatgtaaatgttagacctaaaactataaaaaccttagaagaaaacctaggcaataccattcaggacataggcgtgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaaccaatttacaagaaaaatctaacaaccccatcaacaagtaggcaaaggatatgaacagacacttctcaaaagaagacatttatgcagtcaaaagacacatgaaaaaatgctcattatcactggccatcagagaaatgcaaatcaaaaccgcaatgagataccatctcacaccagttagaatggcaatcattaaaaagtcaggaaacaatatgtgctggagaggatgtggagaaataggaacacttttacactgttgatgggactgtaaactagttcaaccattgtggaagacagtgtggtgattccttagggatctagaactagaaataccatttgacccagctgtcccattactgggtatatacccaaaggattataaagcatgctgctgtaaagacacatgcacatgtatgtttattgcagcactattcagaatagcaaagacttggaaccaacccaaatgtccaacaatgatagactggattaagaaaatgtggcacatatatgccatggaatactatgcagccataaaaaaggatgagttcatgtcctttgtagggacatggatgaagctggaaaccatcattctgagcaaactatcgcaagaacaaaaaaccaaacaccgcatgttctcactcataggtgggaattgaacaatgagaacacgtggacacaggaaggggaatatcacacaccggggcctgttgtggggtcgggggaggggggagagttagcattaggagatatacctaagtaaatgacaagttaatgggtgcagcacaccaacatgcacatgtatacatatgtaacaaacccgcacattgtgcacatgtaccctagaacttaaagtataataaaaaatatatataaaaaaagaaaccctacaagccagaagacagtgggggccaatattcaacattcttaaagaaaataatttccttcccagaatttcatatccagccaaactaagcttcataagtgaaggagaaataaaatcctttacagtcaagcaaatgctgagagattttgtcaccatcaggcctgtcttacaagagctcctgaaggaagcacaaaatatagaaaggaaaaaccggtaccacctactgcagaaacataccaaattgtaaagaccattgacactgtgaagaaactacatcaaccaatgggcaaaataaccagctaggatcaaattcacacataacactattaaccttaaatgtaaataggctaaatgccccaattaaaagacacagactggcaaattggataaagagtcaagacccattggtgtgctgtattcaggagacccatctcacgtgcaaagacacacataggctcaaaataaaggggcggaggaagatttaccaagcaaatggaaagcaaaaaaagcaggggttgcaatcctagtctctgataaaacagacttcaaaccaacaaagatcaaaaaagacaaagaagggcattacataatggtaaagggatcaacacaaccagaagagctaactatcctaaatatatatgctcccaatacaggaacacccagattcgtaaagcaagtccttagagacctacaaggagacttagactcccacacaataataataggagactttaacaccccactatcaacatcagacagatcaaggagacagaaagttaacaagggtatccaggacttgaactcggctctggaccaagcagacctaatagacatctacagaactctccattccaaatcagtagaatatacattcttctcagcaccacatagcacttattctaaaattggccacataattggcagtaaaacactcctcagcaaatgcaaacaaacagtctctcagatgacactacaatcaaattagaactcgagtttaagaaactcacttaaggccgggtgcagtggcttacgcctgtaatcccagcactttgggaggctgaggcgggcggatcacaaggtcaggagatccagacatcctgactaacatggtgaaaccccatctccactaaaaatactaaaaattagctgggcatggtggcgggcgcctgtagtcccagctactcgggaggctgaggcaggagaatggtgtgaacccaggaggcggagcttgtagtgagccgcgaaggcgccactgcactccagcctgggcaacagagcaagactccatgtcaaaaacaaaaacaacaacaacaaaaaagaagctcactcaaaaccacacaactacctggaaactgaataacctgctcctgaatgactactgactactcggtaaacaactggtacatttgttatttttcaagttaaataatgaaattaaggcagaaataaataagttctttgaaaccaataagaacaaagacaaagacacaacatatcagaatctctgggacacagctaaagcagtgtttagagggaaatttgtagcactaaatgcccacaggagaaagtgggaaagacctaaaatcaacccctaacatcacaattgaaagaactagagaagcaagagcaaacaaattcaaaagctaacagaagacaagaaataactaagatcagagcagaactgaaggacatagagacacgaaaaaccccaggagctggttttttgaaaagatcaacaaaattgatagactgctagccagaatcatcaagaagaaaagagagaagaatcaaatagacacagtacaaaatgataaaggggatatcaccactgatcccacagaaatacaaactaccatcagagaatactataaatatctccatgcaaataactagaaaatctagaagaaatggataaattcctggacacatacagcctcccaagactaaactaggaagaagttgaatccctgaatagaccaataacaagttctgcaattgagacagtaattaacagcctaccaaccaaaaaaagcccaggaccagacggattcacagccgaattctaccagaggtacaaagaggagctggtaccattccttctgaaactattccaaacaatagaaaaacaagggactcctccctaactcattttatgaggccagcatcatcctgataccaaaaccagacagagacacaacacaaaaaaagaaaatttcaggccaatatccctgatgaacatcgatgtgaacatcctcaatacaatactggcaaaccaaatccagcaacacatcaaaaagcttatccaccacaatcaagttggcttcatccctggaatgtaaggctggttcaacacaggcaaatcaataaacataatccatcacataaacagaaccaatgacaaaaaccacacgattattgcaatagatgcagaaaaggccttcgataaaattcaacaccccttcgtgctaaaaactctcaacaaactaggtgttgatggaacatatctcaaaataataagagctatttatgataaacccacagccaatatcattttgaatgggcaaaagctggaagcattccctttgaaaaccagcacaagacaaggatgccctctctcaccgctcctattcaacataacattggaagttctggccagggcaatcaggcaggggaaacaaataaagggtattcagataggaagagaggaagtcaaattgtctctgtttgcagatgacatgattgcatatttagaaaaccccatcgtctcagcccaaaatctccttaagctgataagcaacttcggcaaattctcaggatacaaaatcaatgtgcaaaaatcacaggcattcccatacaccaataatagacaaacagagagccaaatcatgagtgaagtctcattcacaattgctacaaagagaataaaatacctaggaatacaacttacaagggatgaaaaggacctcttcaagaactacaaaccacaagcaaatggagaaacattccatgctcatggataggaagactcaatattgtgaaaatggccatattgcccaaagtaatttatacattcaatgctatccccataaagctaccattgactttcttcacagaattagaaaaagctactttaaatttcatatggaaccaaaaaagagcccgcatagccaagacaatcctaagcaaaaagaacacagctggtggcatcacgctacctgacttcaaactatactacaaggttgcagtaaccaaaacagcatggtactggtaccaaaacagagatatagaccaatggaacagaacagaggcctcagaaataacaccacgcatttacaaccatctgatcttttacaaacctgacaaaaacaagcaatggggaaaggattccctatttaataaatgatgttgggaaaactggctatccatatgcagaaaactgaaactggaccccttccttacaccttatacaaaaattaactcaagatagattaaagacttaaacgcaagacctaaaaaccataaaaaccctagaagaaaacctaggcaataccattcaggacatatgcatgggcaaagacttcatgactaaaacaccaaaagcaatggcaacaaaagtctaaattgacaaatgggatctaattaaagagcttctgcacagcaaaagaaactatcatcagagtgaacaggcaacctacagaacaggattaaattgttgcaatctattcatctgactaagggctaatatccagaatctacaaggaacttaaacaaatttacaaggaaaaaaaccatcaaaaagtgggccaaggatataaacagacacttctcaaaagaagacatttaggtggccaaaaaacatatgaaaaaaagctcatcatcactggttattagagaaatgcaaatcaaaaccacaatgagatcccatctcacaccagttagaatggtgatcattaaaaagtcaggaaacaatatgtgctggagaggatgtggagaaatagggaatgcttttacactgttggtgggagtgtaaattagttcaaccattgtggaagacagtatggcgattcctcaaggatctagaatcagaaataccatttgacccagcaatcccattactgggtatatacccaaaggattataagtcattctaatataaagatacatgcacacgtatgtttattgcagcactactcacaatagcaaagacttggaaccaacccaaatgcccatcaaagatagactggataaagaaaatgtggcacatatatgccatggaatactatgcagccataaaaaaggatgagttcatgtcctttgcagggacatggatgaagctggaaaccgtaattcccagcaagctaacacaggaacagaaaaccagacactgcatgttctcactcataagtgggagttgaaccatgagaacacatggacacaaggagggaaacatcacacataggggcctgtcgggtggcgggggtctaggggagggatagcattaggagaaatacctaatgtagatgacagataatcttatgtgtcttaaactttgcaggcacaaaatccagctaatgtatggagtttcactttctaatacatgcaagttaacctgcttttcaaggtacatgatgttcagtggctaaaattctttacagttctagatatgagagatttcaggactgtaagcccattattttgcttcaaacatggtatctgatctcatacttaaagagcaatgagaaatgcttcagaaaagggagagcactttttaatatattctgaatgtattaggatgcagttatcatatcttgtaaggttgaaaattcaggccgggcgtggtggctcatgtctgtaatcccagcactttgggaggccgaggtgggcagatcacgaggtcaggagatcgagaccatcctggctaacacggtgaaaccctgtctccactaaaaataggaaaaattagctaggcatggtggcaggtgcctgtagtaccagctactcgggaggctgaggcaggagaatggcgtgaacctgggtggcggagcttgcagtgagccaagattgctccactgcactccagcctggatgacagaacgagactctgtctcaataaaaaaaaagaaagaaagaaagaaaattcaaccccagtgagacaacagaactattcattgatcagaatactcagaaaagcagtattatatagggataggagggtaggcaggcagtatactgccaccagtaaatatatttgtgagttctactaaagaggaaaggagaccccttttggagtttttttgttctgttttgtttttgttttttagttttctcatgttttatcctaatgggttttgaaagcatgatcatttaaaatactgttggaatgggcccatcagtgatgtgatctttcacctgtgaaaagacaagggctacttttgtggctgtatctcccctatccagacaggtaggagacccagcctctgtggctttatgccggacgctcatttcctgcccacagagtttctctgcccttcaggataactcagagtttgccagccattgttgggtctatccaagggtgtgtagttcacaactgcttccttcctttttccctagaagggtaaaggttaccccataagctaaggggaaaatgcccagcccagagagaaaagctaagcagagcgagcctcttggatcctgagggtctagcagagggcttataatatctcttcctattgccagtgccccagttgcgcagctctctgcgtcttttctcaaatcatcacccaatccgtttgccttttatagaaagtgatggtaatgatgtgtgtagagtgacagacttcagtttttacatagaaagacgggatgtaggcagtgggatcaggccaacatcagccttgggcagcgttttcagtggggaagcctcctcattagaagagccggcagcagctgtgtgactgcctcaggctgaagagagtcctgggagggttggatgtcttgttctctcctactggatttctaccataataataataaacagatttatttttctagtagttctcatttgactagacatggatgaggtaaattttcaggaaaggcacaacagtgtaatggatttttatgggtaaaatggctatcataaaagctttaagctaaaactttaaaggggtttgataacgagggtacattaagactttggtttgcaattatttacttaggaaggatggaaatgtttgcaagtttgaatttggctaaaagcccttcttaattgtaaaagaatcacttttagatgttcacaagctgagctttagcaaatacctttactggttcttgagttgcctctatcttagttttcccaccattgtactttacagcacaatttacaatatgtccccacccccaaaagagcatttcctttctcaattgtcacaaagctgctgagaagaagcttatttttaacttggaaatgtgttttgttttaatagttttagcctgagagcaattatcttacacactttataggtgcctaatgcggtcttaaatcatgactgaccaaggtttatcaataaatccattgataacataccagaaatgagtctgcaataacaaaatgagtctgttatttgcttaacatcaaccatcagggggaaaaatttaatcctaaaaatgagatataaaacaataccaatgaagataattaggaaaaattgttacaatactgattttgggccctctctggttccgtttttatctatttctaaaagaaacaacataacacatgtattaaatattacataatttttaaaaggctgagtgtgtcaactaaccagcctggtatacatcaaatagtgaccatatttaaagaacaaggaaaaatcttcagtcattaataaatgtgaactaataggtaaaaagaagtagattcacttttcatttgttagtgcctggtgcataggaggtgctttattaagaaataattaatgaaacctgggcagcataacaagaccccgtctctacagaaatttaaaaattagctgggtgaggtggcgcacacctgtagtcctgtctactagagaggctgaggcgggaggattgcttgagcccaggagtttgaggctgcagtgagctaggactatgccactgcactgcagactgggcaagagtgagacccccatctctaaaagtaaataagtaaataatgaatgaatgaatgaatgaatgaattattggcagatatgtgttccaaaaccatctatatgtttcatattatgctagctgctgaatgcaactgggcaaacactggataccaaatgaggtatttttactgtgcaacttttgtctctgggtggggaataccatagcaaccagaatgtagtgcacgcagccagtgcacagagcaaggcgtataatggctggaccttggcttatagagcacatgaaggagtttgataagagctcagtccgaaggctgatgaagagttacaatcagagttatgagcaagtaaaagtctgggcccaacgtgtttctactcctaccctaaagagccctagaagatgaattcacttcagaatggcccaaaaagggccaggtccaatggctcatgcttgtaatcctagcactttgggaggccaaggcaggaggatcacttgagcccaggagtttgagaccagctgggcaacgtagtgagaccctgtctctagaaaaaaaaaaaatagccaagcatggtggcccacgcctgtgatcccagctactcaggaggctaatgtgggaggattgcttgagctcaagaggttgaggctgcagtgagccatgatcacgccactgcactccagcctgaacaacagagccagactctgtctgaaaaagaaaagaaaagaaagaaggaagaaaggaagggagggaaagaaaaagaaagaaagagagagagagagaaagagagaaagaaagaaagaaagaaagaaagaaagaaagaaagaaagaaagaaagaaagaaagagaaagaaagagaaggaaggaagcagagaaaggaaagaaagaaagaaagaaagaaagaaagaaagaaagaaagaaagaaagaaagaaagaaaagaaagaaagaacggaaggactcgaaaagcccctttattcctaccaagctgcatctgctctttgtcccatctttggatctcctgaaaacaacttgtttcattaacatgtcatgtagttttaatgtttgttccagatgctctgaaatttgtgacccttttccctttagtgaaaattaaatttttactaaattgtgggaaaatgaaagaatttcagactatttaaggatatacattttgtttgttcgttttccatatatgtgaaaaattataatatattgggtttttttaaaagttctatgttgtccttgtaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacgtaaggatcttaaaatgctttgctggggtgtgcttggaaaataggttttgtttttgaatgaatatttcttttaaaattgctcaagaagctcatctcttgaattaaaaagggtcttggcctgtcacatgccttgtgggtctgttctgttttgttcttgtaatcccatttactcattggatttgaagagagagaaaggtgacatggcctaggtgaagagaagaggccagaaatgggagtttctcaaccatttatgcgacaagtcttcaggtgttgtctgagtagatttgcaagagtagcactagttgggatcacttcatccttggagtcttcaaatgtagagtctccaaaggctttttctacagaaatcagtaaacagctcagcatggatcctctcttttaaattcactttctaaacctcagaaatgtagtgaggcagctgaatcacgtgtttgagacttttttagatgagttaaaatttatattcagcttatatttactggcactgcaatatatgggctgtatctcactgaaccatccccacggtcctgggagggagcagtatcattcctataatataaaagaggtacctgaagttcagagagatgaagtgtggcttcacagaggtaatccagagagtaagagctgaacaagccttcagctcagctctgatcatcttctgatccaagacccgtgctagttctactgtattctacatgtacccttctacaagctttgaattccataatcatcagagaatccagaaattattcattatcacataataacaacactcaaatatttaaagttttatggttgaatctttatgattgaacccattctatcaggtggttattttatatctaatagaattcatttcagggttacacaaaggtccgaatctatccattttactgagaccaaaacactaatgaaggtaatatttgttagctgaatggcaaaacaaattttttctagaaatctcccttgtaaaatctccaaaactcttaatcattgcatataaatcaggacctgtaaaagtaaagcataattcattctctcctttaaaaagttatttaataaatcaaattgtatttaaattttctcagaactatatgattattcattcagaaataattctatggaaagccatcacaatttcattatcatttaagtaatttaaataagcatgtacaagtataaccacagaaatgtacctgttgacatactttaatgaagagattggcctatttgtagttagcccattgtttcatatgcatctgaagtggaccaaagattatccccaaatattaatattatccaaacttagattattatgcactattcaactggtgaggtctttatggataaggtctgatatttcctgtttgtctgtataagtgctatagtaccattaatgtaaagtttagtataagcagggtgcagtggcttacgcctgtgatcccagcactttggcagaccaaggcaggaggatcacctgagcccaggaattcaagaccagcctgggcaacgtagtgagactccatctctaccaaaaaaaaaaaaaaatttttttttaattaaccagatgccgtggcatgcacctctagttccaactcctgagtccagaggatcccttgagcccaggagttcaaggctgcagtgagctatgactatgccactgccctccagcctgggtgacagagcaagatcctgtctctttttacataaaaataaaagttaagtttatcatagtatagaaataggattatataatttttggccttaatgcttatcttgaaactctgcttgctattcaaagcagtcagctcaccatttagagttaatgtcacttcctataaaacaacctaaccagaaaattccttggatttgtcatgtattaaactttgggttttttttccagattgaaatgcacagttggtcctgccatgaataagcatttcaatatgtccataattatttcaaatggccacgggacaacacaatacagtacattctcctatgtggtaaggaagattctatcctatcatgtttgatttttacttaatctatttaaattataagatgaacaagttactttgttttgtttttatctcccctccaggatcctgtaataacaagtatttcgccgaaatacggtcctatggctggtggcactttacttactttaactggaaattacctaaacagtgggaattctagacacatttcaattggtggaaaaacatgtactttaaaaaggtgttgtaaatttattttttgttgcatctgtcaatttgaattaatatctgtaccttaaaaattaagcagattgttttgtgtgtgtgtgtggagaagaaaaatcaagatgtttatttgtttactctcctactgacaaaacttcctccttccaaaattcatctactccttttgctgatttttcttcctttctcttgttttttagcaatcctacttttcagttttgtcttcccatccaccctctttattgttatagcttaggatcttagctatactatgagctgtgagagtctggtcattgataataatttaaaataaacattttcatcaagatttgtaattagactaagtcactctggggaaggaagaaatggggaaaattgggtctggaagacagttatgtttctgcttcttagagttggaagagctcagtttaatcaagtaccaaaagtactttaaaggtttttttttcaaatctcaaatgttttccagtcaaggatagcttgtccacaacaaaggtaagtttgagatccagtcagattaaacagcctacactagaaaaggcttccactcaggaaattcccacttaggaaccattgagttatatccttttgatttgtggatataattctaaaatatgtgtatctctaatagctaaaattcacttccttaattttttttgttcagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggtaagtagaagcttctgatgggtataagaaaacaatgaatacaaggatgattttgctgtagaatagtcaagaggaattgcagttttatctctggctttgatgctgttatgttgcttttgaaggcttctttccaattcaggagagaaaactatattcaggttctgagtgtagtttgacttatcaatgctagttcattccaagaagtatcttatcctgttctattacatttaaacagagtatagcaaaatagtttaatgtggcattgtagtatacatgcacttacattatgtacatatcaattctatactaaccttagtgcccagaagtggaattaccttttttcttccattctctagatatgtttttgtcctgcctgctttacacacagcttttctttatgccagactctctttgaattgatatctcattggacccagttcaatctgccttgtttccgttaattctatcagtctagcaacaatagttaagttcggttttctttgtatttttttcagaggtgaaatatttattttgtgtaattcggtgaataaaatacaaatgcatttcttaagcttatgaaatatgcattttaaaaatattttcaagttaaataagttgtttccaaagaacagttacccatgaacttccatttgatgttgactgtgcctctgacctgtaatcagtgcaggtgattaaattgaatccctctcttacagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggtaagtcctttgagcaatggttctactcagagctctgcatctttgcctctaaccatgtggctttcatggtacctgagacatctcagtttcgcctttaaggtttgctagttaatttccttgcagtgtagccaagtagtattttttatttaataactgaaattatctagagtcttgggctaaccatgtggaaaaaatacatacacatacacacatgcacatataatgtttagacaagaatgaagattaccaatttgagacagtgtttttttatgtttgttggttggttggttttgagggtttttttgagacagtatctcaccctgtcatccaggctggagtgcaagggcacgatctcagctcactgcaatttccccctcccaggttcaagcgattctccacctcagcctcccaagtagctgagactacaggcacgagccatcatgcctggctaatttttgtattttttggtagagacgaggtttcaccatgttggccaggctggtcttgaactcttgacctcaaatgatctgcccacctcggcctcccaaagtgctgggattacaggcatgagctactgtgcctggcctgaggcagtgtttttacagacagtcagtacaaatggaaatcacagcatttccctagtccctttttaatgtgtcatagaacatggacccttttgctctaataaaatccttggaaaaggttgctgatcttgcagcagtattcttgcatttctaagcagctgacgtatgctttcttacagccccctgttcttcttatcattcttcttgtccctttgttagctctttcttgaaagagctaacaaagaaagagcattagaatatttatgttatgtcctaaagtgtgaatgttatttgctgtttctccacctatccttattttatataggtcacattaaagtggtagttttagtttagaccttagaaagcttggagttatttccaaagattccatacattttgttgatgtttttctctaatataaaataccataatctagtaggacttgagcactcaactcagaatgaaagttctaagtgctcttgctcaagcaaggtcttgattggtcaggtgatagattgaattacagcacttccttttagattctccatccaatatttcttgaagactaaagccacaatgttctttaattacaaaaaccaatttggggctaaaaatgtcaagccaaatcaccaaataataaggtcatttcaaataagatttttcttggccttctcaatcagccacattgcatcacctctagagagtattattagatttttatcatattcctgagagattgtactctagggagtcaccatatgaagcaaagcattttgaaaccaatccccacacatggccacaaacaaagttagagtaccactgctattaatttaaaggacatcagttctccacaactaagcataacaatgtttcattaaccaaataagaataatagtgaccctctttggtgttggtatgagaccttttaaagtagaaatctgagaaattattagtttatctaattaatgctgagcctccattattaagataatgactgaatttcctttcttctccctcattggcattaaagtgacactcagaatgccttagcttcagtcattcatttgtaatcaaatatttattaaaaactttttaggtgtcacacatgagagttacatatcccaaggatgattcaaacaatggtagacgataaaaatcttatttgtttatatatctggaaatataaacttctgttgttttagtgacaaacatgttagtacagtagaactgtacattagaatcggacaagagtgaaaaattcagtggatctattttactatttactatttattttactgtcgtttgtgaaaagtactttataaggagatatgtattcattccatgttccttgccacttatagaatttaaagctgaccatgatgaattgaacccatttattatttaacaaataaaaactcttggtcaggtctgatttagatatataggtccagccacaataactttaagtccaataaacttgaatcctttcaaaacaagaacaatcatcttcataacaaaatgtatattaaattgttaacatgtgcattatgccctaggagcctgcagtttattgtgtagttctcaaatttcttgttatgtaaacaattattgtgatgacagttaaattgttcatgtccatcaggaataaataacttttagcattataatattaattttatataaaactaaatagtataattttatccatattatatctctatcagttttatctgctgcctatatacatttttaatgtaagatcattttttaaatgattttttaaagaaaatagcaaataacaaattctgtttgtcctttttatgtatatcctgagtcctttttctattgtgggcataagtaattgttttatctccaactatacttgtcaaagaaaaggaaatctaagggatgttgttgcttgtttgtcttttccttgggggaaaaatgcaaccgttaaccttagatgtaccactatgtgttgctggtttagtctaagtacaatcaagaggaagctacattttccaaaattccataaatcagaattccaaagaggaagatttgaaatgagacatgaaagggcatgaaataataatagcagaggctttgtaaaatagagagcataggaaaaggtttcagtataaaatatgtcatagacaaaaagatagcatgggagtgaagacactgaattttggagttaatggcctaggatttatattcgctattctgccactccaagctgtgtgacctggcctaatgacataagtttgcaaagctcagtttcttcatttgtaaactgtgggtaatcataatacccacctataggattatcaggagaattaaatgagaccaactttgtaaagtattttgcacagaacctggcattcaataattaatagcttaaaagacactaataagattacctaacaacatagttaattatcatgttcaccatatggtgcttggtgctttacaaagcactttaccatgtggtatccaacatggtaaatagcattttcatcttaattcctaaatgaggaaactgagttattcagtgtgggccctaccttagttcccatagcttgggttaaagctaggagatgagccaaggccttctaaccccacaaagctgagctcccagtctgcctgactgcctcacacaacaaggggcagttcctccaggtgactgtcctgtcttcttaaggaaaataaaatgatgagatgaaggccagcttcagatagatcagcacagtttatgctgggcaggtggagctctgtgtttctttgaagggtgggttgtttggataattttgcatgtatcgtgtttccagaaatgtgtagtctaacattaggaagttaaatacagattttttcaaaaattatatattttcaattgattggggtggtaaattataaagttgctatggatgttgccaagctgtattctgtttacagtggataattgtgtctttctctaggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaaggtaagaaatgctttaaacactgtcttaaatcatcagctcaaacttaattgacttcatagctatgtgaatacaattgttgtacttggccattgtatcttatacaacaccagcaaatatataaactctgaaaaacaaatctttttggcataaaactaaaagataagaataaccgtggactgcattttaatgaagcattaaaaaaccctttcttgtgtatgtattaaaacgtagcaaatgtgggacacaaattatccattaaagaggatccgcgtcatgcattatcttgctgatgttatacatttccccggacatgttacctaaatgtgctcattataagataaaacataagagctgtgaaagtaaatgcatcaattgtatctccgttcttccttgtaatacttggaattttgtatctgggtatggtcatctctaagctaatttgtaaatggaactagatatctgccaccttaggaacatattagcttctaaatgtaatttaatagagaataacagatcatcttttctaaagcaagcctgttgcaaacaaagaacactaagacccagaaaggttaagtgattgacaagtgacaaaatagtggcagaataataaagactagagtgcagcttttttatgtcccttcagtagtttctacttcaaataataacacaggcaaaatgctcaagacttgaattattcatagctccagtcactagaaacagcaaaatatttatccttcaacatgttgttaaaacatttagaattttttttcctgaaagatgatctgaatgcaaatatgaacaaacataaagcaataggatagtctttatttggttgtaatataggctttcatgggtcatctccatctaagtaataatatgtttccattgaaatttttctgactttttcaacaaaaatttaactgcagcccaacttatgcatatgttcacgttcatacaagtttactaacctcattattgtgttttgtacaataattaagcaagcccagcataaaattgaatggaagcccgcttcaatgaacagtgtgtttacaaaagcaaagttctttcatctgcttctttaattagttttagaaagggagaaataagcttttatcacttctttttttttaataaaactaatctagtgtgaccttttgctttcaacaattactgtgtttgccatttgaaagattccatttggtttttcttgatgataacaaaggtttatgtgcaaatagttttacactcacagaaactctatttttctgttcctgtatctatgatgaagggattagagataaacggttctttatctacccttccaagcacagtctttatggaagagaaaacttctctttccataaattaaatacccattattcaacatcctacaaaattgttggaccaagaaaaacataatttggcatcatcctcggcctgtcaatggtattcccaacatggcgaaagggtcttctagagactggcaaaaaacactttattttcttgcctatatatggaataactctttctctaacaagtgtatagcacctgccacgtgacagaatagtaatctagtgggagcagtggcaattcagggagattattttagtatcatggttcaatattttttcatacttcatttttcttatgtatgagaggaaagcaaaggcataagagaatatttgttgtgtcagcaatctaactctttatcaatacgttaagttgatcacattaaaacttctacctctcagccaggcacggtagctcatacctgtaatcccagcactttgggaggccaaggcgggtgaatcacttgagatcaggagttcaagaccagcctggccaaaatggtgaaaccccatctccactaaaaatacaaaaattagctgggcatggtggtgggtgcctgtaatcccagctactcaggaggctgagggacggaggtgacctgagtcctgaaggcggaggttgcagtgagccaagatggcaccactgcactccagcctgggagacagagcaaaaaaaaaaaaaaaaaaaaaaccacgtacttcatcaatgaaagtgttctggagagaatcatgtgtttagaatgagatatgctctttattgccaggaagatttcatgctcctcatgcagccatgcatgcaagagttcctagggtgaaaagagattgtgatcattccctgccctagttgtgagagtccctcaattcatagtaagcccagtgactacaccatgggcaaaagggcgagccaggtttggatgagggaacacaataggggtcaagcataagtcacccctcagaatgaatcctaagccccatggatggagaaggaagtttttggccaaggcttcaagtcccccaagagcagtcgtagacagtggtcatcaaaagtaggtacctctttgtgggtatacatgactccccaaatgcctctatcaacaacagctcatgtttgtatggaattttacagttgacactgtactttggcatattttatttcatttgagtctcatgtggacccatgaggttgggaggtcagtgatgattatccccatttatagataggtaaacaaaggtttaggaagattagctgatttgtcttgggtcacccaggaagcaaagagcagaactggggctcacactcaggcttcttgattccaaatttggtcttctgtcactgcatacactaaattacagtatttcttatattaactctcatttaatgtatactaaaataccattatagagacacttttctatcatatgctatttatatatctatgcagttctttagagggaatagctcttaactttttataaatatctaaaaatttattctgtttaaagaaactctgtatttctccctgagtgtcttatttctgactttttatgcatgagcatatcttatgaaaagtagaaaagtattctgtttcatgctggaacaaggactgcctgacattgccttgggggtttatcttattctgcagcatataggaacatatgagaataaagatgcttcaaatgttcaatctggagaagtcaggtcaaacaggaaaaagaagcacaggaagatgagccagggcagggagcggggacttggtctatgacactgtcatcacaggaacaaatgctgagagctcaggaggaggtgaagcatcagtgtgtgggcattggaaggatcaaaaaggaagcatggttttgaaccatcctaatccacctgctgcccagagccagccagatgttgtccttctccctttgaataatttatgtgcaactctacccctcaatctcagtcaaaaccaccatgaactcagttctgagtccagacaggataaaagtgaagggttcttttttcagaggttatttggcccagtgtcgaaacctgttcttattaatggtgctcaacgcttactctcaaactagtatttctttgtgctgcccaggttaatgggcattctgcaaaatatatatatattctttttccagggcagtttcatagtatctaataataaagatagtaaaaaatatattcctgtggtttcatggtacctagtagtaaaggtccccaactagccagcaaagccaccagtttaattttggtttgcccagcttttcccaaatggccagggaagttttccccaaaatgcctattaacatctggtggaactcagttctgaagctgtctgtgaggttcgttgcttggttcctaagttgagggacttgtgtcctctatgtgaagtgtaaatctcaccccctcaccaccacctcactaatttcctactgctgatctccctggactttggaccctcagcctggctgagtcctgctgccaaactgtactgacttgcccagacccagcctgtggccacctgggtgtatgaaaacttgaaggaccctcctctcatagtgttatttttcagatcctacccacttccactcccatctgctcggttctgtaaccatctcagacatgagtccccgggtgtgaatactcaatagaaacatgtcacacctggccagggttggagaggaaagagacatggtacatcctgatatagcacattgggagtaattagttttcatttttgaaatggatccattttgacattgcagtgagaggaagaaatccttactcatctttatattctcagtgactagaactgtgtctaacacacagtagacggtaagtagattttgtgtcaaatggaatttgatttgcttcatgatctagcccctttctggataatagttctccatatgtaaagcagaaatgacaataatacctacttcagggggagtatctttgcaggataatatgagatgattataactaaattgctctatgtctgttggagattaaagatcagaaagctctctctcttttgttgctttatttttaaacccacatattaccattttagtgactgaaatcaccctgaagcagttgaatgacttttatttaataatagttaatattcaataataaatattaatataattaatagtaaaatttctaaatataagttttttagcatctcaataaagctatgtttactttcttttattttaaatgacaaaaattagcctataccttttaaaatttttccttttttgggccccattgttatatagaagtgagctaccagtatcacttttgtaatatctgggactttacgcttctaatatgcatatatatatatatgtgtgtgtgtgtgtgtgtgtgtgtgtgtgtgtatacatatgtgtgtgtgtgtatatatatatatatataactgatagtagttgcttatataagtcactacttaccatgtgtcctttggtatctacatataaaatgagacacagtggatgtgtgatctgtttttgttttagagaagcctttatgcaacaaccagggagatcctaagcctgaaaccataagtattggaaacacaaatgttgtacattcatcccttcccccaaccttagttattatctaagcaagcaagacacattttagaccttttctcataaatcaaatcctacagctctttaatctcttttctttgtcattccctgaattccctccaatatgtggataagggttttatcccccttcagacctagccaacaagttgtcgtttgaagccctaaagtcatctcttagattgctgagcttctgtgttgtgttggcctgtgtggctgacctggttcaatggactacacatactgcttctagaagtatcataaggatagggtttgtctatatccattttatctgaaactccaacatcaggttataaagaagtattttcttcccacttcttttcctagaataataactgcctgaccaatcaatctattgagatccgtatgagaccatgtatgtgaatggagtttgccgagtattaaagattatataaaacaaaggagcagcattttagctattatgggctgctctttgttagtaagaagaatagtaatatgctttgatatatgtcacctcaaaataatagcttgctcaataaataactgtactcattaagtcttgatatgagaaattatacctaggtttgcacttctttcgcaaggctaattattggtttctcaaacaaaacgttgatatttttaaaatgcctgatggtaacttcagttaactaaatatgccacattaactaatttttaaaaaatttttgtgtaactatgtaattgttcaaaataatggaattgtgctctcaaattataatagtcatacagcatctcacataaatttcttttaaaatgaattcacttatgtataggactcaagtgtgcaagaaggatgaaagtaaactacccaactcaaacaaaaaaagaatgtattaatattaacataacataatacagtgttaatacattaacaactatttaacatcagatctctggagatgagacccggacatcagtattttttaaagttttcacggtgattccaaaagcaaagtcaaggctgagaatctctgcattgggcagtgttagatagtgcaacaactgaatctctacattgcgtcttttttgccaaacattgataccccctgaggacaatggtgaggtgatgataggtaagacatcattccacatttaaggatgtgaagcaagaacctctttccttttctttaaggtccaatttgatgcaaaagctatatgctataattcctaactaacacatgccctgaaatggtcatgctcccctttagccatcccaattcccatgaaaattagtatcatagaatcgtgtgccttggcaaacaacatggcctgtgtttgcagtatatttatattcctttgccattgttagcattcctgcagaactgtgaagtgttaacaacctttttttttttttttcctttcagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagaggtgggattcctgcattcctctcatgatgtaaataaggaagccagtgtaattatgttattctcaggcttaaaataaatcattaaagctcatttatgtgtgggttttggctcatcaactcagcctgcattcctagttgttattttagaaatagtgagctttttgccacattgtctccttccccaagcctgggaggtagatctcaaaagttctttctacccacactgcttctccatcacgccacactcttcccaaaatttgctgtaattctcagaagaaataaggatgcatccaagagtgtccttctactgcctcccaccaccccaggaggccagagccagtgttccactgccaaccactgtgatcactaatgcatagagtcccataaataaaggaagatgcatgcatcaaacaaagtaaaataaagattaaactactttacagtaacttttttcgtgtagacaactgaatcaaacaagctagaaccaaagcgagtgatctttttcattctttttttagcagctttattgtgatgtaattcacataccatgcaattcacccattgaaagtgcacagttcaatgggtttcagtatattatattgtcaatttctttgaattgaggtaaaatatacataatgtaatgtttgccattttgaccatttttaaatgtacaattaagttgcattaatttcattcacagtgttgtataaccatcagcattacctaattccagaactttttcgtcaccccaaacagatactctataaccaataagcagcagctccacatacccttctctcccccggctcctgataacttccaatctactctttctctctagaatttgcctattctagatatttcatgtgagtggaatcatacaatatttgtctttttatgtgtggcctattttacttaacataatgtttatccacgtggatgaacataagattcatccacgttgtagcctgtgtcggtacttcattcctttttgtggatgaataatattccattgtatatatcccacatttatccaagagtaagtgatttttaaagggttcctgaagtcttctgaagttataaaatggaaaaacacacaaaaattagaaaatcaaaggctgaatcatgagatcagagttggaatttcagaaggaccataaatcctaaaaatcataaaatgttagagccagaagggacttcaaagatttctgctgtgtatcaaaactgaagtaaaaatattctgagactttattgttccatcataacagtacaattatttacctcttatgggaagtcttctctgccctccaccccaccgtccaggacagaattaatgtcccattgtctctgttgattactgtttagtcatacttctatggtacataccacactgtactggaatcatttatttatatgtctgtctccccttctatacttcagttcctgttttttgtacatctttttatccctaatacctagttacaaatacaaacagctaagtaccacataagtacttaagggatcagtgtcccctaattatttgaacactggagcataattgaggaatctcttattatcctgaaggcagttatgccatttgtagaatggtaataaccagttggtatttgggacccaaagtgctacaacctgtgtagtacaaatatctatcatggctaaatgctgacttttctttatttgtcatttttagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaaggtgcatttttgttactgttcatttttagaagttaccttaagaacacagtcattacagtttaagattgtcgtcgattcttgtgtgctgtcttatatgtagtccataaaacccatgagttctgggcactgggtcaaagtctcctggggcccatgatagccgtctttaacaagctctttctttctctctgttttaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaaggtatatttcagtttattgttctgagaaatacctatacatatacctcagtgggttgtgacattgttgtttatttttggttttgcatttatatttttataaaaacctaaaggaagtatttacctctgccaagtaagtatttgacacaaaattacatggctcttaattttaaaagaacccatgtatatattacattatgattttagagtccataagctctcatttcacaaaaaggttaatttgagcaaaagtaatttgtttatcatctaagtgcaatagtaagaaattgcgaagctctcttttacaatccaggaagagttaagttacaaaatatacttatttaaatgtaagttggaactgctacattttttacctgttgaagcccaaacattgaaattatactgttagtaattcttcgaagtgttttcaatgaactgttagtacacagcctttttcccaccatattctaggacttgaatgtattttgagacttagccaaggaaaaccttcaattatgccatgaaaaaaaggaggggtcaatatcatcagctttgtaaaacactatgcctagtaatgttcaggttaatcagagttttcatgttgttttatttaaatctcctggtaaaagcaaaaggtctgtattgtatcagctccattatctttagaagttacaggatgtgagtcaagtacaagcatttccttggttgaatatttaccattggacaaataaaatgagtcacagatcattgaggatactggaaaagttagaagttgctcatccaaacaagttcaagagcaatgaagcacttaacattttaacattttcaacacttactacctcttatgttttgaagtttatgttatttctatggagatacacatagtaaacattgtctttgccctgattccattcacctttaaaaatccattcgtttaaccgtgtggaaaaatcaaacctagtttattgttttgaaatttagatctatttagtattttatgtgcacatttagtgcatctatttagtattttatatgcacatttcatagttctaatctgagatcattaaaatttacaaattttctttgaaaaaaaaacttacctaatcttctttgaacctccttactcaccaaagctctgtcatcattgctaagaaggttgagtttcacactcttttctccattgagcctgctccttggagacatgaaaagaaaacaggtaaaagagggtcatttagagagaatgagaaaataggtgcacagccaaaacctaatgaagaggcaactgcagagctttcctctctacatctggtggggacagcattctcatcagactttttcacggagacctagagtgctatgtggtgtgacatcagggtggcacactgatggtttcaattggtttctgcacatgttggaatttagctgaagagtcacgttttcatgccaaagggcttttatccatgtctcaccaaggatttccctcaatctgtgcacccttaagcatttagagccctgatctccagatgcaaaggctttaggaagtgagaatgaaagacctgagtttagagaggctgattggcattcccaatcccctggggaaggtttagagaccctgactccttggaattaagggagcaagtacccagctaggctccttccttcctcactcacccaacatttcaggtacttcactgatgttccacatccttctttaaaggttgctcttgtcttttttctggctagtgtctactataactgtaattgatgcccaacgcttttctggaaccacttttggccaagttcatttattattaatcaaactgtccactgtagaaaatactaaaaatgctcaagtgggattaggaatagtcaaggtactaacagcattctttttatgcccttctctcagattctgattctcctgcttatttgcaaacaaatgatacattttggtgctaatgaggaacccccacataaccttctccctgtgttacatactaatacatttcaatactatgcctagtttatcttcatgtcagttgctgtggctatgatgccccctccttgatatgtgtgaattcccagtggaaagagaaagggaaagtggaaatgccctatttggcattaagaaattgactatcagcaccatttcttcccctgaaataaaaaaaaaaattctccttgcaaaagggaactttgcctgaggttcttacagagctttggttataaagatcaacttataaagaatgcttacccctttcatagtgtccttaactaaacaacaaggatggtccactaaccgagatctaacctgccttctctaaacaacagtaacactaaatccagtgccatcactgcacagtggagaatttaccactaatgtgaaaagctttcagttttgggaatatagccattatttatttctaatcatatgtgtatttttcccttggccaggaatccataggttttgcacaatagtaattaattccattaacaaatagtagtgtctcaaaaggcatctttttcattttcttatatttgagctggatttttgtgagacgaggcaattgctcaactacctttgctgctaccactgcttccattcttaaggacatagtatattcaaaaataaaccataagcatggctttttgctattgataaagagagaaatgtctaaggaaatgagggtaaaaagctttcaaaattaatacttagtctacttaaatgaaaatctgtaaacatctaatgaaatgcttgtatatataacttagtatcttttcccaatttattatcatttttatcaaactaattccattataaaagctcttcctgtttcagtccccattaaatgaggttttactgttgttctttaataattttccttcatcttacagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagaggtaagtatttccactcagctttttgttaaatacgattttccagtaagcattttatctttggcctttgcagattaggaacttagacaatggtgaaagcaactgacagagcagtgataacaagtgtacttgatttctgttctatagaaatgtagccctgtaaatcatatccgtggggatttgcccttgtgcatggaagcaattggataatcccccaaatatattagaactaaatcacaattcgtcctcgtcctgtgtgtactagcaattatagtttcttcaaaggtgccatttactttcttctaaaactcagggccaggcgcagtggctcacacgtgtaatcccagcactttgggaggccgaggcaggtggatcacctgaggtcaggagttcaaaaccatcctggccaacatggcaaaaccccgtctctactaaaaaaatacaaaaattagccaggcgtggtggcgggtgcctttaatcccaactactggggaggctgaagcaaggagaattgcttgaacccaggaggtggaagttgcagtgagccaaggttgtgccacagcactccagcctgggcagcagagcgagactccatgtcaaaaaaataaatacttataaataaataaatatcactcctttaattttgagtatttttattcaatctctctccagtctttctttaccctgagaacagtgacaaactctatgaagcctggtttatagcagtttgtacactgctggacagcatcagaagacagagaatttatagcattctcctgatctaaagcaacatatatcatctctacaatgcactccaatttctttatacaaagataaatgaatatttgtaataagctagccaaagcagcaataacagctagcataaacagtatttgtggaaatatttagcaggaaaagaaaccaatcaaaaaccgggaaatgaacttcattcttcttgttgtttttttttttctaaaaagcttttacccttaatactaaatggcctctgatcccttttattctatatgtgctgcaagaggttgtacaggcatctgccagtgtgatacaagagaagctgatggcgtgatttcccttatatgaacacaaggccttctcactttcctgtggtagcatccacacattcttctgtcaaacaccccagagcgtaatcctttgtgtgctccttcttccccaagagtggcttcactgttaacaaacatctttccatttctcttcagagtaatatatagttctgtcataggcctataaatcccagtaattgcatcaattttagagtgtgtggactcactaattgtgttctaattctacacatttggaaaactagaattttttatcatgaaaggtactaaaatggcaattatttctcttttgaagttataatcattaacagctctataaatattagctactatgtatttatatgtttttctgcaggagaataggagcactcaaaagcataagttttattttattcttctttgcattagtagagggcagcctaatgcctgacactcacatactaggcactcatggtgtcttggccagctggatgaattaattagtgaatgacttacacagctatcagacatttggcacctctgggggaaattactgccactggataaaaggctaccattgggaaaatgatgtggttaaagccagagagaactggatgaagtgagtcagggtgaatttgcttcatctgggcaactgcctttcagtttctgccaacctggattacgtattaaccagtgactaatggggaaatccttattctataatactaatcctatttttaatggtaacatttttatttcatttcagcttattagaatatagagaacttattttattatagttcttcatgtgggttaactttattttcatattttaaaatactatgtcatcctttaaaaaaatttatttgatgaggccgatgttactcaccttttcagtggttccactgtggttgaatattttattaggttaggctttaatatgagtcatatcatctacaacttattcatgaattaaataatcacattgcttatatccttgggtgaaatgtgttgcatctacatatatatttacaaacacacctacgtacctatagtggtattgttaaaagtattttttaaatgtactcttttgctgtatagaaagaagaaagaataaaatgaagctcataaagggtttgataaataattatttcataattaaatgttacgcagtgctaaccaagttctttcttttgcacagggcattttggttgtgtatatcatgggactttgttggacaatgatggcaagaaaattcactgtgctgtgaaatccttgaacagtaagtggcattttatttaaccatggagtatacttttgtggtttgcaacctaataaatagcttataataaaacgttgatttacactttccccttgtggaaaaatcagctaccactgaaattatgggcctaatcctgaaaatttgttttgttctagacttttattgaactacttcccctgaaatgatccctcagagccctcattagtaagggggtaggagaaatgaggttcttggatgaactgagtatcatttaactataactatgtttggtttataatatttgttttgcaagtgacatttctggaaactattggaagcatgttggcacctacagtagtaatgactcattttacccagaggcattactataattattttttaaccacaacttccattaaaaagataaaaaatgaaataagacaaacaggagaaaactacgctggccaaaaattgaaaaatcataagtatggtaatacctcatttatccacatttttggagagtgaggcattccacatacatgaacttcctaaataaatgaaacctacccctttttaatgctggaacattacttaaaattttagctgttattgagaaaatctttttaagatgaaatgcatactctgtttaagggaatgcttccaaatacaaactaagtctttattggtgaccccaagccataattacagccataaattactatattacacaaacagtgtactccacatacatagtgttcctggctccgcctgtgttgacaggtctcacatgcttgcgttttctactcccatttctcattttctgcttgcaaattgcagcagcctgaaaaatgttaaccagctctactacaaactttatatgggacttaataagctttaagtgcacaaatgaaagattttcctgcaagatactttactgtcacaattatttcagtctttttaaaatataaatcaacatgctaagtagtgttctacatggttaattttgttggaagtctgaccatgagggaaataaatggacagtctttatgaaacctaagtataacctttgcactaagtttataggagacaaactggtggctggttggactctatcttgcaaaagtgggcataggtggtgactggaaggcacagtgcacggtggcatcattcactcagatgtgatgtaaaaagaacactctgcagtcaaaccctcaggacaagatgctaactgtgtggtttaccatttcattgctcttcctatctaaatttgacaaaagtattcactgttccataatgaagttaatgtctccaccactggatttctcaggaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcatgtaagttgactgccaagcttactaactggcaaactagctgtaagccagccatcccttcaaaataggcctgctctgagtctttaaaaagctagtagccaaagatgcacatttaaaatgttagcatcattcaaatgcacctcaaagtcttctatcctggtgggaaatagtgacacctggaagggtttcctggagcaatgattcttacttgctctgcaagcaaccttgctctaccttccctctgatagggacatttagtcatctttgcatgtctactatgtgccagaaactgtgcacagcacaggagaagtggaagcagagcaagcctcagcccatatggaatgttaactctacaaggcattgaaaaattaactccagatgcgttccttgctgttccttgtccttgccatccactctcacacctcaggaactttgcacttgtgctccctcagcctggaacactctccccgcaaatagccacgtatctcacttcctcatcttcttcagcttttggccgtaatgccatcttcaacataagccttccctaatctgtttaaaattgcaactgaccacccaccctcatggcttcagactcctcttccctgctctattttcccccatcacacttaactgtcatctgatacatgcatgaagctgcctgaagctgcccaatactatggccatgagccacatgtaaaaggaggctagttcgaactgaaatgtgctgtacggtgtagaatacatcccagattctgaatacttagtattaaaaaaaaaagaaggtgaaatatctcactagtagttgtttatattgattacatgctgaaatattttggattttgggggttgaaaaatacattgtgaaaattaatttcacctgtttctttttacttttgagtatggctactagaaaattttatattacatgtgtgtcttgctttatatttctattgaatagcactgtagtagataataaacaaataaacaatagctatatagatgtatatgtatgcatatatatgtacacacaccctcatcccattagaatggaagctcatgagggtaggatttttgtgtattttgttcactgctgtggctccaacacctaaaacagtgtttagcacatagactcgcagtaaataattgttgaatgaatcagctaagggttacaaaaaaaggttcttagcctcttgcaagtggtagatttttttcttgacatttatgccaggacctaaaagtcaccaggccaggaccagggagggtgggaataagaatctcaagaactgaattcatagaaggcctcaagctccgtctcggttcctgctctccaagtctctgtgggaggtaatgaagttgatcaaaagcaactttataaatatggggtcaaattatcagagaaaataagctctaggagagtaatgagatattactcagccaaaagaataaaacattccctggcagtgaacttttgcagataaggcgaattgaccttacaaagcacacagctgccctgacagaccccactttcccacttcaacttttgttattaccctgatggattaatgtggctggaggtgctaccttctctagggtactgttaccccaggattaaagcatgatagagatttcctgttatccagaacggaatagtgccatggccttttttaatccaaggagctgatactgagagcaaccacaaacccagatgtgtcttaaagagaaacctaaaaccaggaactggcctttctctatgctgtgtgcattgagtggggctacagcccttttgcagggtccccactgactacatcttgcactgacaaactcctcagtgactgttgaaggggaataccccattcctgattgccagccagtgacatcaccagacttgacagctgagtggtttggggtgatttctttctgagcctcctctattcactgtgcttctgatgttctaacatcttgggccttactaaccctggaggaactgtccctcccaaggctagctaattcctgcaaatagtaaacagcttgccttcaaagcatacctgtcatgtgcaaaccaaccaatccagagcccttatctaacctcctcctttatcaggctcttacactttgggctactatccacctgccctaatcaccccagggcccagttccagacaactagaactatcctcggagcctgctgaaatactccagattggccagctccaaacctgcttaccctgccttaccagtttcttcccagggaaactgcaatgaaggctcttgctcatgtttttcccctctctctctctgcctctagagcccagggcttcccccatgtgaccctgcatgacagggtgtgcctcctcctcttgcaaactgtgaatagcaaactatcttttcaatggcagttgtctcctgttctgttggcctcatcatacctggaaaataataaaactacattttaaaacacctccattttcccatctggaaaatggagcctgtaacacctgcctgacagaagtgtagaagtagctgtaatttatgaaaacaattagcctggtgtgttgcatacaataaatacttaacaaatggttgatctgtcaatggggcacactttttgttgttgttgttttgttttttgtttttggagacaaggtctctgtcacccaggctggagtgcagtggcacagtcatagtgcactgcagtatccaactcctgggctcaagcaatcctccttcctcagactcctaagcagctgggactataggtgcacaccaccacaccaggctaatttttttgtgggcggtggatgggagtaaagacaggatctcactgtgttgcccaggctgatctcaaactcctggcctcaagccatcctctcgccttggcctctcaaagttctgggattacaggcttgagccattaagaccaaactaatttttgagacaagataattttttataaataaatatttcagaattctaaggtcaaaattagaacagtagatgcttagtttatgcttttctaactctctttgactgcagaatccaactgtaaaagatcttattggctttggtcttcaagtagccaaaggcatgaaatatcttgcaagcaaaaagtttgtccacagagacttggctgcaagaaactgtatgtaagtatcagaatctctgtgccacaatccaaattaagtgacaaggaggaatctgtttcccactgttcaatgctagttaagctgttttctcttcttatgcaaaagtcctttatttctgttacaatcttaaatcgatgtgtaagccctggggatgtgggtgggactttcagactttatccaacagagaatttaaaaggattctccatagggggtcttaaacagctgttgtgtacttttgcttttctcagtccttccctccagtagctctcaatgttgtggtttcacactgcattagtgttggggagggagaatttgatcttcagcatttgacagtgaaaaggagagggctgggaacacaaataccaacatattgcaacttcccaagagtggatttgaagccagcctgcagaagccctaccaaaaatggtatttggcaatgaatatacaaagaactttatttgtgtctggctgcctggctatgtaatacaacagtcaacagtttgtaattgagttcatgttttcccttgcatagcactgattcatgacttatggtatgtgtgaatgaaaaagggtgtgctattaatttcctaccttggttttggtcactgtaacaacataaaagccagcttaaacagaggatgcatagccccagatagcggaaattgatttttgttgaacttcgctgtttttcttagatgctttactgtgtatcctagttctctattacctcagtggtgggatatatgagttttgtgtgctaacctagctcatttaagaatgaaaaagtaaagtatcagtcccctgtcatgctctcccataaaactgagtatcgctaatcagttgacaagcgaagattggtgattgcttgggtagttaattagcatacttcatttagcaaccaaagtaaacccacaggggagacagccttactactgcagatctacattaaagcaaaaaggactttcttatgccatacaattcatgatctctttcctcagcctgttgaattggcaatgtcaatgtcaagcatttttattcaagaattctgttgtaatttagtgttagtcaatagaggccagatgaaatacttccttcagaagttatggatttcaaatactgaagccacttgtttaatctgtagatattcagcatcattgtaaattattctatttcagccacgggtaataatttttgtcctttctgtaggctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtggtaatgtattggttatctctgagtttctcctcttttactttcatatccaactttttttgaagttttatcactacttaattttttaaaaaaattcaacaccaccaattccagttttcttcatatgtaaaaatggacttgtctgatacgtacacattgtatattttcataaattcactcatttgttcaaaaatatttgttgagtggggcaacataccagctccttaggaagcccagagctgaaccaggcatgaaccctgtcggccaagaactttggctcagaagggaagagatgagatggtcaacaatgactgtgacacaggtggcctggaatgggccctgattctcatagccccaggcgagcaagaattccacatcaagaaatctggaagctgtaactgaggcagtctagcagtgagggcatgatccctgggcctagctagtaaagtgccttcccttatctgcaaaggccatccttcttgcgcagaacaagctctcaaaaggcatgcacctgagtgctgaggctgggagaaatactcacctgggcagccagattcaccacattccccttccaccatatggagaagtggcatttgaattgggttaaaggacagcaggtttggagttgggcagctgggcaatggaaataccgatccaggtgtggcagaagagcaggaaagtataagcacctgtaaagttataaggaaacagtacttagttatttggcaagaacagaacacagagagggaagttatgagaataaatggagaaaaatatacttatactaggtcatagagttccttgaaaactgaactagagagtatggaatttattctctggtaatgtggaaacaaaaaagtaatcagattagactgcaatctttcatcattgtattagtccgttctcacactgctataaagaaatactgagcctgggtaacttataaaaagagatttaattggctcacagttctgcagactctacaggaagcatggctggagaggcctcagggagcttttacccatagcagaaggcaaaataggagcaggcattttacatggcaggagcaggaccaacggggctgtgggaagtgccatgcacttttaaacaaccagatctcctgagaactctatcacaagaacagcaccaaaggaagaaatctgcccccatgatccaatcacctccaaccacgcccctccctcagcattggggattacaattttacatgagagttgggtgggaacacagagtcaaaccatatcattccgccctagttcctcccaaatctcacgtccttctcacatttcaaaacacaatcatgccttcccaacagtcccccaaaatcttaactcattccaacatcagctaaaaagtccaagtccaaagtctcatctgagataaggcaagtcccttctgcctatgagcctgtaaaataaaaaaacaagttagttgcttacaagatacaacgggggtacaggcattgggtgaatgctcccattccaaacgggagaaattggccaaagcaaaggggctccaggccctacacaagtccgaggccctatgcaagtccaaaacccagcaaggcagttattaaatcttaaagctccaaaataatttttttgactccatgtctcatatccagggcacgctgatgcaagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcaggagcaggcatcttgcatggcaggagcaggaccaagtggggggagggggagcatcttatatggcaggagcaggaccaaggtggtgacaagctttcaccaaggggagaggtgccacacacttttaaacaaccagatctccgtagaattctatcacgagaacagcaccaaagggagaaatctacctccatgatgcagtcacctcccaccaggcctcagctcccacactggggattataattcaacatgagatttgaatggggacacaaatccaaaccatatcaatcattctccaagacaacttgaaaggagtagaagcaggaagatgaagtgagaagtggaacttgaaataagacacaatgagaatggaaaggaagagatgaaaggaggagcatctcagaggtagaatcagaagtatttaccaaggaattgataaaaagtcaaagattagcaaagatatatgctcatgcaataacacatatatgaagcacagaagcaaaagctggactcagaacaaaaatagcaagttgagccttaaacacactgagtttgccttgggagtagaatgtccaggcagagaagtccatcaggcaattgaaaatgtgaatctgcaacttgtaaaaaatgtattattcagcctgggctgtcatacaatagaccacagactggttggcttaaacaacaaaaatgtatttctaaccattctgaaggctagaagtccaagatcaggatgtcagcatggttgggctctattgagggctctcttcctggcctatagatggccaccttcttgctgtgtcctcacatggctaaaagaataagagtcagttctccagtatctcttcttagaagggcactaatcccagcatgaatgcccaccctcatgaccttgtctaaactgaattacctctaaatggccccatcattaaacattgtcacagtggggcttagagcttcaacatatgaatttccggggaacacaattcagtccatagcaggggtcaaggctgggaatatgcttttgagagtccaaaagcaattattcagtagtccaaaagcaattattcaactacatatataaagtgaaagagaaaagcagtgaggtaagggacccagaagcaaagaccaccatgaaagtcagagtaagagaaagtttcaaggagaaattggatgctcaacagagtccactgctactcagtacaccagaagggtcttggaagctgagtaacttgagtgatttggaggtctagagtgtgcttaggagcacaggtgttgaatggaatggagagtacacttattctattcacatgttgtaagtcagaggactgtgatgtctgaagatagagaaacatttgatgtttcagtccttaaggatgacaactaaaaaaggaaaatgtgcaaacaaagtagtcagaaaataatgttcatgggggacatgcacttgaagagaaagggttggtagcttttgagagatgatgggtcagagatctgagtgtggcatgggaagcaagaagtcatctcatccacctctctgtgaatcagcaagagggagaggtgtgacccctattggcaagagttgcaaagaaattgtgacttcaactgaaagctgagtttcagttcctgtgaggaggtaggggaactattagagaataagacgaggtgactgggagtttgttttcaatgagtaagtaggtcataggtcatggtggaggaccaggacttcagcatgcatgagattggtaagagaaagtgatagtgccatgtagagcttaatgcctgggattttgatcctgaaagattctgaaagaggtgaaagaagtgggtgctagagagggagactggggacatgttagtgacagtggcaggtgaaggcaaaagatagggagaattaacccatcctccaagaacatactgttcattcagacttgagggttagtctgccattaagaagccagagccaacccttacaactcaataataagactgtcttagtcgttttgtgctgctataacacaataccacaaattgggggatttataatgaacagaaatgtatttggcccacagttctggaggccaggaagtccaagatcaaggggccacatgtgctgaaggtcttcttgctgtgtcataacatggtggaaggcatcacatgggtgtgagagagtgcaagagagagcaagaggtgaacagattctctaacaaacccccttccacaataatgaactgactcccaagataatgacattaattcacccatgagagtagagcctcatgacctaattacctcttaaagatccctcctctgaacactgttgcattgggaggggattaagtgtccaacacatgaactttgggggacacattcaaaccatagcaaaggcaatattactcaatttttttaagtaagcagaagatttgaatagacattttaccaaagagacgtaagaatagctagctaatgagcacatgaaatgaaacatatgcccacatgaagatttgtacatgaatgatcacagtagttttcttcataatagccaaaaaccagaagcaatcttaatgtccatcaacgggtgaatggataaaaaaaaaatgtggtgtgtccatacaatggactaaaccattcatcaacataaaggaattactgatgcctactacagcatgataaacctcagaaacattatgttaagtgaaaaaaaggcagataaaaaaattacatgttgaatggttccatttatatgaaatttctagaaagaggcagaactacagagtcagaaaacaaatcagtggttgcctggggccaagagaaggagtgaagataaaccacaaatggacatgagggaattttctggaatgttgagatgatctaaaactggactgtgatgatatgatagctgcacgtctatataaatttactaaacatcatttaatcactttaatttactaaacatcaccaatcacttaaaattggtgagttttatgatctataaattatacctcaacaaagctgatttataaaaaaagagcctgatgaaattttggatgtttagggcaagtgttgggattctaagcttcttgacagccacatacatgcaacaatacccccacctccccaacaaacacacacagacagcacagaggccaaggcttccaccatagccacagtcactcagatacttgactggaaatgtacatagatttctgcagataggatggtgctatttctttctcactctcatcgaaagacactattttgtgctacataaaggctgaacctgaataatctgtacataatgctgctttgggaaatggttactgattgcatggataaatttgcacagtgttttacttccaggacagcgcaatcttgaatgttgacatggaacatttccaaaagcatgcaatgagctatgtgtatgttgaaacctgcgaccaaaaacttgcctgcttgtagattgggttttctttctagaaaatgcccaaatggagtttggctaaaatctgaatactctttaagtccattcaaacaaaatcggagtgtcactacactggaaatcactcacaccctcctctgaacccttttgcaatgggtgttgtaattgtattatacgttgtttcacacttaatacaagttcttccattaaactgtgtattgacttccttgttctcagcccttatctgcctcatctttctgaagtgtttaacattattgtaaccctcatttttcttgaaatttcctcttcctttggtttctgggacactgaaacttccagttttcctcctgcttctaggttgttttctttatcctcaatggcttctcttccttctgtcttccttctctcagatgtagctgtctcccaggatttttgtctttaggggtcatcctccaccaacagttggaaccattcccatcaataaccacctttgattctctctacctggatgtcatcatcagtgtcacaaatttaccatgttcagaatcaaactctttcctgccaaaccctcaatttctcacctcctggctttgattaatggcatcaccattgtgtaatttacccactcctcattcttttcagtgttcggtttttcaggttttgacaaatgcatgcagttgtgtaaccaccaccccaacaatcaggacatagaacagttctatcatctcagaaaatttccttatgctcctttgtagtcaacctctaccctatccccaggacctggaaatcagaaaaccagatttattttctgtctctagagttttactttttctaaaatgtcatataaatggaatcatgcagtcagtagtcttatgagtctgtctccttttacttcgcatattacatttgagagccatccatgttgtcgtatcagtagtagtaacgtatcagtaattcattcctttcttattgtggcaaaaaaatacataaaatttaccatctgaacgatttttattttattttaagttccagggtacatgtgcaagatgtgcagatttgttacgtaggtaaacgtgtgccatggtggtttgctgcacctatcaacccatcacctgggtattaagctcggcatgcattagctgcttttcctgatgctcctcccctccctcgataggccccagtgtgtgttgttcccttccctgtgttcatgtgctctcattgttcagctcccacttagtgagaacttgcggtatttggttttctgttcctgcgttagtttgctaaggataacagcttccagcttcatccatgtccctgcaaaagacatgatcttgttcctttttatggctgcatacaaccatttttaaatacacagtacagtattgttaactatgtgaacattgttgtgcaatagattcctagaactttttcatcttagcaaaactgaaactctatatccattaaacaattctctctctcccccaggccctggcaaccacaattctactttgtctaagagtttgactacttcagatacctcatataagtggaatcatgcagtatttgtctttttaggaccgacttatttcatttagcaaaatattctcaagcttcatccatgttctagtatatgacaagatttccttctttttaaaggcagaataatattccattgtacatatatgccacattttctttatccattcatctgtcaatggacatttaggtttcttatacctcttggctattatgaatagtgccgcagtggccatggatgtaaaaattctctttgagatcctttttttcaattcttttgtatatacacacagagacaggattgctggatcatatggtaattttattttcaaatttttggggacctctctactgttttccacagcagagtagttcatctctttttatttttgagtagtattccatcgtacagatgtaccacattttatttatccattcaccagttaaagaacatttggggccaggagaggtggctcacgcctgtaatcccagcactttgggaggccgaggagggcagatcacttgatgttaggagttcgagaccagcctagccaacatggtaaaaccccatctccactaaaaatacaaaaaattagccgggagtggtggcacatgcctgtaatcccaactattcaggaggctgcggcgggacagttgcttgaaccctggatgcagaggttgcagtgagctgagatcatgccactgtactccagcctggatgacagagtgagacccgtctcaaaaataataataataaagaacatttgagttctttccattttcaggcaattacttatacataattgtaatggctatgacatttgcttgaaggtttttctgtgaacgtaatttttatttctcttgggtgaatatctaggtgtaagagtaactaactgggttgtaagataagtgtacattcaactttatgagaaactgccaactatttttcaaagtggctgtatcattttatgtccccaccagcgatccataagagttccagttgttcagcatcctctcccgcacttgacattgtcagctttctgattgttagtcattctaattggttgtagtgctgtctcattttctttttaatctttatttcccaatggctagtgatgtcgagcctcttttcatgagcttatttgccatccttatatcacctttagtaaagtgtctactcaaatcttttgcctatttttaagtatttattaataatattaatttagttagggtttattttattggcttgtttttgtttcttattgaattgttcgagttctctgtatattgtggatacaagcatatcttatgcgatacacttttgccaatgcatttttttttcttttgggacgaagtctcactctgtcacccagcctgaagtgcagtggtgcaatcttggctcactgctacctctgcttcttgggttcaagtgattcttttacctcagcctcgccagtagctgggattgcaggcatgagccaccatgcccagctaatttttgtatttttagtagagacagggtttcaccatgttggccaggctcctgacttcaagtgatccgcctgccttggcctcccaaagtgctgggatcacaggcatgagccaccggtgacacttggcccacaaatgcatttttctagtctgtggattaccttttcatttatttaatggtatccttcaaaaagcaaaagtttttgattttgttgaaaattttatcagtttaccaattgataaaactttatcaatttattttttttcttttatcaatcctggtgttgatgttgtatctccatgcatctactcttgaatgctcagatttgcctatcatccttccttgctcacttacctcagtagcaaccctgtctatcacttttcatagcttacaaccatctttcacatttaatcatttctttgatcatcaccttcagtaaagttaggccagatattctccagatgagcttattgctggtgctcaaatgctcaaaatggcttgaccaatgccatacagtaagcacggatgatagcgctctcatggcttgaaactaaaactgacttgtttcctaatgcacatgaattgtacacctccctcccctcacccccgaccccccctcaaccgacagacacacacacacacacacacacacacacacacacacacacacacaccagcttctctcttcttggtcatcatcctaatcagcatcacctcctctttcactgtccctcccctcaccctgctgtcagccccacaatgctttcaggggagtgtggagtgcagacaatacaatgctcttcctggaaaccttcttcctcttacctccctgtcccgtgagtcctccagctattttctgatacccagttattgcccacgtcctttaattccttggaaaattacccaactccatcccccttttatgtgactttgtctccagacaaatctacatgtagcgtagactgtcagatagggagacctgatcacagaactttggcttcctcatcctaaaataaaaccaattacatcacaggattgtaaccaagtacaatccattataaggattaaataagatgttttgtaaaggatataatgcctatgcatgaatcattatatgacaaatacactctttcactaccttaattccagagaaaagcctcataggcttccgtattgtaggtatgcaggagtgtccctcacctattcttattcagaaacctcctaactggcctccatattgtgaatcagcttctcctttctgttctaagcttggcgcttacagatgccatctccctgagcacaactcagaactcagccatgtcccattgatttcagtctaacgcactttctttttttttttttttgagacggagtctcactctatcgcccaagctggagtgcaggggcgcgatctcagctcactgcaacttccacctcccaggttcaagcgattgtcctgcttcagcctcccaagtagctgggattacaggtgcacaccaccatgcctggctaatttttgtatttttagtagagacagggtttcaccatgttggccaggctggtcccgaactcttgacctcaagtgatctgcccacccccgcctcccaaagtgctgggattacagatgtgaaccaccttgtcccgtcctgtctaacccactttcaacatttaaaaacctccacagcacagtcccatttcaatcttatgggtccctaatcccttcccctactccaacatgtcaagcaacgtgaactattatactttatggtttaataagaacacatatgcagccaggcgccgtggctcatgcctgtaatcccagcactttgggaggccaaggagggtggatcacctgaggtcaggagttagagaccagcctggccaacatggagaaaccccgtctctactaaaaatacaaaaattagcctggcatggtggcaggcgcctataatcccagctactcaggaggctgaggcaggagaatcgcttgaacccgggaggaagaggttgcagtacaccaagattgcaccacttcactccagcctgggcaaaagagcgaaactccatctcaaaaaataaaaaaggaaagaaagaacacatgtgtactgttactcctggccccaccccctccacccaaaactctccctctgccctcatattacctgcacctataaaacaaagtctccctgttcctcaagacccaccttactgtcactctcttcctgcagcctttctcagtaccctactattatctctttgacttttggcaacctttgtacctctttgatattactgctctatattacagctattatcttattgtcctgtgtggcagttatctgctcaattctcttaaccctgttcattcagccctgggacctatctagtaacttgaacagtaacctactcgtatgtgatcaagggtcaattgatacttgttaaattgattttaaatgttaatgcatattctgggacttgaaagttaacacgatgatgttgtcagaagtgattgttgattgttaagattttcagactttgaaaacttctactttgcaaagctgaattagacagcaaagttctgtagctccctcctggcaaggggtttgagttttctgttgggatcaaggcagtcagcagccatcaagggttcttgcacttgggcaaagaagtcattaatggtaatttgtatcagcaattacagcatctacctcatttctttctttcagtcgcagcgttcaaaggcaggctttattctccttcttgctgggtactgcaagctacacttgcctctcagttttatgtcttcctactccagctgtctggtgtggattttccttctgctccaagcttccttcatttcttcctccttatgcttcctactcttagagtggcctggaagtgttgctgggccagaactgcccccctgggtcctgtccacaggggcggcctctgcccatgctgactctcctcgtgtcattcttgcatgggcacatgtccagggggagataatatgtatgacctggtctatcctgagcacagtgttttaaatcaagaaattgcatgtttattgaagttcagtagaccaaacaagacctaagggtcaggaactcttaaatgtttatcccagtgtggactcagatgtattggggaattttagcaagtcacttaacctctccgtgtccctgtgatcttcctatatagtactgatacggctattttatatgaatctagtactttcacatcttcatgtgacagttttattgaaattaattttcaatagagaaacttgttgccttgcagttttttttatttctgatttttaatatgtatttttacttatgttgatttagaccttcccatttaatagtaacctttcaatgtggttacatttcttaaagagtatttatgttcagtttgaaaccacacaaatttaaattttgggaggctttcttcttcttttacaagtaatgtaaaattgtagtgaagctattggaaaagaaaaggatagaaacatgttagtgctttgacacagcgggagagaattttggaagagatattctaccaactacagatggaatcttcatcatcatgtagacttcagatattcttttagaaaactttacatttacttataatctaaaccttacttgtttaaacaagtcatgaaatgtatagcttaataattgcctttaagaaaattgttgcccaaaacagaaaccgtattgagtatgtaaagccaagtttagttaccaagacctactgatttcctttcatatatgtatggtcacatctctcacctcatctgtcctgtttcttgttttactagtggtcctttggcgtgctcctctgggagctgatgacaagaggagccccaccttatcctgacgtaaacacctttgatataactgtttacttgttgcaagggagaagactcctacaacccgaatactgcccagaccccttgtaagtagtctttctgtacctcttacgttctttacttttacagaaatgcctgccttcaaagggtctcttacagcatgtctttctttttggaacagatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtatactgatagtggttattgccagtcatgcttgattacctgcatttgcataatgatagaggaagcctaagatggatttcacctggctgcatagagctcatccatgtaggagagccttagtcaagtgaatgctgaggaagtagtaaaacagcatgcatccccgaatctcaggaagtctctgtctttccaagggtttggtctaagttgctgattacctggatttttctgacgatctttcaactgctagagcatctggttcctgttttagcatggtgctcttctccagcaaggtgtgtccttagactagaagacacaaaaatggagcagcagccacaccattggcgcacagatacctaggtgtgggttggagagagaggccttcttgccccatcaaaactactctttatctacacaggtgcccacccttttacccccagttaccagagaaattaccttcaggttatctccatgtatattcttgtaatggtaagggaattcaaaggtgataatttcagccatctaagaattgtgtgacacattgggggtaatctaattttaaaagaacccaatttaaaataatgcctacaaaatacaatggacactgatcctttactgggagataattcaacccccgctcacggccaaactctctcccactcaaaagatgcatttccccagaaagttcaatccaactctctcccataaggagaacaacctgtcatctttacatctctagaatccggcacttagtagattctcaaataattgctgaactgaaacagcattttcttattccccatcactttatttatttatttatttatttatttatttatttatttttgagacagggtcccactctggcccccccagctggagtgcagtggcatgatcttggctcactgcaacctccacctcctgggttcaagccattctcctgcctcagcctcctgagtagctggaattacaggcacacgccatcacgcccagctgatttttgtattttagtagagacggggtctcgccatgttggccaggctggtctcaaactcctggcctcaagtgatccacctgcctcagcctcccaaagtgctgggattacaggcgtgagccaccacacccagcctactttaaaccaccatggacagagttattgcctatgtagctcccatgatgtttggagaacactaatatggagaatgcagacttttctggggaaagagaaatagaaagatagacctttaagaagtttggcttggtgctacgcatttttaattatcacagggttttcgcttcacgatataagcatcaattatatttttgctcgctgacctacacagtggattccatctttaaagaaatagggagaagggatatataacgcgtagaaatacatcaaatgcttgaatgctgacatctggcattgttaatctacctgatttagttcagaaaatgagttagcattatataaaagaaattgattagtattttatttaactcaacgaatatttatcaagcacctatatatgtcagacactgctaggtaatggggatataaaaataaacagtccctctcaccccaaggaatttgatgaaacagacaaaattacataattaatgaatattaaaaattattcatttcttagatttgtgagttgtcttgaagagacaccacagtttaaacatacacaaagtgcaggctcctgggcaacagaccaagccctaactcagattgggcaacatattggacttctctaaacctgtgttctcatctgtcaaatacattaatcatggttacccccacaaagttgtttgaggactttaaaaaaaagtgtataaaggcacctggcacaccatagttgttcaataatcataatatcattattatctttagtcttagacaataaaagcccatgtataggtagccttagttggctaaagggaaatgaggcttggaggggcattacagatgtttaaatccaaattcttaccccattctttttgtttttgttttttgtttgttttttggtttttgttgttgtttgttttgttttgtttttgagacagagtctcactctgttgcccaggctggagtgcagtggcatgatctttgctcactgcaacctccacctcctgggttcaagcgattctcctgcctcagcctcctgagtagctgggattagaggtgtccaccaccacaacagctaatttttgtatttttagtagaaacggggtttcaccatgttggccaggctggtcttgaactcctgacctcaggggatctgcccgcctcaggctcccaaagttctgagattacaggcatgagccaccatgcccagccaacttcttaccccattcttcacctcacacctgctttatatacagtagaaacagctgtgattctgcctcatcctgcatatgacagtgagggtgagagaggagaaaggtgacaagacagtggcactggcaagagaactccctcacttctttctctacactccccactatcactttaattacttctcctgtgacagattccttttttctgttttagcctttagacctggaatacacaacagacatggaagagaacattctgtctaaatgacaggcatgttgcatgaaggtgcaagaataagagccatagtcttcagtattggtgtctagaaattattattgttcctcatttttgctcaaatgttaatagatggttaatgatcattcaggttgaagaaaaagtaaactaagtacagtattgttttagttatgtgctatgtgtttgaagatgaggaatacatgactagacacacatagcaagttacacaggcacacatgactcactgttgtagcacttcagacagtttcaagacacagagaggtatgcagacgttatgccccaaaggaagaaatgcttattgctgtttttctttttcatatttgaggggttctttcaggactatctcaattccttatctatcaaagaattggaaagaacttcagtcataaaccaatgaaatatttcagttggtgaattgaaggtaataaaatggatgcttgcccaaactgtcctttgttgtaaattattccagagaactagattacgtcagccaaagatattgatcacaatgctgagaggtttataactactattaacttaccatgtgaccccagggcagaaatctaggaaaattgcaaaagcatatctactgtaatgaaaagcccatcattaataggacttactatcttgtcatccaactagtactatgttggcttcaaggcaaatatttaacaaacatttgaaacagaaagcacttctgtcttctcccttttatcttccattgatgttcccgagctattctgatgaatgtgtttttgttcttatcaataaaacatgtaggttaaaataagtgaatatatttataattattagcctatataaattagcatccaaatattgaaatagctcctactcctttattattactatcattattttaataaggagttagctcctcatgtagaccagtttagaatacggctcaagtccaattctcctgcgtagttaaaccctacctggttaagcattctgaaaactagttactcttttttttttctttttttgagatggagtctctctctgtcacccaggctggagtgcagtggttcaatctcggctcactgcaaccaccacctcctgggttcaagtgattctcctgcctcaacctcccaagtagctggaattacaggcatgcatcaccacacccagctaatttttgtattttcagtagagatgggatttcgccatgttggccaggctgatctccagttcctggcctcaaatgattgccacctcagccttccaaagtgctgggattacaggtgtgagccaccacacccggtggaaaacgaggtactcttagagaagcaattctgagatgaaaatggccatatttagaatgcataaacagacatctctgatttaaattaactactaatttaacgttatttttgaagcactgggcccaaattacaatgagaattaattcttattcctttcttgaaaagaagccctttgtctttgtgcattcaatttttcactgtcacatgagtacattcttttcaccgcatgagtcccaggctggcagaaacatccactaatccttagacctcttggctggaacgacaaaaatgcataaaatcttaccaggccaaaagagatcaactttaaaaatctttggcatccaaacatgtcagaactgtttttcgctggttctgcaaaccatttgtgttcttcatttatggtccaggggatctgtaatgtcagttcctacttttattgggcagcctggaatttttaagcaccatatttcctttacctttcttggtggtttataattttcaccgctgtttttacgagttttcttctctatgtctctaagcctaagtgtggagatgtggtaatagacagcctgctctttgccaatcaaagcccttactttgacgttggccactttgttcctgtgacatctgctctttccattatagacaaactggggctttccttctgcagaactgtgactaaacaaccaccatattcatcagtggcaacaattcttgtaaacaagaaacgctgaatacaaaggctttgtgaaatcctgcccccaagaggccacatgtctaaagtcagtcacgtggtcctcagaaatgattttagaagtctcagtaaagaaaaattacagagacactcaaatatcctagtgtgatactgctgtaaaacttcttctaattttttgttaagctgtgagaaagggcctatggaaacacctggatgaagcagcaaatcactgtcccaaagtcactaaaaatcatatttcagaaaggaaatatctagcgttaaaacaacatagatgcatttttgaaaacaaattgaattgagaaaaataataatgataacaataatgatctaatcccaggacatgtcacaggaattaatgactgactaaaagctaatggtctaaggtaatgctctcaggaattagtcttgcttattgaactgctattgttttagtaaacgaatgcttaaactgacagaaagtaaaaaatcagggctgccattatggagcctggttgattcaaagtggggcagggggagaagctaaagcaaaaaaaaaaaaaatgcatcatttgatcatttgctgttcttactcaattttttaagttcgtttgtcgttcacaaattatagattctttatcatttttttctttcatgtatctgtatgtacttttacttttgtactttaaggatgtgtttacttatgcattgttttattgacagagaagtaatctgataataaaaatgcaactccctctagtgtaggcatatcaaagatctaacattctgtttgcctagaatcgttttattttaaatactctgatctgaagaaaatgtggatcctcggccgggcgcagtggttcacgcctgtaatcccagcactttgggaggccgaggtgggtggatcacctgaggtcaggagtttgagaccagcctggccaacatggtgaaaccctgtctcctactaaaaatacaaacattggctgggcgtggtggcgggtgcctgtctgtaatcctagctactcaggaggctgaggcacgagaatcgcttgaaccccggaggcagaggttgcagtgagccgagattgcaccgctgcactccagctcgggcaacagagtgagactttgtctcaaaacaaaaaaaacaaaacaaaaaaaaagaagtggatcttccatgtgggctttagaatagtgcctcaaaattatacttcacttagaacttattactcaacatcttatttcaagagtattctaacagctgacttcttgattctacctttccgtattgcctcttccttataaccccaaaacagctaccaaaattatatatctgatcacttcactttcctgcttaaaaacctatgcccattcctagatgttctctgtgcagatcctttgttgtttcattttgtttatttttattataaaatatatttttgaggaaaaaattttaaattggacaaaaagatataaagtgaacaggaaatatcctccgaccactttctctccccctccatcctcactccccatgggtagctaatattaatgcactttttcagaaatgttccactctgcatcagtggaactgaactaaaccagacactttagtacatccttcaataacctttgtcttattgaccgaactatgactcggcacacccttccccagtcaagaatattgttcttctacctctgtgactttgaactctcaacagaaatatccccctttggggtatgagccatataaacagggctagaccaagctctgtgaactaccccctcccccactgacttataatttgatattgcttcaaaccagtatcctttacctttgttttgctcaacttttatttaaatggagaggagattaaaatgattttctcttaataaaaaattaaagaaagagattcacttgtttctatttgccaaagcagaataaatatatttttaatcaacaaaatagtatgcttttctaaaattctagttctgtttttcaatggaaatttgcagtgaaagtttccagatgcttggaagttataaagagttttaaacttaggtaataaaaataaatcacccatttatgataagcagcactctgtgaaagattatttcagaatctcagctgactgacaacttttaggagactgaactgtacttaagtgtggcaaacatgcatcatagagatgggttgtttactgtagcaagttacttgccttcggtccaactgtccttttggcagaagcacaccaatctaattttgcctgttacataaagagccacatgtggaaacctgagtcgcctgacatcatgttactgacttaatccagtcataattcagcgcccagagagcggctggcaggcccacccaccccccactctcactctcgatgtattcatgatagcacagaggttagctggacacacttgggaatcagatatgctaggtcagactcatttccaccacttatcagtagtgcgattttggaccaattgcgtaaccctcctaagcctcagtttctgaatccataaagtagaaatactaacagtggcttcctcataagattgtgcaaagattgaatgagacaatgtgtgcaaagctctcaaagggtggcagtcattattgccggagaccttgattttactttttaaatttttattcaagactctagaataaaattacctccacagatgtccaaagtttggcacagttcagaaaagtctgaaggtaaaaatcatgaaaacagacattgattttcttcatcctttttggtagtatcaacctaatagaaactggaccagggtcctgatccagtctgactttactgcctatgtgaccttccacattacttaaaagttgtgcttttcttgtctataaaaaattaagattatacctcacagcattgattgtaaatattaaattgtgtaagattttacacaagtacaaggtgttattatggttcatcagaatgtaatttttttactttgaaaatctccgtagaactcatctgattcacaaaattccctctaaccaaccccagcacttcatttgctcccacataattgctggagttgtttacacaaatctgtactcagaatcaaagagctcaaggctggagaagtcagggaatctggccctgggcctctgcttgaacattctgggtgctggtcgctagctgacccttaaacaactccatgtcctctttggagttcaaagtttgggggtaaaatcactaccccctctcaaagataaacacaaatggagctccaaggtggtgtccggtgctaacatgagacatgttgagtgtgaatctcatcagagcagtgtttttccaacataataaactgccctttgttcaaatcagaaactgatttcactcgattttcccaaatcggccctgccaggtttccttgatttaattgtatattttttgtctgctgacaatggaaagcagaagaaaatagtctcgctaaggaaatgaaatattaccaagaaaaacaggcattctcacactgtgtgaggtggttttttttttcttcacattcaatttgtataagaaaaaaggtctctaccctttgaaacaacagcattattgcagtgactattaggtcatatctacatggcccaaaagaaaatgttggaaagaaaattaactagttcataagggtatgggcaacattatttttaaaaggaaatggttcttcatacatagagagaataataaatgggagcaaaaaaatgcaagttaggcaattatttaaataattccaattttaaaatatgtacttaactaaagcatccgtggagttcaggtaaaatcatttagagggaacgcaaattaaccaaatcactactgaaattcttcactttttaagctaaaattgcttgttcttgctttaataccagagaagacctgagtcctggttgactgttagtgaggagttgtatcaaaagaacaaaggtttgaagccagttagggccaggtgcctatctcagctctgccatctactcatcatttgcccatcagcaaattcaatttttcatttatttggtttaaaaatattactgagacccttctacgtgataggtgctattgcaaagaaggaagatacagcaggcaatatactagccaagcctgttgctcccaaggggcatttattccaaagcagggagaaagaaagagagacaaaaggcagggggagggaggaaggaggggagaaaaggggaaaggaaggaaagagaaaaaagagaaagataagagataaacaacaaaactatcaacatttggtggtatgaagccatggaaccagaatgagactatctagggatcggtaccagagagggccaaggatgcagccttagggcacaacagtgcctagaggtcagggaggtgagattgaagaggccttacttatctcgtcataaaatgctaggttatcacctacaaagattttttttttttttgagataaggtcttgctatgtggcccaggctggagtgcaatggcttgatctcagctcactgcagcctccacctcccaggttcaagtgattctcctgcctcagcctcctgagctgggattacaggtgtgcaccaccattcccagctaattgttttttttttttttttttttagactgagtcttgctctatcgccgaggctggagtgcagtgatgtaatctcggctcactgcaacctctgcctctcaggttcaagcaattctcgcgcctcagcctcccgaggagctgggattacaggtgcacgccaccatgcctggctaatttttgtatttttagtagagacggtgtttggccacgttggccaggctagtctcgaactcctggtttcaagtgatctgcccacctcagcctcccaaagtgctgggattacaagcatgagccactgtgcctggctgatttttttaaaattatgtacattttgctactagcctattaaagatacccaacaaatgttaatttcttcctttttttttttaaatcctctccctcctcaccaactcccaccatgcaaatataattaatctctggttctaaaaaaaagacaactgagctcctgcataccaaaggaataaaaaactaacacttcctttagctcaatttaatctaggccccactgaatgtaatagtgagcaaagaccatacaatagcaaatcattatagatcacaactagtaatcccaaatgacaggtctcctctgttctgaatttcatttcattgaaattgttccaaagtttgcatcttaaattacacaaattatattcactcctgtcttctattttaaaaggggaaaattgtgcattcatttacctgttccctttaaacatcttaactcctgcttacacttgtatgaaagcattgatcttatcataatta

SEQ ID NO: 528 - DNA, 179206 bp, Homo sapiens
tggcctggtctggcctcctgtgctccttggggggcagctgaccatgaggtcagatgagcatgatgtgccatcccattgctcttcccatcaccctggccaggctttgtgaataatctgtgttccttgcttctatttcctcatcatttgttccttactttttctcttggcttctcgctccattcaccattccctcagttctaaaattccctgggagcccagtgtcctccctgatgccttgcagtgctgagcgctgtcaccattctaccactcagaaccctttcctctctctgccatgatccatgctctcttgtggtgtcttcagctcaacagtttgtaacagctgcatcaggtgctgtattagtctgttacaaacaaatgttacaaaaaaatgcccaggactgggtaatttatatttatttatttatttatttttgagacggagtctcactctgtcgcccttgctggagtgcagtggtgtgatctcagctcactgcaagctccgcctcccaggttcacaccattctcctgcctcagcctcccaagtagctgggactacagaagccccccaccacatccggctaatctttttttgtatttttagtagagacggggtttcactgtggtctccatctcctgacctcgtgatccgcctgcctcccaaagtgctgggattacaggcatgagccaccgcacacagctgggactgggtaatttataaagaaaagaggtttaatgactcacagttccacatggctggagaggcctcaggaaacttacaatcatggtggaaggcgaaggggaagcaaggcacgtcttacatggtggcaggagagaacgagtgaggggggagactgccacaaactttttttttttgagacaagagtctggccctgttgcccaggctggagtgcagtggcatgatctcagctcactgcaacctctgcctcacaggttcaagcaattctcatgcctcagcctcccgcatagctgggaccacaggtatgcaccaccacacctagctaatttttgtagttttagtagagatggggtctcactatgttgctcaggctggtctaaaactcctgggctccagcaatccgcctgccttggcctcccaaagtgctggggttacaggcataagccaccacatccagcctgccacatacttttaaactatcaggtctcatgagaactcatgcactatcacaagaatagcatggggaaaatcccccccataatccaatcacctcccaccaggtctcctccgacacgtgggattgggtggggacacagagccaaaccgtatcagatgctgcaggggctggggacactgagaccactcagacctggtgtctctgtcactcttctgggctctgtctgtctccaggacctccctccccttccatggtatagaaggaaagtgctgtaatgtgcaaattgcacaggaactccttaagacatacattatccactcagcagttttaggttcgcagcaaaatggagtggaaggaacagaaatttcctgtgcacccctccccgctgtctccgccatatcggcatcctgcatccagagtggtagactggttacaggctatgaacctacactgatgcggcaccaccacccagagtccacaggttatgttggttcacatttactcttgctgtggtatggtctataggtttggacagatgtccgataatcctttttacattttggcatccttgggtagctcgtcttgcaggaatggacttgcttcaaagtggaggcaggcagatccttcagatgggtatatggagccctgttttcagttgcttttctaattctctcttatcgtttacctcaaaatcttcctgaggtctcgcttccttttaaaatccttgtctactttgcagcatcactctgacactccattgattcctcagcacctactgactacacggttaggagtgcaagggtagaattcatgttttattcatctttgggtctgtagcacccagcaaagtgctcagtaaatgcgcagtaattgatttgacctctgaacaaatacacactgtactaagaatctacacaccgaaagacaaaaacaagacaaatttgagtgctacaggtgtcacgcttggcctcacacatgtgcctgtgtattcctctaggtggttaccaggagctctgccactgcatgtccactagtgacgggttcgctccaccaccccagctgggtagccgctgctctcacataaggggtccaattaaaattgccaggaataaattcccccggactttgacttctcaagagctaagaaggtttgctgagtattctggcatgatgtttggtgatcaaacaactgctggccaaaaatgatgagtatttccccctcttgctgaagatgtgctccatacaatagtccatcacattcatcattcatcagtctggaagtgtgcagccaatcatattatctatcacatgttgttctggctttttttttttttccaatgtccagcctaaactataaagaactttgagaacgcacagtgaaccataagcttgccaataaagagtcctctgtggtatggaactggcttatttcatacacaatctgcaaacaatgagggcactattggaaacatactgtgctgcacagagcatttacaccacttatctttaatcttccccagcaatccttgctttgtgcgcatttatgatccttgctctcagaagtccacatacttttccccaaccgtaacaaattatttaactcatctaatgtatgtatgtccgcgcagtctgaaaacagtaattgtccttgggaagaagtgagtttaagagagctctagggcactcatcacaactccagccctgccctccatgtggtagcagctctttggactggggctaagtgcttattcttgtgcttcattcctggtaagctcaatttctttaccttaggataactttgctggaaaagggctcagattcagccgaccattgtggcctctgtggctgtcacagcttgtccctgacatgctatgatgttgggtccccttctcatccccttgggatttcttctgctggcccacagccagaacaactaggccttttactccaccatccctttgttttcttttgtttcgttggtaaaaatcaatccttctaccatccatgcatagcaatttctaaaaactgaatttcaagagcagtatctgaagaaacaaacatgatttggtccttttagtaaacagaataaattttaataaatcaactttgaaatagttgtaagagttaagaaaaagcacaaaactgagatcatcagagcagcttggcctcaaaggacaggcagcaggattctacagggtttgagccttcctaagtgaagctgtttcctgcaggctccctgctccaagctcctagctaacagccccttctcccacgattggcaacaaagagcaaaaataactttgtacttgatgctgagtcagtgtaaaaagccataaaaaattccctctaaatgtcaaaatgtttgcctcctttgaggcttctctcctcctactgggtctggataaattagcactgggcttatattgagtcacagatctgggccctgccacagagagcttcctcctagtgtgtgatgctttttctccaaactattgatacaaaatgcactggaatagaaatcaacagaaactggtcaaaggtgtggcatacacattctcatgtagatgtaaagctgtgcttagaattcctttgtggagtctggtttggtcttggttttcttggtgtttgattcatttttttacgtaaattacaaaaaccctccacatttcttcatggattgtattagtccatgttctccagagaagcagaacgagttggatgtatgttttggaagagattatgaggaaccggctcatgtgatgaaggaggttgagaggtcctgtgctctgccatctgcaagctgaagacctggaaagctgagggtgtggctccagtctgagtctgaaggcccaagaaccaggggaaccaacggtgtagattccaggttgaaggcaggagaagatggatgtcccagctcagcaggcaggcaggaagcaaatggggtaaattcctccttcctccaccttttgttccattcaggccttcaacagattggatgagcgcacccccacccccacactagggagggccatctgctttactgagtcggctgagtcaagtgccagcctcatcccaaaacactctccagacacacgcagaaatgtttcatctgggcaccctgtggccagtcatgctgacacacagaactaaccatgacatggattcttcttaaagcagtgataggagcgaacagaaacattttcataattttcaattatttttaatgaaaactatatctgatggaattgtttaaacctagtctggccacacattatttcctgggaccgcccctccttcaatcccttggacactgatgactttatgcccagattacactggaggcctgtgctgattttctaacacatacctgcaactgagctggcaaaaagaaaactaggcaagtatgacagatacatgatgcacaggctaagtgcaaaggaaagaaaaacaccaactgcagggatgagggactcacccctttagaagtttctacttgagcagctagaagactacaatgccactcatcaaaacagtgactcagggggagtatttgggataaaggaggaatctgatgttggaggtcaaatttgaagtgtctttaagacctacaggtaacgagacagctggacaaacacatggaactcaggacaaaggctctaaggacagcacagcagctgacatcctgtgtgacagccttgaaagcagcaggcccgccgctcacattttggaagggaaaatgggtacaatgttgtctgccactttggggccttcttgggtcacatgcattttacatttatgcagttgatatatttatgtttcctgggtcttttatacattagacaccatgattctcaatcctttgttattttgtattacaaaaagctgaattattatttcaaatatgggcaaattagagccttccatattgccaaggtgtatcaaccacactgatatcacgatctctcttttgaattagttttccagttcacacctaccatttatttcatgattggtttcagacttgttcctcctggaaacactccctaacaagcacccttgcaggaatgaagacacaccacacacatctaccccattactgcatgtactcaagagtcagcttttatatgatctctcccaagtgctcctataatggggatctttcactcaccctaaagtgaggacaaaatacttgaaagcatgagcccagtgcctgtaggtgtgcaattaacctcagaccaaggaagtgccgaacgcatctggcttttagcaaggcacctgacaaagtccttcaggatgtttttgtacatgagctagagaaatgtacctggagaacagcttctactgccagatgatcttactcaaaagatgcagattaagcaaaatatcaacccaaagggtggtccctgatggcccaccagccctgtgcctggctcgtttcctatgtttcctagatttggtttcagacttgctcctcctgcagacactccctaaccagcatccttgcagaaaactggtgaactagaaaaggcctgtgtgggtcacgtggccacccaacaccacagcagtgtctaaggtatgcgtgggagcctgcacagcaggagcggggtcttctggagacccgcatgagatgcaaagggcagtggacaaggagccaagggaggtggctctagtcacgctggtatggtgccagcttgaggatgctgggcaagtcccgagccgtctgccttcctagtaccacagttaccactgtctgttacctcgcgagttcaagtgcttcacgtgagacagctacgagacaggcccctggaaactggaaaatgctaagtaaatgtcatgcacaattgttgttcacattttatctcaatcacttttaccaaatcaggctaaaccctgggtattcataacgtcttgggctgtacaaattgttccttgaaatgactcagagacattttctgaattggcttccatcagccaagcatttcttcagaactggaaaaatgctttaaatttggctttgtcatgattattaaaacactctgtacattttttattattgaaattaacacattgcctactttttaaaaattggaaaaagaaaaaagaagaaaaaaggcctaagtctcaatacctacacactaacattttattcataatccaccagtttttattaggttattttcagcgtttacacattcataagaactttaaattagatttttagaagctggtggtaaattgtaactacaggagagaatcttcccaagaggactgtggcttatggatttattcccatcataggggaaaacattcataataaaataatttgctactgtgatttattcagctgttattgggaagaagtaatgacccctccacattctgtgaagcctcttggaggtttcatgtgctctgactcttcatcaaaattacatatacttttagcaatttttaaagaagtgtacaaagttgagatgtttcctgagctctcatatatctgagaatgtcattttacatctccgtcttcacctctcaaaacttctttcaattctttggctcttaatagtaatcaacacttgcactctggagtcactgtaattcttgctcctttacagctacgcctgttatttccagctgaatatttttagttatttcccagggttccaaaaaacagcaataagtactacacaaagggggtgggccataaccagaaatgtttgggaaatactggctcatgtatgcaatgccaaatctggtttgcgattgtagtgttgctcacatgcagagtgaatcttcagagaatccatgcattttccaaatatatttaataacaggacccttctgagttcctggtacaccaactaacagttcctgagaagtgttctttctgcaaagcccatcttgggatatgccatatattttaattaaactcaaactttaaattaaactcaaatattttatttaaactctcaaaaaagcagaatatatctagatgaggtctctttccactatgttttaatctggaattcagaattctctcttttgtttgctttttaaaaaactgtggtaaaatatacataatataccatttaccatggagcagaaccatttgaatgtgtatagttcagcggcactaaggacattcgcattgtgtgccaccatcagggattctttcgaattgcacagccattctttcagcttaaaaatggtttcttgaaatcagtgattagcattcactcaccagtacccctactaaggggtaggcactggtttgtactcctgggaatacaggagtacaccagaatttatttctgcttattgcttttgttgcaaatgccgtggcttcatctgaggaattctagaattcagagggtgtagccctccactctgctgtcttgctatctgctctcattgcatctgtttaacctgcattctgaaagatgtttctcaggtttttccttgacaattttcttcttttctgattctgacaatgttttaaatcattgtactgtggttatcatttctctgcatttattttacccatcttcctttgtaacttgtcctattgtcttttaatttctgcctgttctttatggctttcaacttcataaataacatgttttctcaaatctctttgtgaattccagagagggccaggcacggtggctcacatctgtaatcccagcactttgggaggctgagacgggtggatcacttgaggtcaggagtttgagaccagcctggccaacatggtgaaatcccgtttcactaaaaatacaaaaattacccaggcatggtggcgggcgcctgtaatcccaggtactcgggaggctgagggaggagaatcgcttgaacctgggaggctgagggaggagaatcgcttgaacccgggaggcagaggttgcagtgaaccgagatcatgttgctgcactccagcctggtcaacagagcaagactctgcctcaaaaacaaacaaataaacaaacaaacaaaacagagagattttgctgcaatgtacaaggagcaatttgctcctttaaaaaaataatttttggccaggcacagtggctcacacctgtaatcccagcactttgggaagccaaggtgggtggatcatttgaggtcaggagtttgagatcagcctggccaacatggtgaaacactatctctattaaaaatacaaaaatgtgctcagtgtggtggtgcacatctgtaatcccagctactagtgaggctgaggtatgagaatcctttgaacctgggaggcggaggttacagtgagctgagatcatgccactgcactccagcctgagtgacagagcgagactctgtctcaaaagaaataataattttctaagttatgattttccagcatcttccaggtcaagtcttcctttcccttttctgaagaatgcttttaaaaaggctccacatagacttctttttttggttactcacctctacaaaaaagacctgataaagatgcaggggttttgtcactgtcggtgcacctgggtgctgatgaaagcacttttcagatttacctgtaactgatttacctgtaaatgtctccaagtctgtttcccagaatgagctggcatctgtgtattgccagtttgtcaggataagatctctttttaagttagcttggatattgtaaatagggtgagacatagaaacagcaagattcctccctgggcactgcaccagagcccttcctcaaacctttgtctccgttcctcagctctgctttgggtacagaggagacaccactgccaggcttgcccgactccctgcccaaggctgtgtgagctgcagtttccaagtgctgctgtatagagagagaagctccaatggggagcagcagggacagggacccactgcagcactcagtcaaacgcaaagccctacttggggtgctggctgctctgctttctggtcagtaccgatttggatttctaagggtgaggaggaggtgggaaagcatgaagggtcgatcccccttgcatccaggagcacctggcacaggccggccactgatgatgtttctccatccagtcccatctctgagcatgaagaaattcctccagattctgcaaataggttgaatgtgtgtcctagttttgggtattttgaatctttcctttcatcattggtctttggtgagaagcaagaagaggctgttagcagatgcctttttaaactggaaattcataatttggttttgactttaatggtgggaaaaacccattaaataatttatttcctgatattaaccaaaatacagtatggtatgcaatactgtaaagcaaatgagttccagataaaaacagacatggtctgtttcctgattcaccagttgcttgacactggtatgtcacttattaattgtacctgcacttactcattctaccttcattgccaagccagtcctctgtgttctgagtctatttgcctaaacattcaggaaaaaacagtacagataattacatgtattttggaaaccacacttggtttgttggttgcctgtaattgactatttaaagtgcattttctaagcctactttagatagtggtcttaagaaatggtcatcattcttaaaagaactataagtgtaacctgtctgaagactgcttcaaactctgtcttaaacaattttgcttttagttaattatttaattaaaccaattaaagatccatggaaagagggaaaagctcaacaggagagtggttatactaaggaaatgcccataccctccatttaacaatgccatgtagaagtgttgttgttactaggtcagagatttccatgtgctcaaatatttgccaaacaggtgaaaagccagaataattaaaacaaattatttattccaagttctaccagtttaaagtttttcagaattacagaagcgaacaatgaaatcagaaacaagctctcacagctgtagcatttataacaaagtcattatctacatgaccttgatttaagaggtgtagagtgtttcttttattcagaatccatgaggaaagtttcgaagtccagatccaagtcggaaacgagggcacttacgaagtcatcaacagaaggacacttctgaagcatacctgcaaacaaaggaaaggtcagaactgcgttcaccaggaggcaacaggaagcacaaagacacaaaatcaaatccacacactagaggaacactctggctttctgaattaagactctggctgtataacctgaatgcaagaacattttataaagtcatgggcagtgtgtgggccttggagctatttataattttaatgtatttttactatcaaatccatccttagcttagagatttaggcctaaatatatttcctaagggctattatttttgcatatatgactatacccttagagactgatattagaagactgatttttttttagttatctttgactgggatgattcacaatttaacaagtttaattacatatcaagttttgttatcaagttctatacactttacaatcaattagatgttaattcttttatagaaatcttatatcagaatcaagttattggctctcctccagatttccctgtcccagagaactcctagctttgcaacttagtaactgtgtaacgcagaagtcacttaaaatctctggcatccaaatttcctacaaggttgctataaggatcaaacaagaagatgtagtagaagcaatgaagcaccatgcctagcatatattaagaattcaataaaaagctgaattcatgtcctttcttcactctaaagaagccaaaaacaaagattgatgcaattaaccttattgctttaacctacattcttggcaggaaatgctaactgaagggttgaacaggctctatatactgatatttactttgggagatgaattctgtaaaaccattttcaaaatcaaggcattaaaagattgcaggaatcctctattgttctctgaacctgtattgcaattcagtgaacatgaaggaagcatctgttgtgtgtaaaggatcaggccaggtcatgggcatacaggtgggcaggctcagtcacaacatgaagagtgagagtagtcggctgggcagaactgcatatccatacggcagaaaactagccttgactcctactgcataccatacataaaaactaatttgagatggtcacagacctaagtgtaaacactaaaattattatcttaaaaaaaccgcatgaagtatctttgtgaccctgaagtaggtatagtttcttaggacacagaaagcaatgcataaaaggaaaaaatgttagatttcatcaaaatttaaaatgtctcttgaaaagaaaccattaagccaatgagtagacaaatgatagttggaaaaaatactcacaaaacatatctcacgtaagactggtatccagaaaatataaagaactcctttgacccattgtaaaaatatgtttttttaaattacaaattgacaaaagattttaccttcacaaggtcaggtttttcacagaagatatctgaataagtaacacaactaataggcactgagaagacattcaacatcattagtcactagggaaatgaaaaccaaacccacaatgagatactattacacatccaccagaatagctaattttttttttttttttttttttttttaaagacaaggtcttgctctgttgtccaggcctggacaacacagcatgtgcagtggtgtgaacatggctcactgcagcctcgacttcccaggctgaagtgatcctcccgtctcagcttgagagtagctggaaccacaggtgtgtgccaccatgcccagctagtttttaaacttcttgtagagatggggtcttgtcatgttgcccaggctggtcttgaacttctgggctcaagcgatcctcctgccttggcctctcaaagtgctgggattacaggcgtgagccactgtgctacaccaaatgttgacaaggctgtgtgcaacctgaattgtcatacatttgtggtgaaaggataaaatgatacaatcactttgaaaaaaggtcttaaccagtgtcttacgaaactaaacatagacctacactaggacccagcaatttcactcccaggtatttatccaagagaaatgaaagcatatgtcaacaaagaaacaacttgtacaaccccaagcttgaaacaacccaagtttctatcaataggacatgaatacacacactacaatatattcatatgatggaatattactcagcaacaaaaaggaacaaactattcatacatgcaacaacacaaacggatctcaaaaacattatgctgagtgagagaagccttatgtgaagcagtacatactgtttgattccatttatatgaagttcaaaaagttagtcaaaccaatctatggtgaaaaaaatcagaactgtggttgctttcgggagtggatattagaatcaactgagaaggggcaggagggcctctggtgtgatggtcatgttctacatctggatagtgatttgagttataaaggtgtgtacatgcatcaaaattcattgaaaggtacatttgagattttgcgtttcactgtatgaaaagtttacctaaatacagtaagcaactattgaactctaatgctatgcatgtaaacgaatctaggtgtaaaatgtactgatgtctgctaccttgaaatgcataaaaacataaggccagatacggagatgaagagatgtaaatataggaaaatgtttactaaatggcaagtatatgagtgttgtactgttcattcaatttttctgaatatttgaaaaattttaacataaaatcttgagaaaaagtaaactgtagatgctaatagcatacaaagtgcagtcagtgtggagaacagaagagaaagatgaattccaatgaagagattcagcaggtttgtggaggagatgggattgagcagaaacttaacagattgggccttttaggtggaggagacaatataggaaaggcacaaacctggggaaatgcacaatgtatgctgaccaagaagtggtctggcgggtagagtaaggctggaagagactctgggagaggaacatgagaggtcccagggctctgaaccagggcaaccaacagaaaaggaaggacagactgggctggaatccaggaggagcagggtggtgtggagacacaacccttgtcaagtttgaggtggaaggggacactccatgtggagacagtgaggacacagagctcagggacagcttggggactagaggtgcagatgtgatcatcccaccagaaagcacatggggtgggaaatagaccaaggactatctagatggtggacatgaaaatacttggtccaaacacatacttgaaagcccttaactagaccaggggtagttgagaacaataccaatattgttacagtttcaactgtagactaaaatattttcactggctatctaatgtctatctaaattctaacagctctatcttaggtactatgtgaggaataatgggctgttactagttactagaagagaatgtcattgctgtgtctatttgtgcaattaaagttcaaaacacagtgttcttttttacagtaaaataatctgcatgcatgaatgcaggccttgcctctggcccagctgtgtcactaaggatagaaacgctgggtatgtgatgatggctaaagtagcacagttgacaatctatcatctagatataggttattacttaagtagactgaatctgattataaatcaggtttcatgcattccctatgtgccaggtttcttgatacagagaacatttgtagggaaaacatttaattaagacatggctttccataaaatgtgctagcctatcacgccatttcttcctttttaatatttgaggggttgcctctctcagctttggcgccctcctcctctgtacagggtagcttcttccttctcttttccttcttgcttattgaactctctgctccttaaaaccactccacgtgtgtccgtgtccttgtatctaagctggcatgaggaccaaaaaccctggtgctccaccactcatcggagccacatcattttggtgcgttggccgagaaaggaaattcattcatcagactgagtcaaggaaacttattttaaactatttatggcctttaataattgagtaaggtgtactcctatgaacaaaatttgaagcatgtttatttctctgcctggttcctctagaatttggaaattatctgtctggaagctctgagtttatcttgggacctcaagaggagaggatcacccaactcacagcaatcaaactccaaatggtgctataaactgaaccacacatggacacgtcagtcttccgaggacccttagatcaaccccaggaggagccctagctgctgttccccattcgacgcccctttccagcaggaagtagccagaagacatcgtcgcccaaacctctaacagcagttagtgcggcatctccacaggggggaatgttgtaggagttattgataaattattttaggcagatagagaggaaaaggggtccttaggaagtttttgttttttaaagcacgtctggaaaagtttcttgtaaagctccagctcttaaagccaggccagttacccgatatccaaatgccagccattagaaagtgggtccacccaaacatggcgattcctgtggacttcttgccctttccccacattcctggatacatggacaccccgaagtatccccacctgtgtagaagatcatggtgccctgcatttgcatattaaaaggctagggtgggagagccagcttttcctgcgggctacgtgaatgacatgcctagtcaaaccaatcccctgagcctgtgcaaatcagacactgcctcctccagcctctgtatatatacctagctggtatctgtggcaggtggggttccctctcttggctttggagccccccttcctctgtctctgtacaggggagcttcttccttttcccttccctcttgcttcttcttgcctattaaactctctctgctccttaaaaataaaaaaaactatatttgaaacatttctataattacatgactggtcgtttataactaaatgactggaattctcagaagagaaagccatttattcagagccaagctattcaggtaagtatggctatcctgttctttgaagtggttcacttcaactcaacaaactgccaatataaatatgaccttgctctctccttcccagcagacaggcccaactaacacacgtccttctccaattccccaccttaaacaattcctgtatctcacagaatggcaactgtggccacaagagaaaaatatatacacttgtgggcttttctaaagaaatatagttagagctaactggtttggtgattttgtatgtatgtgattgctgaagatgaaggttcaaaaaggaggaaatcaggacctgagcctggaaggataatgaagaatagttactggggaagaatcctgggcacactgttatgctagccctgctctaattagatttaaatgttctgcgagtgttaacatgaactaaaccctacacagaaaatttaaaaaaaaaacaaaaaaaacaatgtttcaggtagttccacaagtaagaaaaactggatttggattttgtatatggccatagtaaaaaaattccaagaaagctttggtttcttttttaaagctgacaaagatgtcccctttgccttcaagtcttaattttagaagggtgacgattaaaattgtattttccaagcacccctgggaaccagcttggagctgttaactccaaccaaggtggatggagttaacaaacacatttcactctggaaatcacctaaattagagggagaatgaatggatcttgccaaaaggactcaaacaggcaataactttacaattaaaaagagaaaagtgtcaatagcaatataagaaagacaaaattgcatcaggacacacattgcaaatatgagctcacaaaaggaagcaggtagtagatcttcacctatttgtcctactgagagggacagagaatatataaagagtagttaaagagtgagaatttaatgtatttttctcctcattttacctgagagacaaatgggctaagaaaagatggtacaagccagaacatttttgttctgacggctctgctcaaattagcgtgtttcataaccttgaagtactagggtaattattctggcctgactaatttaaattataatatcaacaagattccaagactgagtcttaaaacggcagggtttccaaactgcggctttccagtcctcttcttccgagtgactgcagacatacagctggagagaaagtgaggagaaaaataccatgcaggaggacttgacctgcagacagctggcctagacggggctcatcagagagaacaccagccactccactcccagaaccacggtggctgtttacagagcattcactgtgcaccagacactgtcctaagagcactgatccatggtctccttaaaacacaccttgagacacctatcttcacaagtaagaaaacagaagccaagagagtcacacaactcataggtttgctttaaccctggcagtctggttcctgagcccatgctcttaaagcgctatgatatattgcctcatgccccgaaattctgtcaaatacattctaaaaaggtttatatttaaatatcagcatccttgatgtgacagaacctaaatatgtagaaaatcttgagagaaaggtctcattatttcctgatgccacccatgagcacttgtacccaacttacacggcttccgttctgtggagcacactttacaagcagtcacgactgtgcccatctagctggaagtagagggcagagatcagtggcttcgtctcacagggccgtagtctggtactgccaacggtggcttggcccagctgtgaccgggacactcatgaccaggacaggcactcatgtaacgaccaagagcctcttcccatcagggcacaacagtgctcacaatgcttggttgctgctggagttcctgtcttggcgtgatactgggaggaaaaagtgcccaagagttctgtgcttagggatgctttctgggtggtctccaagtgcctgtggtaaccccttcaaacagtagccttcacatatttaaggggctcctaactatgcatatttctacactttcgccaagaaaaaatcctgtcagctccaggatgagttcaaatatatatgtgtacaaagctgcaagttcatatcctgttattttgtaatacataatgaacatataatccaaccagaccttcatttaaaaatcagcatactcatggcctcacctgtttaacccttgaatgcccttttggatgtacaattaatataattatttgaaaacatgattgagagcaattggttggcagtttgactatacctgtaagccaaccttgcaaagacgaaatctcattctggctccctttcctaaggccctagggtgaaatcgttggtgtatcatttaatttcataaatacaggggattaccaggcaattaaaaagtagaattattttaaagcttggaagaagaagaataggtacatcttttctttgagtctattttatatattgcttgacaccaagcaaaggtgcccaataaaatgaaactatggctgtttgatcaatggctgagtatgatccaaatttaatgaaactcaaagaatgaatgaatgaagaaactattaattgaatatttgtaagagttttttccattcattcatccattctatctgtgcctaaatgcctaatgtgaatttcaggaaggcaaaacaaacaaacaaccccaaaaaagaaaaaacatgttatttattaggaagatgttatatatcaagcttgtccaactcatggcctgtgggctgcatgtggcccaggatgactctgaatgtgccccaacacaaattcataaactttcttaaaatactatgaagttttttcttggtgattttttttagctcatcagctattgttaatgtagtttatgtgtggcccaagacaattcttcttccaatgtggcccagggaagccaaaagattagagatccctgtatatattatatataaaaattactgagttttttttttttttttcttgagacagggtgtcactctgtcactcaggctggagtgcagtggtgcaatctcggctcactgaagtcttgaatttctgggctcaagtgatccttccacctccgccttcctcagctgggactataggaatgcaccaccacgcccagctagttttttttttttttgtaggaatggggtttcgccatgttgttcaggctggtctcgaactcctgagctcaagtgacccagctacctcagcctctgaaagtgccccatgggattacaggcgtgcgcctctgtgactggctgagactttcttctgaaaactatgatccagtggacctaaaagtggactgacatcactggtgtgtcaactgggagcctgttagaaatgtgaattcttaatcccccatccgagccctgctgaatcagaacctggggataggcccagtgacctgtgttttaataagccttcccagtgactctgctgcatgctcgcctttaagccccatggctcagatggacctgcggaaacctgttaagcctgaaaatgagatgtcgtttctctcaactggcaactataacttgaaaaatactgagcaagaaagatgtagacgattgtaattttctacttaactaaaaaagatttctcaggtgaaatagaaaacaattgtttcatgtaaaactataatttatttgggacactgttcaaagttattgagtaccagctagctggaaaagcacctacaatgatctagtggatttggcatggatatggcctacagatctgtagtggggacggagaaagggacgtggtgtcagtgtgagctgtgtggaagctggggctctgcacttgctcaagaagtctcccagacgggaggtgccctttggagatgaaggcagtccttttatttaaaaagttaaaaagcagggtatgttttgattactaggaacattctacaggacaataatttgtgttgatcaattattatgagaaaagctcagaaacacacacctaagaagcttctttcattctgactgttctgagcctgagaaatagaacccaacctcagtcaggcaggagcccagagggagccatttctcaaggaaaacacgaagttggtagaggactggtcatctgttgataggtcatgatttctgccaaagtgggcgattttagcagaaaggtggatggagttgcttaggtctgactccccataggcatggacctctcccatcattagtgttctgagataaatgcctctgcctgcaggccaagctccctgtgcacggcagcaagcagaaacatgactactcctgactccacttcagactgaacgtctgctcatgcatttatcaaaaggaaatgtttactaagcacttgtgtgctaaacactgtgtactggagacagcaggcacacagatatgagtgagacatgatttctgttctgaggaacttcatgagttggggagaaagccatggaaatacataactgttcatacagcaccaaggtgtcaatggggtaggatattgcttttttccacctagcatccatttcccttctggttaggagaataattttgctttagagcagtggtttagagggtgattttgtcagggcatctggcaaggtctgatgacatttttggttgtcacactggaggagtgaaccaccatactacacacaggacaggccccataaaaagaacttatctggtcccaaaacgtcaacagtgtgcaggcagacaccctgcggtgggccaacaaatgaggaagctctccctgcccctggctcagccagtgagggtggccagatgtgttcttccaggattgagtcttgagccgaatgcagaaaggtctatggctggctggagctgagccatcccagtaccagccccatgaagaacacaccctctcctctgccaagccccaccgagctgctcttctggagccctgttgtaacttcttcctttgagtctgtggcctcaaaaaaaaaaaaaattggttttctgctttgataagccagagttggttctatttctttcaagaagattcccagttgattaaaaaaaaaaatcagttcacccgttattaaaaagaatttaatgatgtctagggaacactgatctttttgtttgatcaaagaccaactctgtagacccaggatttgtacctgaagcagctgttttttcacttaaatgattctgtctttcctccgattcataaagtctgggtgatacacaagcaagctttaatgcctgatttctactccccaccttcactggaaaagcaggggttgttcctggacaaagagaaaacagtgtctcactgccaccaagccctgtcaggtgtggcaggaggtgtgagggggataggaagatgcacagagggactgccctccatagcttgggtctccctgaaactggatcttcccttgtggagtcggggaaggaagtatcgctgcttgtgggtttcaaagatgcaagggaagttcatggactgggtgtccaaggctgcccaggagaggggaggtctgggtgctctgtgtatgtggccaggtggatggactcgtaacaccaatcaggcatggccagtgccatgggccaagacacccaggacaaatacctcatcagttctttaaaatcaaagctaaaaaatcaaaatcacaatgagataccattgtacaccagtcacaatggttattagtaaaaagtcaaaaaaataacagatgctggtgaggttgtagagaaaaaggaatgcttatacactgttggcgggggtataaattagttcagccattgtggaaagcagtgtggcaattcctcaaagagctaaaaatagaactaccatctgacccagcaatcccattactggttaatatacacaaaaggaatataaatcatcctaccatgaagacatatgcacgtgaatgttcactgatgcactattcccaacagcaaagacatggaatcaacctaaatgcccatcaatgacagactggttaaagaaaatgtggtacatacacaccaaggaatactatgtagctataaaaaaatgagatcacatcttttgcagaaacctggatggagttggaggccattatccttagcaaactaacacaagaacagaaaaccaattactgcatgttcttatttataagtgggagctaaataatgagaacacatggacacagaggggaacaacacacgctgacgcctatgtgagtgtggagcatgggaggagggagagcaaaaaaaaataactattgggtactaggcttagtacctgggtgataatataatttgtacaaaaagcccccatgacacaagtttacctatataacaaacctgcacatgtacaccgaacctagaaaaaaaatttaaaaaaaaaaaataaaagttaaaagctagtcatattcttacatttcagccacagcactggacttagtagaaattaattaattaagttccattagccagatttctatttaaggcctataagtatcagttaggaacagtctggtggaccaaaaaaagagcctcaggctccaaaaaagaaaatgtcctgaggaccccctacaggacaatagccccgtggggccttgctggtcagcagagcagctattcgaatgcagttccaccaacagcctcaggggcactgtgctggtgtgaatttggggctgaatggaacattatctggttccgcatggtatcttattatttgaaatttcaggctatttctcttctgactatacaaaagttttcctttgaaggggtgccaagaaagaatagagagaaaaaaatacctttttcattttctaaataaaactttaggtggctcgaaagaaggcaatatatcctgatggttagagcaagggtttagtaagagattaccctgggttaaacaactgggtaaggacctcagactaatcacttaacccctgctggaggaaatctaagtaaaagtaaaatgttggagtttagtataatgtttgaagttcataaaactggcacaatgtcatctactttgctagattgttaataaggattaaataagatacagcatttaacacacagaaatgctcagtaactcactataataatcagacccgaagatttatgaaaacctgcttcctagttcaagagttgaaggaggaggttgcttactatttttgcacaagttcaattccaaaacattgatctgtgattaaatatcataaaactatcataaaactcacaatcacaagctacttatccagctcataaatcacagcttttttctactttttgccatctgcttattaggtaactgtttatctactaaaagaaataaaagatggaattaaaataaatccatttttctacctgttgacttctgtgataaagggtcttcactggggtgatggggaagttctgaaaatggatactggtgatggctccacagcattgtaagtgtaggacattgtgaatggcttggaactatacatttaaaaatggttaaaatggcaaatggtatggcatgtatattttaccacaattttaaaaagagatcagaaatctctttttagaacctgcgattcactcaaatatacagctgtctgtgctatgccgtcctccattactagacataacaataacttggatgtaccaaaaagcagattatctaaacagatttgggagtgaaaaggaggtttgagtattctcagcaccattaccaattctaataattcatcataatagtttaatggctcttttttctgctgaaataattatatgtgccaaactcagcctactgattaagaattgtagctacaaaggctagcctggcagtttgaaaaatcttaagtgaattttatgagatcagaatcctcattccagatctgtctctcccaagcctagggcaactgtatggctcaccatcttgactttgaagtttttctctgctacaagactgtggttacccacaccctttgctaaaggtggattccctctatctacaatcagttcttgagaaaatcagactatcggccaggaagtgaaattcttctcttcctttgaactaaaaagactctgctgctccctgtgctggattggtatctgtcggcattcacatatgaggctctctctgtctctctagaattattaactgaagtgaagcctctgaacctgtgttagacagaagttgagccagcaagtacagccccacatatgtgccctgtttacacattagtttattttaatttcattgtcagatttaataattccatttacaattacatttctgggttacaaaacatcttgccttttgaagctcagtgtcttccttaaacaaacacacccacacattaaacacgcacacaccctcttaaaatattagtgcatttacaaaagggaggtcttagccttgagaacgcaggtgctcctttccatttctttcttccaaaaagctttcagcgatttcagaggctacgttgggtaaatatatgaacaagccaaagattagggattctatttacttggctattattctgggctgcctctattattgaaattgtgtcataatcctagagctaactaaattgtaactctgattccgtaacatgctttcctcatttattcctgctacgctgtgcaagaaaagcagctttctgccaatgaacatcctgtaaagttccaaatcttgctttgtacgctgtgcgttcatgcctttacattcaacaaatcttattttcctacaaaatcattttactgtaggtaaggcaattacatactagtatatatattagctactagttagcatactagttggcacatgccacttttcagatttgtccccatgatatcttactctgataacccaataatatcttctttgagcatcactgtattcccaacaaggcaactcagttgccaaaaattatgaaagagcaagggaaaaaaaatacagtggaatatgcatgcacatatttcaaagcaaaaacttcctggtataatgagaaagaagttgaagaaattaccagcccacacaggtgagtcagagtacctgactctgaatcctagttctaatgtctgctactaggtgatctcaggcaaataagttacttatgcatcccttggactgtttagagaattaaatgagatcatacagcaacatgcatagtacttggcacatcaaatacactcaacaaatgcttttagctgtacttagtgttattgctgtcactattgtaacaatgaacaataaaataacaaatgtatgcttggtttgattaaacttttatgactccctcctagccattcaatgctggcaatatacaagtagcagaaattagttttattgaaagtatttgacatgaaggattacttatctttagaaaatcaatacacaggctatggaagcatttaaataaaatgtctatcctaatgtggaatgcacgtgcatcaaaaggaagacaaaaataaatctagtgttgaaattccactattttgagtgtgtgacttaagcttttaagaattttgttaaagctcagttttatttaaactgctagaaagggaaatttaagtacaggttggccttcctcctgaccctaaagcttaaacaaaacatacatttagtaccgaatggaaagagagtaaagaaactgtgtgttacctgacatactctaacttatgtgatgggtcacaaaaataacttgataatgctattcagatatttgagatgtgcaaactctacaattaaccagggactattcaataagagaaactttaatgtaaagataaactattaaatgtaaaagaaaatcaggtataggtataatttcttaatctaatttcattattaataatgttacatcatagtcataaagaaaaagtttcttttacatttagttgaaaaagacataaacaaacaccagaagatgtcttgtaaatgctctttcaggaaacagtccagttaaaccaagagaaatcttgttcctacatcctctagcaacatttcataaaagagttggctagcaaatgtcaatttcaattcttcaactaaaatctgctctaaatctctataattattactataatttaactttttactggtactccttccaaatgtaaattcatcagtgtattgccaacttgtgatttcctcagcccttgaagcttgatgcctgagggtgtcacgcaggaaagttaagaatctagatccagaccaggtgcagtggctcatgtctgtaacactggcactctgggaggccgaggcgggcggatcacttgaggtcaggagttcgagaccagcctggccaacatggtgaaagcccatctctgcgaaaaataaaaaaattagcgaagtgtggtggtgggcgcccgtaatcccagctacagtcaggaggctgaggcaggagaatcgcttgaacctgggtggcagagtttgcagtgagccgagattgtgccactgagctccagcctggatgacagagcaagactatgtctcaaaacaaaacaaaacaaaacctagaaccagacgtttggggatacaacatctgcttctgtaacctgtgtttagcccactcagcacacttttttttttttttttgagacagcgtttcactcttgtcacccaggctggagtgtaacggcacaatcttggctcactgcaacatctgcctcccaggttcaagtgattctcctgcctcagcctcccgagtagctggggctatacgtacatggaccacagccagcaaatttctgtatttttagtacagatggagtttcaccatgttggccaggctggtcttgaactccggacctcaggtgatccacccatctcagcctcccaaagtgctgggattataggcatgagccatggcaccaggccagaacagttttaaccataagttaagaacaccatctataggcagagtgcagtggttcacgcctgtaatctcagcactttgggaggctggggcaggtgaatcacttgaggtcaggagttggagaccagcctggccaacatggcaaaaccccgtctctgccaaaaatacaaaaattagccaggcatggtggcacacgcctgtaatcccagctactcaggaggctgaggcatgagaatcacttgaaccaaggaggcagaggttgtagtgagctgagatcacctcactgcactccaccctgggtgagagagagagactccctctcaaaaaaaaaaaaaaaaaaattaaaaaaaggaacaccatctataacaaatgaccatcttcaaaaacatcttatgatgtttccattcagcactcaaagcactgagagaacgttacctacattccttttagaaggtagtatacactgacatcatctaaaaatggaatcattagtatattttttggaatgaatctactacaagatatttacttgaggaagaaaaacctctcagacctcaaagtcaacctctggacgtatctcaaaatggaagagggacccatcaaatttatacagaaagtagatgatagcttactattagagaaaactgtcaaaacaagcactacccaccaaaagtaacggtgacaaaacagaagttgaagaagacagtaatcaagagtctatggctaagaggtgtcgaggagtgctgtggggcagcaggggctctggaggcaaaagagtgtgaccgactcctgactatgccagagaatggctctgaaacaagacctttgcttccatacatgggaagtggagatgacacgacccaccagagcagtgtttggtggattaaagatgctgcccatgacccacctggcacattttcactctgtcattgtccctttgcctttcctgcatggagaatctccttcctgcatgctgcttaaacagagtactatctgaaatcatttaggcgggatctcttgatgcccagggcttatgaagaggtgcttgactctggccagtaaggacctatttgggaatggatagcggaccccctttcttctagtggtgtcccctacttattatgcctgctatctagctgcttaacagtcagtactcgtccagtgggcagaaccaagcactgtactagaacaaaaagtgtctaaaacaccgtgacaggaaggaggaagggcaggataggagtaagagaacagctgagagactgaacaagtgtggagacagcacaatggctatatattttttttcttttacatgattaaagaacttcacgaaaatatttagcctgtaaaatatccaaaaatattcatgtgataaaaaaaattcctgaaccaggcaaataaaaacctgttcccattgtaatcatcacaactttttgttgttgttgttgttgagacggggtctcgctctgttgcccgcactggagtgcagtggtgtgatttcggctcaccacaacctctgcctcccgggttcaagtgattctcctgcctcagactcctgactagctgggactaccggcgtatgccaccatgcccagctaatttttgtatttttagtagagaaggagtttcactatgttggccaggctggtctcgaactcctgaccttgtgatcagcccgcctcggcttcccaaagtgctggtattacaggcatgagccactgtgcctggcctgttttgttttgttttgagctggagtctccttctgttacccaggctggagtgagtgcagtggtgtgatcttggctcactgcaacctccgactcccaggtataagcaattttcctgcctcagcctcccaagtagctgtgactacaggtgcatgccaccacacccagctaaatcacaacttttctacagcacaggaaacaattgctcttttaagtctattttggtattcgtgtattcactcattgcacaaatatttattgaatgccgatgggctgagccctgtaacaggggctgcagatacagctgtgaacatgacagtcagttgccctcctatcacagagcttagactttattgaggggcagagaccataaaccaataaatgaaataatacatgttgaaattaggaagtaaatgttaatatgtgctatgaagcaaaaacaaagcagagtaagggggtagagaatgtctgactacaggggaaacgaagagactctattcataaatgtttaaacaacccatcaaaattcatcagaatgatttacttccaacagcaaagttttacttggcatgctagtagttttaaatcatcttatcttttaatatttaatgtatctgtgtgaaggggtttcctcctaagtccctcctaagtccctcacaaatgtaaaacacatttccttcctcctaagtccctcacaaatgtaaaacacaccctggggtgggcacttatcccaagccaaggctggtgctttgagcacgttctggcatttatttatgctgcgcctccacatacctggaggcacagatgctgctggctcagtcaggcagaacctgtcaggcgttaaggcttatctttcccttgaaatcccttattaaaaaaataaaaagcaaagacacctaaaaaataaatttaggaataaccatccagaggtagtgtgcatttactgttctcctacagtgctgggcacaccagccttgccacacaatgccaatatttagagattgatcagattacataaatgctaactgcatgctttaaaactagaagtattaactactactaattttcagtgctataagacaatgtaaaacgccttttctgtttcagtatctgtgtataccttttgacaacagggaaattaatcaagctattgctgaacaatgactgtttatttagctttcttattttaaatgtcagcagtactcctgctgacagacaggacttattgctcctcgattgtcgtgatgtttgtattgtgcaaataacaccaatagcaaagccttgcactaagcatgttttgcctactaggttagtaatcaggttattttaaaaaaaaggcatcaacgcttattatttaagctgctgtgtcacaagacatcaaactttcaagtggactaaatattttgggtcaatttgaataaacgtgtcatcctgtcagtcagagctgtctgaaactgaagtgagtttccttgtgaaaaagtgagtttcccatcatcagaactgtatgggcaaagagctttctccagcccattctgtacagagtccttcgcagtcactcagaaactgaatccgacaggcttgggagcttcctgagctgaattctcgcagtggccgaattgcataagggcttcttgatttctgtcccccgtgacagtcataaccatgcaaccatctctataacaactgaagcacggagcttgggagtcatccttgatatcacactcaccctcctccatgccaacataaaactgatcttggcactacctgccttaaaaatactgtaattggtttctcatagtcctcagaataaacaccaactctctttcacagtatccacaatgccctgcccgacctgacgcccacttaccttccagcctcattttgtgcctaatactcctctttcaatctcacctccgtgcccctccctcccccaagtggcaatgaaaaggctgctgggaagaagggaaacatggtggagtcaaggtgtggaccaaaccatgagcagtggtgtcactgctaaaaaccttcccaaggaggttctttgtttttaattaaattttaaatttcaggatagttttatatttactgaaaaactgtgatggagtcaagagagttcctccacactccacactcagccagtttcccctatcattaatatctttcatcatgtggcacatctgtcacaactcacaaaccagtattgacagaatattgttagctccagctacactttagtcagattgccctggtacgatcaaaactagctgtcttttttctgttccaggaccaaccaggggaccatactacatgtagctgccgtgtctccttaggctcctctagactgtgtcagcttctcagacttcgttttcaatgaccttgacagttttgaggagtactgcttaggcagtttgcagaatgtcctgaatttggtgtgtctggcatttttctcattatgagactggggttatgggtttctgggaggaaaacttcccatcatattatatcaaggatgcatactgtccacatgacgcatcactgatgctgaccttgatcatctgactgaggtcgtatttgtcatttcccccgctgtctctagagtgctctggacggaactcactctgcactgcccacataatgagtggggagttatgttccacttccctaaggtggggagtatgtacataaattacttggaactcttctctatgggagattattctattctattcatttaatcatttatatcaatatggactcatggatatgtatttaatactttgtatcacatcccaagactgtgatttatttggctgctggagttggcccaggttggggcactgggagctctttcagtgggcccctgctgcgatgacacatgcgcccatcactgtgtgtgtttctgggcacttccttcctttctggcactataagatgcttcatgctcatcttctgtcttccttgttccagccctggaatcagccatttctccaaggagccttggttcctcttactggagaatggtgtaaacccaatttctgggtgctgatgtgctccgtgctgctggaactgagaactgtttttaaagaaactagtagatagatatcttcattgtttgcattaatcttcttggagcatggaggtgattctttggagtataaaccataattctctggtttgtttcttaaacaaaaaaaatttaataagctagaagagatgatataggataatatggcaaaagcgagtgtgtttggcagactataaataaagctctacagaaacgtaaggtattatattttaatcagcttaaggtaaggccctgcgggcttctagactttggtttggtgagtcagtctgatgcgaaaaaacaaacaaaatcgagtttcagtttgttgagaattgactcatttagctactactatttctttccatctgatctgatgtttggtccatttgaaaaactccataaagttattatttagtatctctacttgcatactgcttttggccagagagattctgattagaaaggagcatggaaataaagttgtttaatatttacaaataacctcctggaatgctaaaatcttggactttatcctttcccttcccctcccctcagattctttgcggaagagttgaagaaagagagcataaggaattctgtaaccagaggcagaacccaaaactaactgggccatgtcctgcttacatggctgtggggagaatctttccatcaggacccccatggctaaaaatggttataaactaaattgacagctttgccacaaaagtctaaaggagctcacaggaagaggaagattttattgttgatcagtggatgtcaggcaggtctctccaatgtcaatgagaatagataggttgcgacattaaaaaaaaaaaaacttggagatcgttaagagaaccatcagggcccaagacccacattgcttacatctcttgccttctaaaggccaggtcactttcatgtcagaatgtaaggatcaacagagaaaaatgtgggcaaggcagcacagagggtatgaacactgacaaagtttcattatttataaaaatagggacaatatgacctgtgttataggggattaaacttatcagaggataagtaaaatctgaacctaaaaactcagtaagagggatttacctaaaaattttacataacataaaacacaaaaagaccaaatagtttacagagggcaatatgaaaacttgcatgagtaatacaattgccattcacaaactgctgaagtaatatagtttccattcctaatatctatataattctaccagtctatttgctgtagtaagaaacaattctgcttcctagtgggggcaaagtattacttccttgctattcacaagcctcagcatatctgtctttttagaaaactgcacattttctgaagtggctgtaatggaaactgaaccttagatcatgctcaccatagcatacttaacaaatattctagtatatattttataaaatggtaaaatgaatggaaatgccatatcatcatggtttattttaagcaaaaaccttaagttatcttattactcagaaatgtgatttaacataagccaaaaaccattgtgggggtatgagatgaacagcagaaaaccttaacattgacaatgagagttaaacctcaccccagatgtctcagcaattaagaaagttggtttcagtcaggtattgccacatgtgtttagtggaggattaagtgactgaatgtcatgcctataatatatatatttatgtaagctatgaatgtgtttaaaaatagacaaggccatactgtcaatctgcaaagctactgccacacgtctgtacacacaccccacccccttcagagattaaaaaaaggagaagcagattaaaaagaagtgctttgggccaggcaaggtggctcaggcctgtaaccccagcactttgggagaccaaggagggtggatcacctgaggtcaggagttcgagaccagcctggccaacatggcaaaatcccgtctctactaaaaatacaaaaattagctgggcatggtggcacatgcctgtggtcccagctactcaggaggctgaggcaggagaagtgcataaacccaggaggtggaggttgcagtgaggggagatcgtgccactgcactccagcctgggcagtagagactccatctcaaaaaaaaaaaaaaaaataataataataataagacaaaaaaagaagtgttttgaagtcaaatcacattttacctcccgcaaggaaattaagtgactttcctaagtaatttatagacagtaagtagcagagtcactgactgcaaatccaattctatttcaccatgtgattgctttctttctctggggaagaaaatactgttttaaccactattatgttgccttcaaatggtatttggtgtgttaggctttttaagaaagcccctgctgctgcaacttgtcttttttcctgtgaggatcactctatgtaaagttaagtaatggaaaacttctgaataaataccttgcagccaagagttagagagcatagatacatggttgcctagcagtggcctttaactgatgaatgtaaagcaaacatcagggaaaaaagaaagtagaggaatcctgtgtgctcagggacttccttgaatagggtgttggcctctagctggtgaggactagaaatggccgagggactcagagctctgagcagagccctgttcccaagggatgactcattctgaaaaagacaaataatctaaaagtttgcctatgtagaacttattattcaaagatcaaaagcattccctatttgacttctctgaatttgtatcattcaaagagcacaaatatgaatacaaaggtattctgaccctaagaaacacagtcttataactaaggaggtaaaaaaaagttgtgatttggttagggaggtacatagtttgaaggcaggtgttctatttctttccattttgctatgtaatataattctttacatttatccaggaagcagttaaacaaaaatatataaggtacctataaaaagttacattttcatagaagaatactgccaacgagatcctgtatgcttttacattacaaatctcagtaatttcacccatcactcctggtaataccccagtgttaaggctgtgagccaacacctaagacctgctgttttggggtacagactgactgcctccaagaaaatgagaagccactactatgggtcttagcttacaaatccagccctatgaagtgacaactggcataaccctctttgcatgtcccccattcatctctgacatgaaacaaatcatgtgaattaatgagatctgacagaacagcattaagaaaaatattaaaatgtaaaagtagaattgttctattgtttgtgttaactaaaatctgaatacttaatcatctctggtttgaatgatggacttctttttctctcatatgtgaattttagtgcagaaaatattaagtttcttaacacaaaattgttttggataaagaacagaatttttgagagttagttgcaacattctgggaagccgactagaaaagcacaccagccaaaagataaacactgaaaaagatttacatttttttcttttgatggtatctcctatcagcaaatgttgaggtgtagcagcatggcctgggaaaggatgagccaagcacggctgccaggaacacacacctcacagaaactcaccgcttatttccgccttagctcggggtgggctggcgctaccaaccaccagccaaaagtatacaatgtacccaatcagtagcttattatgatgtgcctattgtttcacttttgcctgggtctggaacagaccctgaactagatgtcctgtctgacagtacaggcagctgaagagcttggtctgcttgctgcctgaggtcctggttcaatccctggctcttccacatactgccttgttacataagcagagggcctaacctgcttattgtctataaaacggggatcataactcctacctcatagggttactaagaagagtcaatcaacagatacatggtaatccctaaaaccatccccagaggtggaaagttcaataaggaccagtaaggactagctgtaaatgatggctgtgtcagcatgcacacttcctcactcttcacaaagctgatggaatgaatgcagtctccaaaagagcaggatgtttgtctaagcgtctttcactacttcacctctggcacatggaatcatgtctggcacataattagcacttcacaaatatttgctgaataaatgaatggctgaaggcactgcacaaatatttgctgaataaatgaatggctgaaggcaagaatctggaattctgctaaaaaggagtacaggcattagattcaacagtcttaggcaaggagacatttaaatcacactcatgactacccagacacactcaattactacaatgaaaacacttctccaatattgaaagttatttcctatatgcactttttcagatagccagaaaacttttcagatagtcaagctcagctgcaaatataaccatcaatatattgcaattatctagtaacattcatatcttcctataaatatttgtaagcatgtttcaatgttcttatattcatacatgaaaaatcatgatgatcacttccatttacaattaaattttcagtaaaaatactcaaataaaaaattactgagaaaattacatagaaaaaaagaattgtaataccttaaagatattaagttctaatttttcaacaggtaaaaaaacaaatctaacccaatgccttggaatttcttgaaaatatgtagttttaaactttcagaaaaagaaataaaggaataaaaaataaatgagttctttagactaaaaaaaaaacactgtgacctgttaaaatctaaaggaaaattttctaagagtttatgacaaataaaaaatttttctattagagtataagtaacactttgaaagctaaaacctgaatctttatcctggtacttgaataaatcatggcaactaaaaattaatttacttaggacacagtgagacagatgcttagaacacaatgcacagctaagacatttcttttttatttgcttatttatttattgttttgagaaggagttttgctcatgttgcccaggctggagtgcaatggcacgatttcagctcactgcaacctctgcctcctgggtttaagtgattctcctgtctcagcctcccgagtagctgggattacaggcgtctgccaccacgcccagctattttttgtatttttagtagagacagggtttcaccatgttggccaggctggtctcgaactcctgacctcaggtgatccaccctccttggggcctcccaaagtgctgggattacaggcatgaaccaccacacctggcctaaaacattttctttaaatgaaaaaaacatatggagaaaacataaatcagctttcattatagatggtgccattttggttttgttttaccttcaaccatgagcatgggctccctgcctccaccgtgggccagcatctccctgcgatagcgctccccggcagccctggggaagagaggttctgttacagactcctgcttgcacagcctccattcacacttgtcttgaattctcaaagaaagccacactgatgccatattcataaaagctgccaccatgtgacaatttggcccctattttcttgcttctaaaaatcaaattctggcttttaaattgttctaaaataaattaaatcaggtgtgacatattccctgtaagaggataactatacttttggctatctgttctgttaacaagagacctcactttataaaaataattaacttatgtattatacaatagctgtccccaatctttctggcaccagggactggttttgtgaaagacaatttttccacagacgagggttgatgggggagggatggtttcaggatgattcaagaacattacatttacggtgcactttattattacattatacattgtaatatatagtgaaatgattatacaactcaccataatgtagaatcagtgggagccctgagcttgtttttctacaactagatggtaccatccaggggtgatgggagacagtgacagatcatcaggcctcagagtctcataaggagtgcccatcctagatccttgtgagaggatcataaggatcacatgcgcagttcacagtagggttcctgctcctatgagaatctaatgctgccactaattcaacaggagatggatggggagcggctgcaaatacagatgaagcttcacttgctcacccacccaccacacctcctgctgtgtggcccagttcccagtaccagtctgtggcctgggggttggggactcctgttacagaataagtaaaatattacattttattctctataaaaatagttttgtgattattttaaatgaggcttgaaattataccattaagaaataatttgtgatggcacctaataaagaagagaaaaagaacactctaaaacaagagtgaaggaagagaagctggcaggaaaaggttaattacaccagaaaaccttggttcaggataacagttaacggatcagcaaactccactggagtgtgcgggtgataaaggcacagtggaggctgccttgttcccgtcttctggtactctgtgtcacctggatatgcctacctgacggagttccacaaggaacgctgttaatgacaatatgtgaaggcaggtttggaataatttttgtagacataaatcctccaaactaatgggacctggaaacaagttatttagtactactcttttgtattttatgaaaaatgcaattcctttaacatacatgactacatactatgatgagacaggttaaataaattttgatattgtttccatttgagaagctctggagcctctttacatgtgggtcattttgtgaacatggtctttaatcagactttttgatagcattacagtatcaaaaacatgctgacatcaaacactagccctggtcacatcctgaagtgagtgctaagcgaagcaggaagcctggactgaggtggcgcctcccctcaggggcaggggtggctgaggggccctgcctgactcccgacctggggtgctctgaggcccttctcagccatgggatgtagtgccctgaccctaaatcaaatccctccccacaggcctctagctcctggcttgcctcagctctgcaatgcctggctttctgatgtaggctccagcctggttatttctcaggagtgagatcaaaaaggagactttgacagaggttagaaattttctagtctagtgagcatttttactagcttactttaacatgcccataaaagtatggcaactacatgtctaggcaagaatgtacacataaacaagatataaatatttagaaacgtatatattttatagtatgtacttttctagtaaagtatacttcaaacaagatgatattttgcctattttacagaaatctacagtaaaaagttataatccctgaaactgatttactgatgtcaagtttggctaaagatcttttaaaaataaaatctgaagagcagaccaaatgtctacagtctgcaaagggcagaagacaaaatacatgtgagtaccaagctgcaaaatatttaaaaattctatgacatcacattcagactcaaataatttgaaacaaatgtgattattaactgctgagaaaaatccaagtctaagtcaaattgtatgacagactgagagggtgaggtggaggtgggagggagaaaaaaccaggaatgagaagacctagattatagtcttagtccagtttttaatggtgaagtctgaacaaactgttttctctgagcctcagttttctcttataaaacgtgctggtttctgccaagactgctgtgaatactatgtgaaaactctaggacactctaaaaaccaagataaagcagtaaaaatagcactcatcagccaaagttccctgaaaagaatttggagatgtagttatttgtgtggtgagaagataaatgctataaacaactctgacaccagattataattactggttttctttcaaagaaagagccttctaaggaatcataggacccaaacttgacaacgtcttggttcctattgttatagggattcctgttaggaggatcaggaggccaaatcagggagcaaagggaagatctcctacatctctccagccagcatgggatcctctgcacctccccagacagcacgggaaccctcgcacccttcacccagcacaggacccccacgcacctctccagacagcacgggataccccacccccaccagacagcacaggatcccccgcaacccctcagccagcacaagatccccatacctccccagacagcacaggattccccacacccccaagacagcacgggacgggatcccccacacccccctagacagcacaggatcccctgcatcccccagccacagcatagaatccctcacaccctccaggaagcaagggatctcctgtacctctccacccaatggaagtttaaccactacctggcctttagaaagagattgggaaagcaggactactgatcctaggcacccctacttcctcccgacaatgctcccagcctctccagtgccttgttttgcctccattctgtggaaaggggtgggcatcccgtatcacgtggtgaggtcagaaaagccaagaaaacccacaggagcagcaggggctgcttcaggtagcacaggagccctcatacaagggttccctcagacaccacacagccacctctacacagtggctgcagggtagggggatgtccagggccaccggtcagctgcgggaagcaggagcaagcttgggtgggaatggccaagtggggcgaggctgtgtggggagcctgccactttctgccaggtttggctgtgttatgtgggctgcagttctcgagcccgacttccagatgtaatagagtggggaattactgtggtccaagatggggacattttagaacttacccccttacctgttgaaaggatcctgtagaaaacactccttccaaaccatggaggcgaccgctctggacatgaggtaagagtaatatctagcaccataccccacgaggtggctgaatcgcagctgccaggcctgccaagaacagagagacacagcacgggacacaagtcagtttccacttggagaatatcacatgtgagaacacagtggagacacagagagacccgtaaatgctttcatttgcattttaccctagaaggctacgtcacctatgatatcaatattttcacattttatacactgttagggctgaactgtgtctcctgaaaattcacatgttgaaacccaaagccatacctcagaatgtgacttattaggagacacagcctccaaagacgtgattaagtaaaagtgaagctcttagactgggcccttgcccaaactcactggtatcttggaagaggaggaaaggtggatgccagggtgtgggcacagaggaaaggctgtctgcaagccaaagaggcctcgggagaagccagatctgctgacaccttggtctggacttccagcctccaaaacagtgggaagtaaatttctgttgtttaagccacatagtctctggcattttgtgaaggcagccttagcacactaagacatacacaaagaaaattttgtatcacataaatataatcatatatagatgtatatgttttgctccaaatatatggctattcttcttcattaagtgagtttaattacactgattataatacattttatttcacatgactatctacaaaaacagtaaagtcaggagtttatttatttttaataatttagttagttcagagagttgtactctgcaatgattctctgttgcatgaactgcttttcatgaactagtttttgtaacacaaaaaccttccatgtttttaccataattacattttatgacaaaacaaaaagtcacagagcagaagaaaaatgggacagaatttaaaaatcattactatacaaagaggggtaatctgggaatgcattctttttttttttttttaagaagagacaaacgctaagaaccaaagataaccaccagcaacttgcctctcagtggaagaagggtgaacaaactgttgtccctccttctctaagctccttccacttattttctaatcataagaaggaagaagcggacacctaattgttttgtacaagttcatcactttgggattcacttctgtgacagaaacgtaaagacagcctagagacggtggcaggagtgccaatggtggagccgggtggaggtgcacatctgttctgacccacttggaacgcctggtcatcaacattggaggagagaatttggagtctggcacagagagagagcatccattctatctcaggacaatgtagtagttatgataggaaaagccacatggattttcatggaaggacacagttccactggaaacttcttttcctacgaatactgctctttttctgttgctaaagtggaaaacatctccattccaattcatcagcaggtgcagggctatgcaagcacggcacacgagcttgcgatggtatatctgctgtaacgtcaccccagccaaggctgggactatgaaaactgtcctcaaaggctacacttaggactttaacatttttacttttctgaaacaaatctgacacagcaatcatccactttcttctgtctttatctgacataaacatttcttttaaaaaacagaagcttgggccgggcacagtggctcatgcctgtaatcccagcacatcaggaggctgaggcagctgggtcacttgaggccaggaattcgagaccagcctggccaacatggtgaaaccctgtctctactaaacatacaaaaattagccaggcgtggcggcacaagtctgtaatctcagctacttgggaagctgaagcaggagaactgcttgaacccgggaggcggaggttgtagtgagctaagatcgcaccactgcactccagcctaggcgacagagcaagaatctgtctcaaaaaataataataattaaaaaataaataaacaacttttttaaaaagcttaactttttttttaaccatgataacaacactctttaacaaagctgttaactccccagaaaataaagaataaacaaagtataatccttgctacaactctataaactagataagtgaattctagttaacatatcaaggaagaaacatttttaaaaatatggttacttcatcacaggaacgtggcagcatactccctgtattcactacacagtggcttaaaagacgcatggcaatgctagtgactctctggttatgtccgattctccaagacaactaatttgcttgggctcggcaagggctctgtcataaggaaggtgtgcaggagcactgcaatcaatttaggacatgggggcagcacctcagagacacactgcacctccacatccgttctcctctttctgtaagaagatatgattggaagtcaggtgggcgccttgtgagtggtgtcctgaaggaatgatccatgccccttcctccttggggatgcagccagtcagaagtgtgggcctgtaatggggcagccgcctcctgtgctgggcaggggcacttgcacggctattgttttgggtctcttgcacagcaactagacctgtatccctacctcacaggataccccaacttcaggcccaaatgccacccccaaacagtaccatgaatacacaaccaacagcggggctgaggctgctggaggtgcaacagatgccatgcccttggtagagctgtgccctaggtgggaggagctggacactcaaaatgtggcctgcacagtcttttgccagcaaggtccctccagcatagtgaagggcagagaaaggtagacacgtacttttcatcctattaagatgcaagtgctatttaaaacgaaagcaaagagactaggaccatctatgaattaaattctagtataacaaactttgaataactacatttttagtcaaaaggcttttagaattcgtttacaacatatacacagtccaatgtactctgtcttatttaaaaggggtatttgtcagtttttctttttatgctggaatcctaatctactaaatgatgagaactcatggaccactggtagcctttctcgtatgaagcagtttggatgtgagggtatcttctgtaatggaatacagcctgctgttttaatctgatactccaacaagatacgagcacttgtactactgatgataagcgtctctcagggtggaagccccggaatttgtagcatacagttaaggggctttgtctttgaaacattttcttcatggtgatttgccagaactagtttggcagcctttgcagtatagagcagagtttaattctgtttagattcaagctgaatacagctttgttttatcttgaaagcaggcccacttcaatagtggcatttgatctgagctaagaaatgtcttaagttccctggtttcatcagctcataactgagttcccacatcccccataaacagagttataaaaataagacctttcagaatggtagaaagagacatcaggatttgtgcatgcatcatttcctagacagccaggggtctgccttatcctgatccccctgcctgaatccaggtcttctggcacacacatgccccgttgtgtcttgctctttaattacaggtttgggttcaggactacacctcaagacatgctaaataaattatctccacctgacacctttcatcataggtttgcaagtctgtggctaagacctacaattccactgttgtttgaacacaattgctgaattcctgctaattcaacctaatattaagtccttattaccatttcactcattcatctggaaaaataaaatatagcatttcatcttaagcgctggaattatgatatcctcttccttttaaattgaagttttcttcttcctaagggatatttgtcagatggataaaagctttcacacttccttcaggatatttaacgtgtggatctgatttcaaaagcaaaccatgcaaacatctttgtagttttccttttattacggtgagagacatagattttcaaatcctattgctgtcccaaggcatgcctatttaaaccttccttgagttacataatctcagtgatcccatacgaaagacaaaacttggagccagcaaagcagcctgtcaggaaacccatggatatggtcacttgctttagaacttcagagaatggaaggctctttgatcatttttacttgcctatagccctactctaatgccacgattttccagggccggaaatggaaaggtagcaatgagccatttacttactatctattttcagtttcaaacacagaacaggggctagtgcagagcaagcactcagtaactgtgtgctagatatggaataacggaactaaccatttctcccaattatactctttttaaatttttttagagacatggtctcactctgtgactcaggctggagtgcagaggcatgagcatgtctcactgtaacctggagctcctgggctcaagtagcctcagacctcagcctcctgagtagctgggaccacaagtgtgcaccaccataattggctaatttttaaaaaaaatttttgtagagatgagggtctctctctgtttcccaggctagttttgaactcctggcctcaagtgatctgcttaccttgtcaagtgctgggattacaggtgttagccactgtgctcagccaactatactcttaaatagtataccatttcttcatgtccagctataaatgtagaaatgctttagctaaaatttattttcaaatgatttttatcactggaacattatacagttgactcttgaacaacacaagtggatccacttatatgtggatttctttcaatgaatacagtcgaatacatattggcaggttctgcaaccacaaccaaacgcaggtgggaaatacagtatttcagggatgtgaaacctgcatctatggagggctgaattttcctgtctgcaggttccacatggccaatcacaggacttgaacatgctcagattttggtatccatgctcggggggtgggtcctagaaccaattccccacagatgctgagggtcactatacagtagtcctcccaactcaagtgaaaaggtaacagcagctttcctatccacagtttcagttacctatggtcaacttcgctccaaaaataggcaggtgtaccataattacatattttgagagagggagacaccacattcataaaacttttattacagtacataagttgtcctatcttattgctgttaatctcttactgtgcctaatttataaatgtcactttatcataggtatgtatgtatagtatatatagagttcagtactatctgtagcttcaggcatccacctggggccttgaaacatatcccttgagaataagcggaggacccctataaaccacgagtatagaaatgcaacctattgctctgatgtgtgttataaacttcccaagggcatggcctacatattgtgcccatgtctggacttactgcagtactggaagcacaacgggaactcgacagcaatctgctgaatgaatggatggacagatggacaccatgggattctttcacaatgacattcaatgttactgacaactggacatctggctgagatgcagagtccaggaataatatttctggtttacaagaccggtgtattgggttgtactacaagggcagtttcatttaagtaatttattttcgactagggaagtgagtggtattagggtaagaatggtagtgaaatatattaaatacattgactatataccaatgatgatgtgacactgtctgagagagtacatttcaagaccaccacacaacaaccatccaaaaaggcctctgatatggaataatcctattcattatttcagaagtatttttcttcgccggattcttttgagcatctaccatatctgttttgcagataagaagatactatggtgttaaaaacaaatttggatcttaggctgtaaatgatttttaaaaatagttctttgactacattatttgatagatgatgtaaggtttctcaggctaattttggtaccacatctccaggtctggatcatgcagagaatctgagtagggcttcctagagtatgttatctccttcaagccttagagactctaaacaaacaatgggctagtaatactgtatgagctcatataatcttgttgttcacacttgcacctgttgtaatcaggataacaaggcaggaagaagcaagttcctgagctcgtcttcatagaaagaccattttgagttctcacattctctgtgtacaatatcactggtctgctaaaaaagatactccagaagtgtttaacgatttaaccacaatgtagagcagaggacatatccttctatttgcctcacacatccatgctctctctctctctctcactcactctctcaatgtgtgggcatgttccatgcatcactggagactagtgcttctaactgataaaaagtccctactgacagtttaccaaaacccatgaaataacagtgcccaacagacaggaattctccatttggaatataaagtgttgttaagtggaacagttattgtggtggacacactctcaggaggcccccatgacccatcctcctgatggtcacacctttgtggaatcccctgccttaaatatagacagaagctgctccttgctcctaaccaactgaatatggcagtggttccggatgtcactcctgtgaatacattgtgttatccatgatgtctccatctcgctagcaagctcactctagaacactccttgttagctagaggaagaaggtgaccatgttgggaaagcccactgtcagaggtctgggggaggaccctggaacctggggggccctctaggacctgtgggtagcctagagccaaccggtaagaagcctgtcctcagtgctataactgtaggacatgaattatgccaataacctgggtgatgcagccaagctcccagatgagactgcagccctgccagcaacttgcctgcagccttgtgtgacccccaggcacagcaagcagctacactgtgttgactcctgatccaaaccaactgtgagataggcactgttttaagccactacatttgtagaaatttttatacagcaattgaaaactaataccaatatctatttttttaaatgagacttaggttaaaaatactattttgagaataaacgcctgcaaatatggaaggtatataaagatataccttgtgtctttgtgaaaatgtttgaagggcagtatctttgtaaattttttttttttttgagacgaagtctcactctgttgcccaagctggagtgcagtggcacgatctcggctcactgtaacctccacctcccaggttcaagcgattctcctgcctcagcctcccaagtagctgggactacaggcacgtgccaccatgcccagctaatttttttgtatttttagtagagacggggtttcactatgttggccaggctggtcttgaactcctgacctcgtgatctacctgcctcggcttcccaaagtgctgggattacaggtgtgagccaccacgcctggccctttgtaaatattttttaatttttttttgtaaatattttactagcttatattttataaatagacttgaaaagagcgatttgcccaaggctactggcagagattagtaagtgttccttccttcattttcccctttttccttttagaaacagaataatacccttttcttgctaagtgtgaacaggactctcgattgctgtggcagtgactgcatttcccagatgccccgaggcgtgtggctgtgcgactatattcttgaaaatggctgtgagtaaaggtgacgtgtgcagctgggttctgcaaaaggaagctactcgccctccttgtcctctttctcctttcctgctagctttgaaatggtgaagactggaatcaccaccttggactcaaaggtgaacaccagatgccagatgttgatgaagctaccagctcactggttctatctgctagcttgataggcaaggggaggccaagtttacacccggcttgattttacatcactaacaccaaaactgatgtctatgccacattcatgttgtgtatgtatgacacctgtaacttttaactttgtttctaccatgtctgctaaaatacatatcaaaacacaccacagagctatttttacagctgaaaagaaagttcttacacaagctatgttaagtaaatactatagtttaaaatgttgaccaggcacggtggctcatgtctgtaatcccagaactttgggaggccaataaaaacagattgcttgagcccaggaatttgaaaccagcatgggtaacatggtgataacccatctctaccaaaaaaacaaaacaaaacaaaaacaacccaaaaattagctaggcgtggtagcccacctatagtcccagctactcaggaggctgaggtaagaaggatcacctgagcctgggagcagaggtggcagtgagctgagatcacaccactgtactccagcctgggtgacagagtgagactctgtctcaaaaacaaaacaaaacaaaaacccacacaaagtagtatggcagatgtaatgttaaggacaaacaaaatattaactaggagcacatctcttcagtatgctaacctcgactgttaatgtaatttatatgtaatattaaaaaacccctggaaatacaggattgtgtctatcaaaagcaaatctactagcagagcagggatgtaactgactcaaatggaaatacatttattagatgagacatagaaaggtaacatggatctaattaagacaaatgaaaaacaaccaccacagaaccagaaccaacaaatacttgctctttttcttcccagtcaaaactctttaacattgctttttctctctcctccaacatctgctgagaaaatggtaaattgccccgtcattctaaaggaacccatgctaacattgggaaagtgtcagagaagttaacacagaaaataaggacgtccatggtcaggagagtcagcccaggacagcaacggggcctctgtaggaacaggtactgtgtctgaaccctgatcaggcagctctgggagtcaatgaaacccctgaggcacacgacaagaagggttctgtttttgttttcatgataatcataagtccttcagtaaaggaggtgtgtctgcataggatcagggaaaatccatgaaaggaaaaatggaaaaggacatgagtgccctttgtagaccatgagattttctctccaggcatagagtacaacaaaaagtgatgcagaaaggacagtaacttctcaatgggaaggagtccaagggcaggtgtatcaccaacagattgcacacaagtgtgcaaggaagcaggtgtgtggggggagggctataactgggctttgtgggcagaggctccattcctgtaggggctcatagctttagaacccaggtctccgcctgccgtggggaatcaggcagccagcacctctaccctgttagataaacttgcaatacaaaaaggagagggacaaatgggacaatttgatgtcacatacggctgctatggtcccttccaaaactcatgttgaaacttaatccccaaagcagcagtattgagaggtggggcctttaagaggtgaccggatcatgagggccctgacttcataaacagactatcatgggagtgggactggtggctttataagaagaggaagagagacctgagctagcccatgagcacactcagcacccttgccatgtgaggccctttcccatcttgggactctgcggcgtccccaccagcaggagggctctcaccagatgcagatcctcaaccttggatttacatgcctccattactgtaaaaaataaactcctctttgtaaattacccggtttcaggtattctgttataagcaacagaaaatgggctaggaaagggcctactgacttctttcattaaacaggcaagcagaaccctggaatggcttcctcagaccatgtcctgctcagacttcacttcctgtcactctcccgttgttcactgtgctccagacatgccactgacttgctggtccagtagcctccaggtaagctcctgatcctagctctctcctctctgcctcagatactcttcccccaggtcgatccatatggctcattctcactttcctcaatgtctttttaaattacgcttcttcaacaagaccttctctgatgagtaaaaaaaggggagggggtcaggatgctgtctcagtgccaattccaggcacaattggaacaaccggtttcactgctgtccccctgcccccaggcagctgggacctcagcatcgaagtctgtgcagatgaactcccactccataccctcttgctcaatcagggcctaactcccctgcctgccagcttggcctcccccaggtgctctctggtgtggctgatgtcctgcaattgggctggagtcctcaccttcagagccactcacccaccaccagagaccgccactgccccctccccattaatctaatcagccagcacctgggattatttcagtgggaagatttattgaagagggggtagaacacacgagtttattattttctaatgagtttgtattgtccctttacagtcttcatagagaaaactggagaggctgtcctaacttcacctcagcattggccgtggcagcgagggcctgccctgtgtcttgtgcgtgctcaccaccctttcctctgtacctctgcatggcgcataaacactaggcacagagacttgaaaatcatccatctttccaaacctcactgaattcacaactggccagcactagagaggaccctgacctcatggctgcacagtcactggggggtgcagacagtaaatccgggatcactggacagtcacactgcaacaagtgctatgggaatgcaggctctgcacttaccggctgcacagccaacaccagatcccacaaccaccctgaccgtggccacacccacctcctagggctatggcatgggctaaaggagagaagggaagggaaaagtgtgcactgtgctggtcctcgggatggtccagtttgtcagctgctaacagaatcctttctaagcagggtggacatcagacacctctttgtatcagtgactagtggggtgtcttcaataaatatttacacaaacaatgataaaaggagcaagaatattagacataaatgactataatttggaaacagtttacatctgtaagttcaaattctttttctataattaaccagtttcaaaaatcagtaaaattataaagttatcaacaaataggtaacatgtaactaatttgctgactacacacacacacacacacacacacacacacacacacacatctgcatttctgaagtgacaaaacaaaattaaaataatactgctattagcttctcataagcttaggccaaggtgtatgtgaaatactgaagaatgcatgactcctacacagactcttccctaacagtcatgtttcatctgaaacccgtgaaatgtggtgtttgcacagccacatcctcatttcagtgtctcttacctattaacccttacctaataactctaaatgattcactcaacttccttggtttgaataattgctgctccccaaacttattttctcattttaatggtgaaagatccccctaagatcctattaaaaagtacatcctattaactttcctttacattgcctaagaggtaaaaagccagacgtgtgcaattaggaggtgtgtcttacgaaggattatgctcctgctaagatgaaactaaattaataaagacaataaaaacaacttcacctccaggaatccgtaacaactgcccccccacttcccatgtaaaggcattccagagcttattaactgcacattctaaaggatagcccagggcttgtgacagtatgtcatttgcaggtcatgttaccacctgtattttgttcagaataactgacagaaataaagaatgtgactgagccaccgaaatgactaaggctgcctgcattctatcaacatgtgatcaatcctccctgattgtctcatctgaagaatttccaaaattcctgatgcaagagtttttagcaatttttttttaacaacaacaacaaaaaaaacggctacagttgtggctgaaatatatggaaaacttgggtaatgccaaacagtacatattatggaaatttaaaaaacatattagataaaaatattcaataccattagttaaaagtagtattcactataaataatgctgctgcgctgaagtattcttacaattattagtataaaaagagaatcaactagcattactttaaaatgctataatattataggtattttatatatagaagctctgtaagagctttcttctcacatctcctaagtttgaaggtttgaggtgtaatgttaaaaggatctgtggtgaatgacaacttgttgaaggctgaggtgagctgatggcctcatatttccttctagatctataggttacaacgttaaacctaatccctcagaacactagccagaacacccttcccaggaaagctggtctctaacttctatggcaattcagtctccctcttcctgggaaggaatggaggcattgagtgtggcccatcacagcccttccctgctctaagacagtgactcttctttaaaaaattgagataaacatcacataccatataattcactcttttcaagtgtacacttaaatggttttcagtatattcacaaaattgtgcaactttaaaaaactgagataaacatcacacaccatataattcactcttttcaagtgtacactttaatggttttcagtatattcacaaaattgtgcaaccatcgtcactaactccagcacattttctcactcccaagagaaaccccgggcccattcgctgtccctctccattcctccttccttcagctcctggtaaccactgatctattttctgtctctatggatttacctgttctggacatttcatataaatgaaatcacacaatagaggttttttgtgtctagtttgtcgcaccgagcgtaatgttttcaaagtctatccatgttgtagcaatacttcatttctttttatgaccaattttccattgagtggatacaaggcttttgtgcatccagtcatctattgagtggtttccactttttgactatcatgaataatgctgttatgtacatttgtgcatacatttttgggtgggcatatgttttcagttctattgggtgagagttccctaccacctgggagtggaactgctgggccatctggtaactctgtttaactttttgaggagctatgagactgtttcccagagctgctgtacccttttacattctcaccagcaacgtatgagggttccaatttctccacatccacaccaacacttgctactgcccatctttttattatatccatcccagtgggaatgaagtagtctcgcactgtggttttgatttgcatatccctaatgatgctgaacatcttttcatgtgctaatttgtcatttttgtatcttccttggagaaatatctcttcaaaccctttgctcactttaaaatgggttgcttttctaaagattaaactctgatcagatacatattctcccattctgtgggttatttcactttcatggtagtgttctttggatacaaatttgaactcattaaaattaaaaaatttgtccccattaaaataaaaaaaatcttctgtttctttggttgtttatgctttaggtgatgtatctaagaagccattgcctaatccaaggtcataaatgtgtatgtaatcctatgttttcttctaggaatattccagttttaactcttaaatttaggtctttgatctattttgagttaatttttgtatatagtacaaggtaggagtccaatttcattcttttgcatgtggagatccagttttcccagcaccattcttcgaaaggacaattctttccccaattagttgtcaactgaacataaatgtatggcttttttttttctggaatctcagttgtattccattgacctgtatgtttatccttatgccagcaccacacagtcttgattactgtagctctgtagtaactgcttcaattgggaagtgtgagccctctagctttgttccttttcaagattgttttggctattctgggtctcccacatttccgtgagaaattttattagatttgtcattttctataaaaaaaagcagctgaggttttgatagagattgtgttaaatctgtaggtcaatttggggtgtattgccatctttaacaatagtaagtcttacaatccatgaacatgagacatctttccatttatttaggtcttctttctttcaataatgttttacagtttatactttacaagtcttgaatttcttttgctaaatttattcctaagtattttactcttccagatgctattgtaaatagaacggtcttcttaatttaatttttaggttgtttattgctagaatacagaaaaacaatttttgcatattgatctcataccatgcaaccctgctgaactggtttatcagttctttttttttttttttttttttttttttgagatggagttttgctcttgttgcccaggctgaagtgcaatgggatgagctcggctcactgcggcctctgcctcccaggttcaagcaattctcctgcctcagcctccctggtagctgggattacaggtgcacaccaccatgcccggctaattttttgtatttttagtagagacaggggggttttgccatgttgaccaggctggtcttgaactcctggcctcaaatgatccacctgccttggtctcccaaaatgctgggattacaagcatgagtcactgcacccagcctatcagttctctgtgtgtgtgtgtgtgtgtgtgtgtgtgtgtgtgtgtgtgtgtgtgtattccttaggattttctatatacaagatcatgcatgtcatctgcagagagataattttatttcttccttgtaatatgaatgcttttaatttttttcttgacaaattcctatggtgaaaaccaccagtacaatattgaatagaaggggcaatggcagacattgctgtcttattcccatctcagaggaaagctttcagtctttcaccctgagtataatgtcagctgtgggctttttctaggtgctctttttaggctggggatcagcattgactcttgattccttatccgcagttactgccaatcaatcctgaagtcctgataattttatctcaatatattccttgtagtttttcccttccatactcatcctcaatgcccaggtttagatcctcatcacctcttgcctaaactgtaaggcctttggggtacgtagggtctatgtgcatatatgttttacttaccaaaaaaagttacattcattaaacaaaaccaaaatgctgtggaaaatgaagacaagaacaggcagcagctaccagaaataaaaatatccttgccaaaacaaaaacaaaaaccaaaccaaaaacagtgggaagagcaggaggataaaatcaaggcaatctccaagaataaagcaaaaacacaggaagaagagataaatcaaatggaggaacttctgtttcatcagcataatgggtctgctatttccaacagtcctgaatgaaacaactaaactctggataaaatatttaaaagaattttttttggtaaatgtgttgctgagagaagaataaaatgttatcaaaatgatgtagatcattccagcagattaaaaaacagatgtttttaagtatatggtcatattcactgtatttttctatttgttttcatctatttcttggatagattgttttctccctgccttcaatctctgtaccccccatctatcacccatactgaaaccttaactttttgcctgcagcttatatctgctcatgtcacttctctgcttacaaacttcaaacctctaaggcctccctattccctccccagtcatatataagcctctgagcagacataaagaactcttcaggacttgatcccagtctgattttcaacccccaaacaacagcccctcccttctgttccaagttccctatcatcaagcaaccaggactaatatattctctaaccactttctatcataccttacctgttcctcactccctcctccctactgtggcttaagctagggtaaaatctgaagcagaagcaactaagcccagattaatggtcatttctgactccacgaggcaaaattcaacacttctctatttataatagtgttctcacagcactgcattgtatcatttttcacactgtcttgtacatgtatatatcatccatcctgaaagatgtcattcaaatgaattaacacacatgaggagaagtggtggtgggattaaataaaagttgtggttttagtgttctaaataatttagttctaaaacatctctatcggaaaaaggttttatggttgacttgggaaagaaagtagaataagcaaaatcactgggcaggataagttaacatggagatttttcaaactgtgcaccagtatctactaatggtttgtaaaatctgtacagtagcttgtgacctgcattaaaaaaaaaaaagaagaaaatgggacagaaaatatatagtgcacagcacagagggtaactttagatttgtggtacttttgtttcagtttcactcccacatatatgtacatatacacctaaatgtacatacatgtatctgtacaatagatcataatgtaaaatgcatttcttactgcaggtttgctcaaaatgcttaaacgccagtgagtaaacagttcaaggacagattaaaaaatcagtgctactaaagtaaaaagagaagtcaaggatataaaggcaggtgaaaatgcttaagatgggtgatctcgtggcttattctgactttacccatggggcaagtggaccataaacacagcaatggctgctgtggctctcaactctgagcactttaaagtatttgtgtttctctaacatggtagcatcagaatgcagggcaagtcccagtgatgtgcaagtctctactgatcttgcttctgttgttcctgtcttcatgatgcacttaaaatctggttatcatctaaacagaacaaaaggagtcataggttgtaggttaaacttataaactatgttttgctaaccattctgagatgcaccatcctagaaaataaaagacagtgaatttctgaagtaatcataatgaacaaatagaggatgtgaaagtaattcagattactgtgttacagtattgtaccacagttaatttcctgggtttgacggtacacatggttacacagaatgttatcactggggaagctgggtgaaaggtactttgcaacttacgaacataaactattttgagataagaagttattaaaaaataagattagagtgttttgtgaattccaaggattagtccaatagactagtttgagattgactccactgcagtaatcatgtttattactcactactgatgagcttagagctgaattaccttatttcaaataagcaaactccactgcacctagtgttactctacttgccttcagtactgtgcttctctaaactaactgtggcagcatattattctctaaaatattttaatgtatttctttattcatgttcatttaaattcaatcaggacagagtgttcaacttcttagaggacatactaagttttaagagggaaaatgggttagaaaaagtggttatgaaataaatgtaaactatcatttgatttatagacatctattgcttccatttaaaggacttagcagtatgaaaggattgtttagacgtactttggcttaagtgggaaaaagttatggctgcaattgtataaatcatttcaaatactgtttgattttagcttttgagtgtctgagtttttctaaatgttctgagaaagtctggttcacttttcactctccataaatcagcaagtatttcaaagcttccccaagacacaaaaaaacatacacatgtgaaaagaatgattgcatcatcactaagttaggaatttgaagataatgtatgttaaagaaagcaaataactgctttcttttataattattaaatatatacattacaaatcatgatgtgtgcaagacaccaagataaactattctagcacattaataatcacatatggtcatggaaggctgttgggggcacgaatcaccataaccatgctcaagcaactagctgtgcattatcatggggacccctggtggcctggccaatggctagccttggggagcagagactccctcaaaactcactaatgaaagaatgctgaacacacagattcccatcaattttggtctatttgtttttcttgctttgacacatcctatgtgcaactgattttatttatacataccatttttatcatgtcaattacccgtttttttcaattcccctttcaagctctacattattttattatactgacaataataataataataatacatgacatctgcttagtgtttactgggtgccaggcactgggctaagtgctttgatcatacattatttcagtcatagtcctgtgatttagatatcaccatcttactgatgaagatctcacgcctagctcacctgattctacaacaccacactctacagtatgcctgaattatccatcatatctgattaatctcactctcctcagaggagccacctctactcatgttgtaactcctccacacagagcttcagctttgtacaacctgtttccacacataactttctcaatcctttcttgttaatttgaatatgcccactctttatcctggaatgttctcttctctcaagtacacacactagcactctttcaaaccataggtcaaaccagaaacatgccaaataaggatgtttgccttttctattattatttagcaacagtttgaaagttcaagccattgaatcagctgaggacaaacagaaacgtacagctattggaaagcagcagcaaaaatgttatttacaaatgttgtgagtgatgtgtatgtagaaaaccccgaaattgtggcaggtatcaaagatagtatgttttcattagaatttccagccacaaaaatcaacaaatgaaaacaagtaacttccttatgtatcagtgataatcagctagaaaaaggtgggaggataaacatcccattcacaacaacaaaaaaccataaaacaaatacatttaaaaaggtgtatggggggggcagttccaagatggacgaataggaacagctccagtctacagctcccagcgtgagtgacgcagaagacgggtgatttccacatttccaactgaggtactaggatcatctcactggggctcgtcggacagtaggggcaggacagtgggtgcagcccaccgagtgtgagccaaagcagggtgaggcatcgcctcacccaggaagcacaaggggtcaggggattctctttcctagcaaaggtaaggggtggcagatggcacctggaaaatcggatcactcccaccctaatactgtacttttccaacggtcttagcaaacggcacacgaggagattatatcccgcgcctggctcagaggttcccacactcacagagcctcgttcattgctagcacagcagtctgagattgatctgcaaggcagcagcgaggctgggggaggggcgcccaccattgctgaagctttgagtaggtaaacaaagtggccaggaagctggaactgggtggagcccacctcagctcaaggaggcctgcctcagtagactccacctctgggggcaggacattgccaaacaaaaggcagcagaaacctctgcagacttaaatgtccctgtctgacagctttgaagagagtagtggttctcccagcatggagtttgagatctgagaacggacagactgcctcctcaagtgggtccctgacccccgagtagcctaattgggaggcaccccccagtaggggcagactgacacctcacacggccgggtacccctctgagacgaagcttccagaggaatgatcaagcaggaacatttgctgttcagcaatatttgctgttctgcagcctccgctgctgatacccaggcaaactgggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatgaggaaaaaacagagcagaaaagctgaaaattctaaaaatcagagcgcctctccccctccaaaggaacacagctcctcaccagcaacggaataaagctggatggagaatgactttgatgagttgagagaagaaggcttcagatgatcaaacttctccgagctaaaggaagatgttcaaacccattgcaaagaagctaaaaaccttgaaaaaagattagacgaatggctaactagaataaccagtgtagagaagtccttaaatgacctgatggagttgaaaactacggcacaagaactacgtgacgaatgcacaagcttcagtagcccattcgatcaactggaagaaagggtatcagtgattaaagatcaaatgaatgaaatgaagcgagaagagaagtttagaaaaaaaagggtaaaaagaaatgaacaaagcctccaagaaataagggactatgcgaaaagaccaaatctacgtctgattggtgtacctgaaagtgacggggagaatggaaccaagttggaaaacactctgcaggatattatccaggagaacttcccgaacttagcaaggcaggccaacattcaaattcaggaaatacagagaacaccacaaagatactcctcgagaagagcaactccaagacacataattatcagattcaccaaagttgaaatgacggaaaaaatgttaagggcagccagagagaaaggtcgggttacccacaaaaggaaacccatcagactaacagcaaatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgggagattttgtcaccaccaggcttgccctacaagagctcccaaaggaagcactaaacatggaaaggaacaactggtaccagccactgcaaaaacatgccaaattgtaaagaccatcgatgctaggaagaaactgcatcaactagcgagcaaaataaccagctaacatcataatgacaggatcaaattcacacataataatattaaccttaaatgtaaatgggctaaatgctccaattaaaagacacagactggcaaattggataaagagtcaagacccatcagtgtgctgtattcaggaaatccatctcatgtgcagagacacacatagactcaaaataaagggatggaggaagatctaccaagcaaatggaaaacaaaaaaaggcaggggttgcaatcctagtctctgataaaatagactttaaaccaacaaagatcaaaaaagacaaggaaggccactacataatggtaaagggatcaattcaacaagaagagctaactattttaaatatatatgcacccaatacaggagcacccagattcataaagcaagtccttagagatctacaaagagacttagactcccacacaataataatgggagactttaacaccccactgtcaacattagacagatcaacaagacagaaagttaacaaggatatccaggaattgaacacagctctgcaccaagcagacctaatagacacctacagaactctccaccccaaatcaacagaatatacattcttctcagcaccacatcacacttattccaaaattgaccacatagttggaagtaaagcactcctcagcaaatgtaaaagaacagaaattataacaaactgtctctcagaccacagtgcaatcaaactagaactcaggattaagaaactcactcaaaactgctcaactacatggaaactgaacaacctgctcctgaacgaccaccgggtacatgacaaaatgaaggcagaaataaagatgttctttgaaaccagtgagaacaaagacacaacataccagaatctctgggacacatttaaagcagtgtgtagagggaaatttataccactaaatgcccacaagagaaagcaggaaagatctaaaaatgacaccctaacatcacaattaaaagaactagagaagcaagagcaaacacattcagaagctagcagaaggcaagaaataaccaagatcagagaagaactgaaggagacagagacacaaaaaagtcttcaaaaaatcaatgaatccaggagctggttttttgaaaagatcaacaaaattgatagaccagtagcaagactaataaagaagaaaagagagaagaatcaaatagacgcaataaaaaatgataaaggggatatctccaccaatcccacagaaatacaaactaccatcagagaatactataaacacctctacgcaaataaactagaaaatctagaagaaatggataaattccttgacacatacactctcccaagactaaaccaggaagaagttgaatccctgaatagaccaataacaggctctgaaattgaggcaataattaatagcctaccaaccaaaaaaaatccaggaccagacggattcacagctgaattctaccagaggtacaaggaggagctggtaccattccttctgaaactattccaatcaatagaaaaagagggaatcctccctaactcattttatgaggccagcatcatcctgataccaaagccgggcagagacacaaccgaaaaagagaattttagaccaatatccctgatgaacatcagtgcaaaaatcctcaatactggcaaactgaatccagcagcacatcaaaaagcttatccaccatgatcaagtgggcttcatccctgggatgcaaggctggttcaacatatgcaaatcaataaacataatacagcatataaacagaaccaaagacaaaaaccacatgattatctcaacagatgcagaaaaggcctttgacaaaattcaacagccttcatgttaaaaactctcaataaattaggtattgatgggacatatctcaaaataataagagctattcatgacaaacccacagccaatatcatactgaatgggcaaaaactggaagcattccctttgaaaactggcacaaaacagggatgccccctctcaccactcctattcaacataatgttggaagttctggccagggcaatcaggcaagagaaagaaataaagggtatacaattaggaaaagaggaagtcaaatagtccctgtttgcagatgacatgattgtatatttagaaaaccccattgtcttagtccaaaatctccttaagctgataagcaacttcagcaaagtctcaggatacaaaatcaatgtgcaaaaatcacaagcattcttatacaccaatcacagacaaacagagagccaaatcatgagtgaactcccattcacaattgcctcaaaaagaataaaatacctaggaatccaacttacaaaggatgtgaaggacctcttcaaggagaactacaaaccactgctcgaggaaataaaagaggatataaacaaatggaagaacattccatgctcatggataggaagaatcaatatcgtgaaaatggccatactgcccaagataatttatagattccccatctataaatagggtaatgccctatttataggtaatgccatccccatcaagctaccaatgactttcttcacagaattggaaaaaactactttaaagttcatatggaaccaaaaaagagcccgcattgccaagacaatcctaagccaaaagaacagagctggaggcatcatgctacctgacttcaaactatactacaaggctacggtaaccaaaacagcatggtactggtaccaaaacagagatatagaccaatggaacagaacagagccctcagaaataacaccacacatctatgaccatctgatctttgacaaacctgacaaaaacaagaaatggggaaaggattccctctttaataaatggtgctgggaaaactggctagccatatgtagaaagctgaaactggatcccttccttacaccttatacaaaaattaattcaaggtggattaaagacttacatgttagacctaaaaccataaaaacccaagaagaaaacctaggcaataccattcaggacataggcatgggcaaggacttcatgtctaaaacaccaaaagcaatggcaacaaaagccaaaattgacaaatgggatctaattaagctaaagagcttctgcacagcaaaagaaactaccatcagagtgaacaggcaacctatagaatgggaggaaatttttgcaatctactcatctgacaaagggctaatatctaggatctacaaagaactcaaacaaatttacaagaataaaacaaacaaccccatcaaaaagtgggtgaaggatatgaacagacacttctcaaaagaagacatttatgcagccaacagacacatgaaaaaatgttcatcatcactggccatcagagaaatgcacatcaaaaccacagtgagataccatctctctccagttagaacggcgatcattaaaaagtcaggaaacaacagatgctggagaggatgtggagaaataggaacacttttacactgttggtgggactgcaaactagttcaaccattgtggaagacagtatggcgattcctcaaagatctagaactagaaataccatttgacccagccatcccattactgggtatatacccagaggattataaatcatgcttctataaaggcacttgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggaacatggatgaagctggaaaccaacattctcagaaaactatcgcaagaacaaaaaaccaaacaccgcatgttctcactcacaggtgggaactgaacaatgagaacacttggacatcatacaccggggcctgtcttggggttgggggaggggggagggaaagcattaggagatatacccaatgtaaatgacgagttaatgggtgcagcacaccaacatggcacatgtatacatatgtaatgaacctgcacattgtgcacatgtaccctagaacttaaagtataataaaaaaaaaaaaaagaaaaaaagaaagaagtcctctaaaaaaagaaaaaaagggtgtatgagggacttctaagaagaacatatatgatagtatgctagcaataggcaggtaaatcgaacagtaaaaatttcatattaaaaatccatcaacaatcaattaaaaacttcacaaatgattatccagcctgggcaagaacatctgagacagaaggctgagaaacaaatcttgttgcatatgaaaacctagtatctgacaaaaaaataccttttcaaatcagtggggaaaagacgaattataacgatgtagagacactaaatctgccagtgactcacgtctgtaatcctagcactttgggaggctaaggcgaaaggaccctttaagcccaggagttgaaaaccagactgagcaacatcgtgagaccctgtctctacaaaaaacagtaataaaaaaaaattaaccaggcatggtggcacatgcctgtagacccagctactcaggaggctgaggtgggaggactgcttgagcccgggatgtcaaggctgcattgagccatgactaagcccctgcatgccagcctgggcaacagagtgaggaccgtatcttaaaaaagacaagaaaaactaaagctggttccaaatttcatactttacatcaaaacaaatttacataattaaagatttaatgtgaaaaataaaatcataaatactagaagaaaatataggcaaaaatttaaataatcttagataagaagttctctttaagcataacaggaaacggaaaaagtctaatagatttaattaaagctatcaacaacatacaagcaaaacaacaaaaataaaatcttttcgatgttaaaaaatcataaaagatgaaagacaaataacaaaataggggaaatacgtatatcaagaaggataaatgattaacattttcataaaaatcaatagcaaaagaaagatcaacataaacatgggaaaataataaaaataggcatttcactccccatatagttggtaaaaagaaaaaaaaataaggaaagagtgactttactagtaatacatgaattgcaagcacaactaagttagcatttgtggagcatcagattggcaaaaattaaaatcagcagtgagggttgtcaaaagaaaactacctaatctattgcacaactttgcaacgtgtctgggaacatcaactttgcttaccttttggcccagcagtacactgttacggacttattttaaggctaaagtagtcaagtgcacagagttatgcagaccttctataataacgaaaaaggagtacacaatcttgaacacaaggagggtctggggcaagatttcagagcaagcagagtgaatgtgaatactaacttcaactaggagcagaagtcacacatgggagacaaaccaggggtgatgggaacgccacagcttgacacgcaggtaagtggcaagcagattgctcagtgcaaagtatccacatgttgtgtctgacacacagtggtaaaggtcttaggaaaatgtctgatgaacaaaaatgtacaaagtttaaactacacatcttagtttgggctgctataacaaaataccatagactgggtggcttaaacaatagaagttatttctcatagttctggaggctgggaagtgcaagaatccaggcaccagcagatccagtgtctgatgacggcctgcttccagtgtggagatggcagtttgcttgctgcatcctcacatggtagggtggggggagagagagcaagagcaagagacggggagagggagagagagagagagagagagaagacagagagagagagagcacagcaggagtgcacatgcttctcctgtctcttcttctaaggcactaatcccttcatgagggctctatcttcatatcctaaagatctcccaaaggtcccacctcctcacaccatcctattcattttcatttattgatttatgtgtgttttatccaggcaaataacacactttctctttctctcgtgtcccctaccacggcacttccagggagtgctctgcagtgaatgattgctcagcattgcgaaaagtctagttaccacctccaagaatatctcttttaggatgcagcttttccgaggcaagtgagtttgcattctctatctccaagatcatttaaaggagagggaaagaatttaggctctagggaaatggatgttatatctagaactaaagccatgatgacaggaaatttctactctgagcccaagttaagtttagtcctgatcctccacctcagctgcactcttcaggtaaaaaagggtccctatgattactatcatttccatgagcgtggcctctttaatggttcacagagaactgaatggccataccactgggagtcagctggaggagggtgggtgtgcatatgtttgtgtgtttcctcttctgattttagaaggaatacatgctcattagagaaaaaatggaatactgtgaaaaatataaaaaaggaaactcccacccttaatccacgtgtgtgatcaatatttgctaatgtttcaaagttttcttcagtctattttaaaaagacaaaatcacactatgtatactttcctatcagtttttccctaaacttatttatgaattctttctaaacatgaatgactgcatattatttcatatgggccatattaggctatgctatgttacaatgtgatcacatgaaccctaaaatctctgtgtttgctccttgagcatacaacatgtcatcacaggtcagtgggcccgtctcgcactatcagtatttaggaacccatgttctcaagacctccaccaactggaatgtcattgactgctgaaccaagggcaggagatgtggacaactgtatagtagctctcgaaggccacagcctaggaatgatacacatcacttctgctcacatttctttggtcatattaagtcacaaggccacaaataactgcaaggggcatgaaagtgcaattctaccatggggcagagataggagagctggattactagtgagcaggcctagtgacaaccacatgatgcgcactagtttatctagccattccttgaatgctggattctttccaatgtttttgtacatgttatgatgatcagttcaccaagctttattggatttctatttattcctttagaacaaattcttaaatgttacattattggcttaagggatatgtaaactcttcaggttcttggtccctccttttaaacaaatttatccttttatgaacaaatataaaattatctatctcagtggagcaatcctcctacctcagcctcccaagtagctgggactacaggcatgcagcaacatgcccagctaagtttattttttgtagagacatggtctcgtcatgttgcccaggctggtcttgaactcctgggctcaagcaatctgcccaccttgccttcccaaagtgctgggattacaggtgtgagccattgcacctggccaatgttgggatttttaaaaaattgttcttctgttgtcattgttttatttgtatgagctctttatgcagcaaaacgtaaaccatatgtcacagatgttataatttaaaaaaaccagtttgtttgccagtacattttattcatcatgttttatgagagaagttcaaatctactactctttgcatttgtgatttcttccatttctattacatttaccaaccttctctaaatgaaaaagagctatctgtctatagaagccttttttaatggcttatgtttttccatttaaatgtttactctatctggaatttacttcatgacagtaaaatagagtaacagaaagagctccagtccaaatgtcaggcaatgtgtgtactaattctgcccggaacaccttaggtaaatgccttagtcctcagtctattctggccccatagcattactccaaagtttggaaagctacgcaaagcttcttagcttcagcacaaaactgaacggtcatcctggcctctgcattacccagagtatcaggtacaaataaagagaaagaaatactgtacttctatttggcaagctaacataaaaacagatctcactttccatgcccttcttgttgaccctcagtttctcccacctgccgggtttggggctttcctcatcctacgccctcgtgctctgctgggaattcccaccctcccctctacccgcactagcagttccactgcgatcagtcttgagacctttaaccctgtggatacccatgactatggcagcactgctctcctggctgttctctgtatccactttctgccctcttctttttcctcccttttcttctgctgagctttctaaaatccagtcatcagcaaaaccacctgtattttcctctgccttctttgaaggttcctttcacctttttattctaaaagaaacccaggtctctgctaagaaccatacttcccttgcaactttttcatgacacggctggtttctcgccaaatcctgcatatgactgggtctgaaggcaagtaggtgttggctctggttttcactgccagttccttctccttcagaacactccaactctgattttgctgacagtggaccataatcctctttacccttcactactgcagtcactagcagaagcgtccgtccttctcactcactccttgaagatttcttacttctgttttacttcactctcaccaatcctactcctgttagaattctgatgacagcaatgcccccaaagctaatctttcaaatgttctgtgtggcagaaagaataatgccctctcctccaaagatgtccacatcctatccctagaacctgtgaatgtcaccttatttgggaaaaaaatggactttgcagatgtgattaagctaaagatcctgaggtgagaaggttatcctgaattatctgagtacgccctagtcagaaccacaagggtccttataaaagaaaagcaagaagtagaaggagggggaggcaatgtgatgagggaagcagagaatgcagcctgtggcccggagccagggcacaccatctgcctcatggagtggggagaggcagggactggatgctcttaggggcctctggaagaagtcagccctgctgacatcttcattcagcccattaacactcactgtggtcttctccagaattctaagaaaacacatttttgctatattaagccaccaagtttgtggtaatttgttacagcaacaataggcaactaatactctggcctctcgactccttgaccttctcttctttagtgatgatgttcttggccctaactcagcctctcactccatggttacaatctaggccttgccattactgtaactggaaccccttcataatatccactccaagcattcctttgctcaacaatcacaccctgtcttttcagctaactctctagtaccctatctccaatcccactgggacctcacaatccacttccaaatgttcaccaggccagagctccctcatgtgctcactgtcctctgccttgttaaatcccacagtcagttgtcacagttgctctgaataaccctcaggtccatggcctgctcttggactatactctacattcacttggcaaaaccacagccctggtgaaagctaggcaccgagtatggccaggaaaagcacacaaccatccccacagctctcttttcaaaccagtggcactaaccccacttgggcccttaacgtggcctgcaatcataactcacatctccactctgccatctctcccactctcctttatacctgctcctctctcctcaaatgccagcagcactgccccatttgcatgctcagctggtgccctgcttccgattgactgagcaaagccccggaagaggacttccacaacaccatctacccactgcttgcatctttgttcacacaccctaaagacggttaggctgtgctctcgggctctacgggctaacccctccacccgtacaaaaatcccttccccttgtctattctcccctgcatcactggcttttcagtcttaatagatctttcccattcacttacacatattattcacctcgttaaaaatccaaatgaaatcagtcagtcaagcaaaaaaacaaaaacaacctccctttatctgtacatctcctccaagttcaatttttcttctcttgcaggaaaacaccagaagtgcctctactcactgcctccaattcttctctctcactttacttgatacccactccatttagcctttgtcccaccaaccactcaactgataatgttcttatccaagtcaataacgaccttcaccttgctaaatccaatagttgttgctcagttctcagctcttctaccctaaaggtaccatttgatacaatcactcactcactctgccttgaaacattttcttcagttggttccaagacattaccctctttttcctcctgcctcattggtgtctccctctcaattcacctttttttttggttcctcctcactgtccccgcctctaaatgttggaatgccccaaggctcatcttttagacagattgttcccatttatacttactcttggggttgatctcacccagttccttggctttttgatacaatctgtgtggggatgactccaaatgggtatcaccagcacagaccagtcctctgaacttgtacatccaactacctatttgacatcttttctggtttgtttagtagacgtcttaaacttagtatttcctgatcttctgctctcccttaagacctacatttcccatagtcttcatagtcttctccatctttattttttgaggcagggtcttgcccaggctagaatgcactggtgcaatcacagctcattgccttgactggactcaagtgatcctcccacctcagcttcccaagtagctgggactacaggtgcgtgccaccatgcccagataattttttagtctacattgcccaggctggtcttgaatgcctgggctcaagcgatcctctcatcttggcctcccaaagtgctaggattacaggtgtgagccacgatgtctggccgtcttctccatcttaatggcaatgccatcctttgggtgctcagatcaaaacccttgcagtaattttcaactcacttctttctcttacattccacattccatctgtcagtcctctgtttgaaaccctcctatttcatccagattagagaaaacttacacaaagaggacattcaagtggcctctgaacatatgaagaagcacccagtatgagtgggtgtcatgagacaagtgcaaattaaaaccacagtgagatcattctccatgctccagaatggctgaagtaaaaaggattgattacatccttttaattataactggagaggatgaagcaaatatccaaatattgctggttggaatgtaactcatgatgatcactttgaaaaactggcgatagcaaaataaaactaaacaaaagtgttccccatttcactcagctaaaatgaatgtttatgtccaccaaaaaccacatacaggagtattcataggaactttattcataaaagccccaaactggaaataactcaaatgtccatcagtagtggaacagataaataagttgtggcatactggaaaagaaaataccacaaagcaatgaaaaggaacagattactaaaacatgcaacaagacagtggatctcacagacatgttgtataaaagtcattagacacaaaagaggatttctgtatgatgccacctacatgaaggtcaaaacaggcaaaactagtggttaactttaaagggggtcgcaagagccttctggataactgcagatgtatatattttgatctgggtggtggttccacaggcaaacatatttccagaagttcatggagctataaattaagatttgtgtactttatgtacattatatctcaataaaaatgtaaaaacatttctcagtaaatatttattgggtacatactactaactgttcagggccctgggaaaacaataaacaaatcagaaatgagccatgctgttctttgaggttcactccagttgggaagatagaaatgaatcaaatggcatcaatacattataaactgagatgacccatcttaagggaaggaccccagccctgggagactgtaacagaggctggccaggtctggagaaatgatggttcaagcagaaggcaaagggagcagaaagagagcactccaggcagcagaaacaagtgccaagactccagtgccaaaggaagcaggctgtgtcctgctggaggaagcttgggtgaccagaccacgcaggaacttgcaagtgggcaaaggactctggcctttagcttaagatcaatggaagccattgagggttttaagggaagggacgtcacactcaaatctgtatttagaaaagacctcactaatgttgtgtggatttgagagttgtatagcagatacttcctaggacgctcattaggggaagactgtgagtccagtctagagctgctctatccatgagaaaaggcaagaagaatattaagaggaggaagtgactgagaactgcagattttatgtctttaaatttatgttgaaccgaggtaattcatcttcaaatcagtgtgatatagtaccccaggctgcctccagagaaagggacctgaggaggagggagactgtattgtaaagcttttgacaccctgtgattttttaatcatgcatatgtattacttactcaacataaaattaaaattaaaaattaacaacactcaactggagccttcctcatattgctaacgctgccttaactccctgttggtgataaggcataaaggtaaagaggcatcacaatggtccctgtgtccggctctcattccttgtgagtaaaaacgggacttacctcagaaaattaccagagaaaacgcttcctgaaatagaaacagcctaaatctaaaagacacatgtgcatcatttaagatacaaaagtttacctggtaaagaaataacttctactaatagcctggatttttagttccttatatctagcttgtcaaattgcaggccgagaagaaaaaaagggcagcattattcatgaaaaccaagacaaaaatgaaagttggtgatttggctcaaaggaccatattaaaaaaacaaccgggtagtcataatttcctcatgttttaaatcactgaaatctagagttgcagctgtcccacaaactgaaaccatataaatttttagaaaatgagtcaatcatgagattaaagtttcaatttataacacttctgtgttttagttacaaagtcataaataaacctagcatgacacagaaagtaaatattttttcagttgtttatgcaggcaaagaggaaagaaatttaacatgcaattaaccacttaggtgtttctagatatgcaccatatggtctttcttcgtatttaagataaaaacaaaaataaatattgttttctttaacctgatgtttgcttagcaacatcaaatattccaagctagctcagcccaggcactaacttcacctcatggaagagactttccatttgcaggagagctggggcataagaataggaggaaacttcttccccagggcgaagaaaaaaaaaaagaataggaggaataagcatttttaccaaatagtttaaattgaatactctggagagagagcagtaaatatttaacccgcctggggctccagtcctattgtttaatagacaatatatttgtttatacatttaaaaacagacccttatgccattctttcaaccaacatctgaacaagtgtgggataaaaatagccaaggtccaaagcaaccctaagatttctgtataaggactccccatatgatcacggttacttacctgtcttagtttaaaaataactaatgggaacaatctgattgacattttaatctagatgacagaaatcacttaatggataattattttcttatcttcatgtcttatcaactattctaaaattaacgcttttaaggtaaaatcattatatacttgatgctacatgaggtcaatacgtggtgctacacttttatattaacaactgaaataaagttgtaaagtcacccatgaacagctttaagatatacagttaaaattaaaaacacaaaaacatttgagaagctgaggtaggaggaccacttgaggccaggagtttaagactagcctgtgaaacatagtgaaacctcatctctaccaaaaaaaaaaaaaaagctgggagtggggtgtggtgatgagcgcctgtagtcctagctacctgggaaaccgagacaggagggtcagttgagccttgaggttaaggctgcaatgagccataatcatgccaatgcactccagcctaagtgatggagcaagaccctgtcatacatatacacacacaattgttaatatgcttgagtgtttaaatgtcacctatcttcatatattatatatatatgtgtgtgtgtatatgtatatacatgtatgctctatatatcgaacaaagaagctcttaaaaattgactatcggcaggatgcagtgagtcacgcctgtaattccagcactttgggaggccgaggtgggcggataacttgaggccaggagttcaagaccagcctggccaatatggcgaaaccacatctctaccaaaaatacaaaaattatcagggcggtggtgcatgcctgtaatcccagctactggggaggctgaggcatgagaattgcttgaaccggggaggcagaggttgcagtaagctggcatcgttccactgcactacagctttggcaacagagcgagactccatctcaaaaaaaaaccaaacaaacaaaaattgactatcaagggaatgagagaacaggaaagaaaagaaactctagtagtaataatatattaaagcattaacaccaaaattgtgcataacaatgccattttctcatggtaggttttaaatttttcttctttttgggactactaaaaaaaaaaaacaaaaaaactccacgtagtaaatgtaacagtactctcaaaatctctctgcactcttccattatattgatttcatctccctattctcatctttccacatggttaagaggcatgtttgaaagttaatccggatgagcacactatgtaaacaacagggttcaccactagctgcactccatctccaagctggtacagtggttactttcctttgcatacataatcatggtaacagcagtgtcagcttaagaatcttctctagaaatcaagcaatcttaacatgggaagccctcaaattacacataagttatatgctaaaagttcattcactattctgttacttgggaactcacaacacacatccaaaacaaatgttctataagtgatgtttcaagccactatacagccaatgtaaccctaaaataatagaaaggagcagagcattatattgttgtgattatagcagtagaaactgaaaagaaaatgttaaaaattttgggttttgctggtacttgagaaaaggctgttccaatgagaacatcatgccaaccacactggctgacccagtctgtgccctttgacggacacacctctgggtaatctcctcaatttcccctcatcctacacagcaaactctccctgttccctgctgccccttcccacagttagtaccttcactagactaatgactcccaaatctacagagctcccaccttgctctgtctcctgggctgtggacccactggcccaacactgttcatctccacttggatattctacagtcacatcaaatgaaattcatcacccatgcactcctcactgcatgaagcagctaccacccctcctgtactctgtttctgaacgtcatccccacccccacagatggctcattttattaaaacagtgggtgtcattcccactccttctcttttatcaccacctcccaaactagcaagcaccaaacacccaggtctgtctgctggctgccgtgaacctctaaagcactcctctattctgcctggtcatcttgtttctttagcctccaggaaagcttgctgatgcacaacaaataggtgtaggttgccacatcatcaagagtgaggaagaatgcaagagccctacaaaaacacaaaaggtacctttttctcattaatgtttcagggaaggagcctccctctggaaattaaaaacgaggatcccaatatagcctcggtattagttgtatacgcatcagaatgtctcaatcttttcatcttttatgctcagtctctctgctcacaactcaaagcaatttgataggcttgagaactattttgcttaataacgagatgtctgacaggacagccagatataatgatgaattggttagcaaatacacatctaaaaggctatttcgaatacaggctccatgagagcaaggattctggtctactttatttactgttacatccattgcttagaccatgtggtagcacgtagtaggcacttaataaaaagataacacatacatatacattatatcaattattaaaaatttgtagttatcacaatataaatacaaaaagcaaattattgtacaactattttaattgggatttgaaatagttttctttatgctaaaaaacaaaagtgtgtttgctctttggagtgtctgactaaattcagcacaatttttggcagtttttttctaaaaacagtttgttacacatagaaaattatacttaatatgaaatatatatcacttctacataattagacttaatagaaattagtctgaatagaaaccagtctccagtagcagcaacctttctcaactaatacaccttgagtatactgcagcaaatcaggtatatctgattatgtccccaataagtctgcagcacacacctactcaaaaagatggacaggtaaccaatgtttatagattatataaatcccccgatatagtctagatatgtgtcttggcccaaatctcatgtcaaattgtaatccacaacattggagatagggcctggtaggaggggattggatcattggggtggattctcatggtttaacactatccccgttggtgctgttgacacaatagtgatttcttgtaagatcgggttgtttaaaagtatgtggcacctaccctctctctctcttgctcctgctgccatcatgtaagacaccactctccccctttgccttctgccatgagtgtaaacttcctgaggccttcccagaagctgagcagatgccagtgttatgcttcctgtacagcctgcaaaaaccacgagccaattaaacctcttttccgtataaattacccagtctcaggtatttatttgtagcaacgtgagaatggattaatacatataatacatccctcatcccctctctagggtaaattagaataatttttttggtttttttttttttttttttttttgacagagtcttgctctgtcgcccaagctggggtgcagtggtgtgatttcggctcactgcaactgccacctcccaggttcaaacgattctcctgcctcagcctccccagtagctgagactacaggcatgtaccaccacgcgcagctgattttttttttttgtattttagtagagacagggtttcaccatgttgcccaggctggtttcgaactcctaagctcaggcaatccgcccacctcggcctcccaaagtgctaggattacaggcatgagccaccacacccaggcaaattagagtaatttttttgtttttgtttttgttttgggacggagtctcactctgtcgcccaggctggagtgcagtggtgcgatgtgggctcactgcaagctccgccttctgggtcacgccattcttctgcctcagcctcccaagtagctggggctacatgcgcccgccaccacgcctggctaattttttgtatttttagtagagatggggtttcaccgtgttagccaggatggcctggatctcctgacctcatggtccgcccgcctcggcctcccaaagtgctgggattacaggcatgagccactgcgcccggcctaggataatttttaactaatgctaacacggtgtcactataatatgccagtttgttgctggatgcaaaaataaaaccctaaacgtggagtgaatcctattcacaagaaacatgtcttcttttcatattctttgttggtgtttgttctaacgagaaggaccaaatatcaacatatccttcagtcccagtaactgctttcctaaaataactttttcattctagctttgaacaacttttatgccatcaagatggtgaattttaaattgtgagttgtgaagaaagacaattttcttagacgtattattatattttcatgtaaatacttagagtgctcagaactttcttattctgttttcaatttgaggtcactaaagggcaaaaaggagtctcactggtggcaagatttattcagagaacactgtcactctgagaacagctgtgctggagacacagcctcaccacccaaacccacaagcctaccaaattaggtcaaaacactaaaatacaactgcttaacagatcttcaaaacctagagtcagctgttcatgttttgtacttgaaaaatacacattagaacagagtcagaggatcaaaggctagaagtttcatcccagagctttctggacacgactgtatctcaactgtgtcagagaggagggtgaaaatgtaaaattacaaacctagaatgctacaaaaataaaaatattacattttctatttcctgaattaaaaataggagagatacacaatcgcttagggaaaatattctgagaagagacagtcatgaatataaaaaacacaacaacacaacactgttctctaaatggaagagaagtggtaacagcagaaggtgagcctgttggtatatgttgtactattgccctctattcacaaatgagtagaaaattttggatttccagcatcaaactactgttagatggaatagcaagtaagtacaaattagcctatattttatacagagtgactcagcatgcacacaaatatcaataaattgccgacactagaaggctatttattgacttgtaaagaaagcatcattatttaatatggaatatctgtggagctgcccctattaaatagttacagtcatgtaaatgcaattttccaaagtatgacctacataaagctagtgcctagaaattatccatgaagacttccagggttaatacatttgaggatagagactcataatgtttgttagcatattacagactccaagcggttcctcagtagagaagccagctcaatgttgtttaaaccagtattgctcaaagataactagtgcgacactttattcccaagatgagttattaatgcacttaaagaattgctaatatagacatatgcaaaatcactgtctaaaagtttgtaccagattatgtacctaaatttgtatcaactccataagcattataaagactcttcgttgcttatattttccttttctcattgtttaatttgggggaataaaaggattcatttcagagaaacaatttctggagacaagtttacagggggaacactgtcactctttggcccgcatgggaaggcgctacaaagtcatcttctatccgatatggaagttgaaagccttgcagttgtcccattcccgtggatcttgctcatcatcccaacccatatatccagtcacccccactgcactgattatgccttctgcactgttctcaggtctgtttcaatcttccactccccacagtcagtgtcctagtttgagccaccagcagctttgccaaggtccattcttggcataccccataccttgtagcccagatcaccttttaatccttggaagtgttttctatctaccaagactatatgtctactattagtagaaagaatgacaaagtcatcaaccatgtacccaccaatcagtttaagaaaatatttctaagactcctgtgaatccactcctatgaattctgtgcttataattccctcacttttctttatagtctaatcacatatgtatttatctgacaatgtactgcttagttttgcatcactctgaactttatataaatgtactagtttgattcatctggtattcatttatttcactttaccttatgcttgttaggctcatcaactggggccctcaatttccatagctgaacagtattccagctgtatgaacaaattgtttatccatttctctgatgacaatcacttgggttcttcccggaatcctccccctcaccttttttttaactacttacaacaagtgctgttataaaccctcctattttttcatgcctggtacagaaaagtatacctggtagagaaagtaaaacatttttttttctaggttatattaggaattgaattgctgggtcatagggcagtccatattcagatttcacagatctgttctgcaaagtggttataccaatttgctctcctacctgcagtgtataagagttcctgtgactccacatccttgccaacatctgatactgtcaattgttttattttttgccaaaccagtgatagtaaaatattttaggagtattgtaatgtggttttaatgtgcattccctgattaatatttaagttattttacgtcattttttgcatatccatgtcttttgtttattcaaagtaatttaaaaatataaccttttccaatggccgggcatggtggctcacacctgtaatcctagcactttgggaggtggaagcaggcagatcatttgaggtcaggagttcaagaccagcctggccaacatggtgaaaccctgtctccactaaaaaattaggcaggtatggtggcaggtgcctgtaatcccagctactcaggaggctgaggtgagagaatcgcttgaacccaggaggcaaaggttgcagtgagccgagactgcaccactgcactccagcctgagcaatagagtgagactccatctgaaggcagggggggaagtcagttttatgctatgtggtatttaactttaaatatcattgaatttgtcagtcttttgctttatgtttaatggctttccattgtatctagaagatccccaacttaaagattttttaactttaagatttttcaactccacagtggtgtgaaagcaatatgcattcaatagaaactgtactttgggtgcctgacaaccattttgtttttcactttcagtgcagtattcaataaattacatgagatattcaacactttattatgaaatagactttgtgttagatgagtttgcccaactgtaggctaacataagcattctgagcacatttaaggtaggctaggctaagctatgacattcagcagtgtaggggtattaaatgtatttttgacttatgatagtttcaacttacaatgggttattgggacttgaccgcatcataagttgagaagcatctgtataaaatataagatactcagagtgggtataaaaaacactatcatggccaggcgcggtggctcatgcctgtaatcctcagccttgggaggccaagacaggtggattatctgaggttgggagttcgagaccagcctggccaacatggtgaaaccccgtctctactaaaaaaacaaaagttagccaggagtggtggcgcacacctgtaatcccagctactcaggaggctgaggaaggagaattgcttgaacccaggaggcagaggttgcagtgagccaatactgcgccactgcactccagactaggagtcaaagcaagactccatctcaaaacaacaacaacaacaacaacaacaaaaacactatcaaaaagaaaaaattcttttgtattatcttctaaaatttaaagctttacttttcacatctcggtctttaactctattttttgtgtgcagtgtgatacagggctgcatttttttttccatatagagatcaatcactacaacaccactttaaaaaattgttccttcttcatccaataatctacagtgtcactcaacctatatttgagagtctattaatttgctgagtctgccgttgggctcttgctcctgtttcactgatatctgtgcatccctacaccagtgttagactgtcttaattcctacagctttatttgaattcaagttggtggtcaagtccaccaacttgatgtcgggaatgttataggcttgatgaatgcattgacaaacaaatgaagaaatgcagaagtttctaagtaggaagagtaggctatctgtacaaatctaaacaaactctcagacacttttttttaaaggcaagccttaaaataatgtctttttttctctaaacatagctatgcttcttttaaagacctcttaaaacaatttacacaaagagcaagtgatggctactgaacgtgaattgtggagctaatcccagtaaagagatacatctttctattttctcaaaaggaattaggacaaggcacacggacttagcatcacccttcctttcaaattaaaagtgatttatggattgttgattcagaatttggttgccactaatacttcatatttgtatgttaaatgattacagagaagaaatctggatggtaaggaagttttcttttaaaaagagacataattactttattattagacctacgataaaaaagggcagaaggcaagcaactcagtcaaactgaagttttgtagctttggcaagcatcccagttctcctaatgttagtcttcctaggactttactacttactggtcatgaagtttaactcatattcacaaagaagaatataagatgagaacaaaaacatacaagcccaaaagcaggtgaatcaggcaatgctctgtgaactggaaaatgctagtaaaatctaggcaattgttattatttattccatgaataaatagttagattattcttatcactataaattttcactaacacagataatcaagagcttggcagtagaaagtattagaatagtaaattacatgtaagattaaaaaattagttagtatgactgacattatatacctgtagcagataattaaggttctaagccaatcgaaaactaatgacaagaggtattatgaagataaaatatcctgttgcttcacttgtctggtaaatacgatctcttcccatgcatatttgagcattaggacctgaagatttagtggacaattgtagtttattgattaacttaatctcttagcacaacatattctgctatccaatcttagagcaaataaaaccacttgacatttattctgctttttatagtttacaaaacactttcaagttagctctccttctgttagaccaactaggctagaaggacatcgacctgaacctaccggtagttatcaaaccattcagtctggggggattgccagagaatgaaaggaacccagaaaaacaccgagctgagaggcagaaagagagagaaacatttctaacgacattgtgggagacctaaatccaacttacttgaaacacccctatacccctgcacctttcagttacaagactcaataaattcccttttctgtttaagtccgtgtgaaccacgtttctatcacttgcagctgagaaaggcctgggtaacattaagtcagtcacattgctaactgcaccaagaatcacactgttaattgcactaggagtcacggtgctcaactgctccttacacgagcctttgagtgatgaaaaaagcctgtttgttttgaacccccatacaatcacttaactacctagatgatctcagacaggacatataatgtgtctgtgcctccaaatgagccccaaatacaaggatataatttaatttataaggttattttgagagctaaattagagatcttttcccaaaggaattagatagagtctggcgcctagaatccaataaatggtaacattactcctgctctctctcctgacatggtactcaacaagataagatatgtaaagcatctattataattcctggtacaatgtaagatactcaatacatgttaattctctttgcaatgaaaatgattcaggactggtaatcacattcatcttacatcactatttttcacattgtagaaaaataactaaaaagaagaatatagaccaactccaatggcctttttaacccccacatttccaaaaaggtacaaaaacactgttagagggaggaaaataagaacatataaatgggtagttggaaatattaaatgaaccaggcaatttccagcatttgagccatgtgaagcctcaacataaatgtagggatttcaagttctccaaaggggaagataatcacaagctacagaagtaatagcagaaccactcaatacacaaaacagaagccaaatgctggactcacagtatttggaacatatggtaggccatagaatttctcttgtgtttccttgagaatgtctgtggttgaattcctcaggggatgcttcccatggtagatttgatccagagtggcataaaagacctagatagataaaaacatctacttagttttggtcgtccatcctcacatcaagatgtggttgaccaaagatgctataagtgcaccagaacaacagttaccaatcacagttgaaaacagtcacaaaaataaacttacatggtttgaaatgtatttcataccacatttaagaccatgctaaagattaaaaggaatgctctcaaccttttcataaataagaatattaaagaattttgaaccatacccataagatactctttatgtacaatggcagcaaatcaaatatgtgacacaaaactggaattttgccaaaatatatgtagacggaaggccaggcgcggtggctcacgcctgtaatcccagcactttgggaggccgaggcgggaggatcacgaggtcaggagatcaagaccatcctggctaacatagtgaaatcccgtttctactaaaaatacaaaaaaattagacaggcgtggtggcaggcacctctagtcccagctactcgggaggctgaggcaggagaatggcgtgaacctgggaggcggagctcgcagtgagccgagattgctccactgcactccagcctgggagagactccgtctcaaaaaaaaaaaccaaacaaaaaacaacaacaacaacaaaaaaatctatatctatctatctatctatctatctatctatctatctatctatctatctgtaggcagaaatatacaaaaccagttacaactttagacccgctggatctaacaaatgttgtttggtttcctcctggaatcctgatatatcttaaatgagagaaatgaaacggtcagaattctagttttgtgataaaaggtgaaagaaaattaaataggtgtggtgggggtagagaaagaaatagcaatgcagcatctcgtgagtatagatgtatcgaagaattctgatgcagctgttggagaggttggaactagactcccacacctggtgtcaggaagtacaaaggaagcagctgctgtatagggagggctcaactagatgaccaggggaaaaggagcactctcctctgagtagaggatataggccactgaaacacagtgggagaagaaagcattaaagaaagtttggacatgaaatctgctgtttacaaagtactgaaaactaaattttgcaaagaaatctaaaataaacataaagcattttttcactgcaacatctgactcaaatattgtttttcaacactgacttgaacatttgacttcatgcaggcaagtagaaaatgctttattttaaaggacaaattttgacacgcaattatgcttctgatatgtatctttgtgattcagaaatgggatttgtagagaatgtgcagctgttgacttgaaagaagtgaggattagtttggttaaaagagaaaatttaaatgacctctggcttctggctgcatctagatatagaattatggttctaaattataaagttaagtttaaaccttccctagaaaaatacagacatttcctaaatataaatattgctttcttctaactggtaatctaaacatatagctaaatatagctctttcaattctacattttataatgagtaacgatgcataaagataatcagggaggccaaaattactcaatgtcttacctatattctaacagagtaaattatcaggaactgaaactcttacattctaacctcaactgaggtgttattttgccccaatgtataaataaatcagaattcaagagtttcatttcttcaattatgccttttacaaaatgatataaacatggggtaacttttttgaattataaaaacagagcaaaataaattaaatatgaaaacagagcaaaataaattaaatgtgcattctttttatgcttatttgctgataaactaaacaattccaaagacatgagcctatctgcctacccagggagtcatgcattcctggggccaagaaacttattaagtcacagaaaaatgaagagcctatttttaaaacaataattttaaaaaatgtacagttttaaaaacagtgttttttttttgttttttttttgagacagagtctcgccctgtcgcccaggctggagtgcagtggcgcgatctcggctcactgcaagctccgcctcccgggttcacgccattctcctgcctcagcctcccgagtagctgggactataggcgcctgccaccacgcctggctaatttttttgtatttttagtagagttggggtttcactgtgttagccaggatggtctcgatctcctgatctcgtgatccgcccgcctcggcctcccaacgtgctgggattataagtgtgagccaccgcatctggccttaaaaacactgtttatgtccccatagaaagttgaaacaattcacttcctttccacccgtgttcatctccactgtccaagtgtaatataaaagctgaacccaggcagctcctctaccaggactttgcctctctctgtctctagggggctattgtttttggagggcggaggagggaaaggttggttttccattttaaaagaaaattatcagaacactttttcaagaagaaagccacaaaacagacttttaaaagccaggccttctactaaagatatcagcaaatcaagacttttgccaagtaatgttaatttttaaaaataactcagaaatcctttaaaaattatattgatatgaatagatactgagtaaggtaaagcaaatatagattcacggttttgtctatataatagatttccttcactgaaacatgtatttcatgtttgaaggtacagaaaaacagagcacatttattaccttctagggactgaattttacaaaactataaagcaattaaatagtgattactttgttaaacaggtaactgaatcatcataaagtgaatactgcctaagatgaaagatgggtgtttaaggtgtttacataactctcaagatctgaagaggagtgagaattccataacaatctcagtcattacaaacatctacgcatctgatgtcatgcagacctggcatccagatggttcatgaaagttttctggtcttcatctcaaaacctgggaagttggttttgaatattatctaaaactaacagcaattactatctaaacttcaaacctaaaaacacaaaaattttaaaaagatacaaaatgaataaacatatgtatatataaaattaagtttgagccttaatttagctggcaaaatgtgtgatttagaagttgtgtaaattttctaagctttcattttttcccaactgaaaacgggaaatagtctttttttttttttgagacagagtctcactctgttgcccaggctggagtcagtggcaagatctcggctcacttcaacctccacctcccaggttcaagcgattctcctgcctcagcctcctgagtagctgggattataagcatgcaccaccatgcctggctaatttttgtatttttagtagagatggggtttcaccgtgttggttaagctggtctcaaactcctgacctcgtgattcgcccacctcggcctcccaaagtgctgggattacaggtgtgagccactgtgcctggccaggaaataattttattcaacgcctacttcataagggcagtgtgaggactaaatgagtcaattttggtcaagttctttgaactcagatgaaagatgttttagaagcataattattataataaataggtatcattggcaagaatgtaaagttatatatttatttgggataatgactccggaaaacttcagaacaaaggtacatacatacctgaagttgcatatcagctgcagcacaaacctttttagattcacaaagacgagacaccatattttttggcagtggcttgataaaacaaaagaatatatatgtgagtaaactgcgtaataagtcactgcactatgtataagccaggaaatttaaaaataacatcaaatgtaacatgagtaatagaatttcattatagtttaaaaataataactttaaatattttagttggcaagacaacatgaataaagacattctgtttaatttcaaaaagtggtaattgtcaaataagggtttgtacatgaaaatacaggattacgtggaactaagacactggcgccgatctttaaaaatctatttaaaacctcaaagggaatactttttctgttcctttgctattagtgagtgcctgttcaaatactctcttgacttttaagtgcatataatcactgacaataggactaaaagatgaaaatgtcaagaaataaatggtaattcacagtgtccgccagtgttaaagctaaactgacatcctaacaaatagtcataataatgtattgcagattattttcttttcgaatctgaaagaactgtagagcttggacacttagtttaatgtccctatgtgatttaaggctttctttttgagatgaattaggcctaaccctataacatacagatcctcttagaaataaattaataatgtagttgaacaagaactttcctcaatcttactctactttaaaatcattaatactgatgtttattaaagaaagataccgatttacaacctaattaagctaaaagcccctctaaagagaaacacattatataaagaccaatggcaagttactcagtggtatggtcgtataaattaaccacctgtgaatgagaacgtgggctgtctgctggaagcggaaactagccactgctttgtaggagtctactcggcagacactcaggaaagatttgtgaaggaatgaactaatagaagaactgctaggaaacggcttcttaagtgaaagacatagaatctgctgactgctcagatgacaaacctacagccttttctctttccatttggcagcaagagaagtaaactaggcagaaaagacaatatttttaaagagctaagacacagatgggagaaagctacatagtgtgaattctggtacaggtcacaggcctggggctttctgacaccaggggcgctcatcttgtatgaaagaaatacttcctcaaacaggatttttaacagtcaagatttatttaagtcatatctgccaacagattgtgtcaaaatgttcacgtttctttaaaccttactttatatcatattttatattgttgacaggattcatgctacatttaaaagatttttcatgcttcaccaagttttaataatttttacaaaaaaagtatatgtggaagaatgacactgaaaccacctttgcagaattgtaagtaataagaagagaaatctaacatgactgactccatcctgcttctaacctctcaggctacattgtctttagcttattctagtgcagaggccaagataactataagaaaaatttggtttatagttaaactttgaggctagaaaacctgaccttcctgcttgtttggggactgaagccacattcctgaggctggatttgaattatggtaggggcctggactttgctaaacaatagatacacttaaacaatcacctgccactgctaagcttgcttttctataagttgctcactaccagagtcacatagccagaggctataagacttgtaacttccccagctactcctgtaaataacatgattattgtggaacctaaagaactggtctttgagatatttttcagatttagcatttcaacaaaccaagagatgctacccggtcctgagacccacctcccaaccagaaacagactcagctgtgcagtttagacactcctgtgatttcatccacagcttatcaactgtttcagttccccaggcccctgcctgacaaagtatctttaaaaactctagcctccaagttctcagggaggtggatttgagaaacgccttctgttttccacttagctggccctgctatgattaaactgtttgttgcaacatttgctgttctcggtgcattagcttttctgggcagtgggcaagaagaacccattgagctgtgacaatattttctcatttaactaacacatatgaagaccatgtaagcaagcactgcattaggcacaaggggcacaaacagtgggcaacagcaggtgtctgcccccaaaacttctcagctagcattctccacgtaagcaccaattccacagttactaactgtaacgcgtgcagggaagaaaaggcccgtaggggacggtatgtgagctgtgaccctgaaaggcttgatggatgtaggagtgagatttgccaaatgaataggtgttaactagacaagagaaggatggatgggaaggggaaagaagcatttcaggcagaagaaacagcacatgcaaagggcaggaaagaacagggctgttggcagaaggtggaagccagcagaggacaggaaaggaggtccccattggagaagccgggaagctgagccacgctgggtcccatctccaccctgagaaataaaaaaaaaattctgagcccctaactgactgaacagaccccctgttggccaaagggaccccagagaaactctggaaacttgagttccagaccatgacgggatgggcagttggtcgtgcctcactctccccgtccctcgctcactgccattaggctttcttccctaccagcaaaccagacactgcctctaaaaaaagaaaatacgtatttagaaaaaaacaaaaaatgctaccactggagaaaactgggtgaaggggacataggacctctctgcatttttgtttttgcaactttctgtgaatttataactatttcaaaataaaaagttaagtacccaattatctattcaatgtctactatacattgtaatacaaaaaacattcacttgtaaagaaacacataagtagagaataagtacaatcctagtagaatagtgcagaggacagaatcattaactcatcaaatcacaaataaaaaatacacatattgtgtgtgctatacatagaaaagtaaatgttctttttaaaaaaactagtttgattgttagtcaactggaattaataagtgtattaattgaaatgaagttatatgcttattctcttagaaaatacttgctttttaaaacataacaaatttgaaaaaaaaacttaaataccatacaaactgattttcttttaaagttgtatctaaagttattttttaaaaataaacaacgtttcaaaattaaaactgaaatttaaaaatgtttcctggtcaagattttcttctgtaaatattgctttgccaatcgcggccatgataaccaatattgaactacagtgttccctggtatacatgggggaactggttccgggacctcctaaggataccaagatctgtagatgtgcaagtccctgctgtgaaatgatacggtatttgcatataacctatgcacatcctcctgtatatttgaaatcacctcgtgtgtaaatagttgttatagtgtatgttttagaaaataatgacaagaaaaaaagtctgtacatgttcagtaccgacacaaccatccatttttcttccccaaatatatatacatataaatacgtatttatgtatatctataaaaaaatataaaatatacctatctctctcataaataggctttcactgtattgcccaggctggagtgcagtggcacaatcataattcactgcatcctcgaactcctgggctcaaagatcctcccacctcagccaagatcttgaggggctaagactacaggcatgagccaccgtgtccagcccccaaataatttcaatctgctgttggttgaatccacagatgcggaacccacagatacagaaggttgactgtaattcaattttgctgtaattccaaaagcaattaagtctacagagcagcacagatgtttaatattattgtctcctaaacacaagactctcacatttgctacattaaagaaacagaattaacatatctaagatgataggtaatgagcaactatgtataaatgaaaatgcatttaaaacatctaagccttgaataatattataattatgttcattatattgaatttgaaaatttaccaaagtctgaggcatcataaataattttcaccgtattatcagctgcacgttttaccagatactatttcaatttccataatttccaaggcagaaaatactccctttcactgatctgtaaatctcctatctcacactgacatataatttctcaattcttctgaggatatggacactaccatagttattaaaaacaaatttttttttttgagacggagtctcgctctgttgcccaggctggagtgcagtggcacaatctcggcccactgcaagctccgcctcccaggtccatgccattctcctgcctcagcctcccgagtagagtagctgggactacaggcgcccgccaccacgcctggctaattttttgtatttttagtagagacggggtttcactgtattaaccaggatggtctcgatctcctgaccttgtgatccgcctgcctcagcctcccaaagtgctgggattacaggtgtgagccaccacgcctggtcccatacttattaaaaattaaaaagaatcctaccagcatattaagaatgctataaatcaagaacgtttatattagctaattatggtaaagaacaactgtgcaagaaacatcaggactggagagctcttttgggcctttcaggctgtttctaacattctaactcctgaccatcgaaatggctgcttcacaatatccaattaatcaagaaataccattcgttccatgaacttaacccattacagtagaactgagagcatggcctgccttaacaccaaaatctgcctgcatttcaaattcctatgattgcgcttcactgtagcacagtaaggagcatcagataaaactgagtttgaatcccaactgtgctacttaccagctaagtggcatggatgttgggcaacttactgaactgtgaagccacattttcctcatctgcaaaatgttaatattatcttttcataggatgagaatcaagcaagataatgagttttaaaatgttaatacatcaggtttaacacagatactgaataaatggtagctggtattctttactactactgctgcactatataatacaataatcactgactttgacgaactttatttacattttactgtgttatttacatactctgcaaatgtgatctgtttcagatctatacattcttagaagacaggaattatagctaaacaattttctctctgtagcacctaacaatcaagttctaaataaggaatgtacttccatagtttcctgattttttgtttttttttgagtcagagtctcgctgtgtagcccaggctggagtgcagtggtgcaatcttggctcactgcaacttctgcctcccaggttcaagtgatacctcccacctcagcttcccaagtagctgggattgcaagcatgcaccactgtgcctaatttttgtatagtagagatggggttttgccatgttggctgggctggtctcgaactcctgacctcaggagatccacctgcctgggcttcccaaactgctgggattacaggcgtgagccactgtgccaggcctatttttaatttttttcatttataaaatagccgattatcttgaacccaaaatgtacgcctcctcaaattacccggctttagaagaggatgctttctctaacctggtaattaatttaaggtttacaaaaaaaccccacaatgaaataaagtaatgtgctagtaatctattaatatcttcgatatttcaatatctgccataaaacttggtcattaactcactttttgaaaatattttctccaccttaagtagaactggttatcaaacaatgagtcagtttttcatctgcgggttctagctcatatttataaaatactggcactaatcagaaaatctctctcttctgacgatcaaatgtatctcatgctataagtctagatagttcagaattgcatagttttgaacgaaaagtctactgtaattattacttctgtttgtaatgtgtcttttctgccctggttgcctttaaggttttctctttatctttggtttccagccgtttgacaacaatgtatccaggtatattctttctgattgtttgtcctgcttgggattcttgaagcttcttggatctctggtgtgcttttcattatttttggcaaattctcagttattatgccatcaaatatttctccggccttgttattgctctcttttcctttctggaacttgaattgcatgtatgttacactggctggtattgtcccagagttcttggatgcttggttttgtttttgtttcccatcccctactcctttccccactctgtatttcagtttaaataatttctactgacctaatctatctttaaattcactgattccttccctagtttcatcgagtgtatggatgagcttctcaaaggaattcttcatatgtgatatcgtggctttattacctacatttgcatttgactgtagtttttttttgtagtttccacttctccttatctgttcatacatgttatccatgttttccgtcttgtcctttaatggttgtttaagtccctgacagacagtgactttgaagttattctagttgttagttattttcaagttcctcagtttgcttttattgattagctttatcttggagcagggagtcagggttttctgctatttctgcagcagcagccaatcacttcctacaacacggaggaagcctgtctgctttcccaccctgctctcatgagcacccagaggaggccgacagaaaatggcctacaagtgaatgcaaactcctccagtatcagggccctcagatattccagattgatattccagtccacactgggactctaacaattcgctaaagtgttactgatctcttcttacccctttgtacggcagtcaacctttccacccatgatctgccacaggtgagccatctgtatctctctggattcagacacctcgagggccctgagacctcagcttccctatgagcttgagaaaagttagcattctacctgccttttcctgtaggaaggttggttgccagcactgctctttcgagctttctgcatcctaggtggatgggcaaatcccaaacagttcagactttcattaagtaatatcatttgggcttagcctccaaaggagaaaaatcaaaccaaaccaaaccaaacacaaaggcagaaaagctttacaaagggtgaactatgcttttaagtcaggaattacacaccatcagagactatcatgaagaaacttgtaaagctttggcacgtatgacagacagcatagctgagcactgtctcaagcagtttggtcagtcgagtgagaatccccctttcctcaccttagtaattttttatcctccaactccctccactccctcattccttggctataaatctccacttttccttgttgaatatggagttgagcagaatctctcccccactaccaaacctcactgcagtagccccccgataaagtctgccttactgttctttaataactttcatgaataatttttcctgtaacaagaacaataaaacatcatcctttgccctcaaaagcattaaaattccgatacctgcatcacaagaaggtggagtctgtgaggcatgctgcaggtgtgtaacgtcgggcttgttgattcaatttgtttgtgtacccctcaaaattcgatcctgtgattcaggtatgctgccccttgatggcaaaggcacttccatccaaaatttgttttactgatacttcaacaagttcccccacaaaaggatcagtaaacattcagtgtttactgaatgaacacttaataactcaataaaacattcagtgaatataatttatatatttaatacacaattagcatacaattgatagatgaggaagttagataaggaaaaatgaaagcagaaaaataaaatgaggtcagaattgaggttaggcacattaaaacatgtttcctgtaactccgtgtcattgtcacagttgggccatacacttagttctgggttttgcagtgagctaagcagcgttaaaagaaaaactttggacaaattaaatttaacagagtttggctaggcacgttggttcactcctgtaatcccagcactttggaaggctgaggcaagctgatcacttgaggtcaagggttcgaggccagtctggccaacatggtgaaaccctgtatctacttaaaaaaaaaaaaaaattagctgggcctggtggcgggtgcctgtaatcccagctactcaggaggctgaggcatgagaatcgctggaacgcgaatgcgggaggtagaggatgcagtgtgacaagatcgcaccactgcactccagcctgggtgacagagcgagactctgtctcaaaaattaataaaaataaataaatgaataaataaataaataaacttaacagagttaaacagagcaaaggacaccttaaaaattgggcagtccctggaaccagaataggttcagagagactcaggaactgccatatagtctgataatatttatggacagaaaaaggaaaatgacctacagaaaacagatgtgaggtacagaaatagctgggttggttacagttcacatttgccttatttgaacaaggtttgaacagcctgtgattggctgaaactctgtgattggtacaagggtaggttacaggctgtttatacctctagtaaggttagagttcattatgtatggagaaatctttaagcctaatttaaaatatgtaaggcagctttaggctaaatgtaacagcggagagggaaattcaatgatgtgcctcattctaatttctgtgagtagtggtctagatcccttacctgaaattccataatccgttaaggtctgaagactggaaagttttcataaatttgaccaaaaaaaacattagatggcaagacctgacctggacaaatgtgaagtttgtaaagtatttatcttttaaaaatatttacccttacacttcgtgaatatgcagaaatatgaatgtgtttcactactgggtactctaccagaactagctaggtttattcatttcttttaattcaacatccacagtataaggttaaacaaaaattatgggaggccattgttttatactgagctcctacactgggccccagtagacaaaaccaaaccaaatggagtcactcatgctaaatgccacacaatcaaaccaaagttttagagaagcaggtagatcccatacagtccggtgtttcctgaaaataggagatcgcagtctacctgagtcagtgtcatatggaagctccctttgctttaacgcttacaaaagaggaacctgatgctaatcaatcggcttttttttctggtgttctgtttccttgttcccaccttataaagcccactcttctgctattgcccaggggtagctttcattctactttgtagaatagaggctgcctaattcatgaatcacatataaaagtcaaacggatctataaccaaatttgttgcaattttttcttctcataaaccatattaattttctaaaaatccagaaaattctgaattccaaaacatctaatcccgaagttttagatagagaactataaatctctatgtgttatatacatttggtctgaaatacagcgtaaattctccactttttattaaaaaaaaaaatagaaaaaaagccggacacggtggctcatgcctgtgatcccagcactttgggaggccaaggccagtggatcacctgaagtcaggagttcaagaccagcctggccaacatggtgaaaccccatctctactagaaatacaaaaattagccaggtgtggtggcatgtacctgtaatcccagctacttgggaggctgagggaggagaattgcttgaacctaggaggcagaggttgcagtgagctgagattgcatccttgcactccagcctgggtgacaagagggagactccatctcaataaaaaaaaaaaaggaaaaaaacctcttttcattccaagtgttctacacacagtatattgtacatgtctccccaatgaggtttacagatgtgtcatttaaaaaatgggttaagtgtgagaaactcttcgagcactcttaattttgtatctatagaatccagttgagtgaagttacttggccttcccttgatgttgtccaactctcgtgcttgtgttgactgaacagaggccctgcctgtggtagaagagccaacaataaaagcaggtcagattgtctaggaaattcactcaagtaaacacctttcttggggattccagttattagcatattaaattatacgtagtcctacctttatagaaacccatttaatgctacacccattttccaaaattatttgagcacagaacacctgctccctccaccccatacatcttttataatcaggtgatttaatatgtacaacactagttggaaaatgacttggtaaagcaattaaatgtaactttcactaataaaagaaagaattcttataaataaaacatcgtaaagaaataaaggaataaatacagctgttattctggctatcttacagcttctttccagtcttatatttacacccactttattagaaagcttctcttcagctcttctccatcgcacctggctctgcctctcccaggccagcacagcccccagacattctgggaacttgcctgcagggtgtcctgccgctctggtgcctgagccagttccaatgccccatcagagtgtgcatttctaaggaatgaaagttgatggagctcatgaaagcacactaatttgcctttccttatggccagggaacaaatggatagagcacagaaggtgctgtatgttctggtctcctcaatgcattagcagatccacaaaactcattctgatttctctgctccaaaacagaagaaaaatagccagcatccaacactgcctccatactgaaaaacgccaaataataccaactgcaagctccacatttccctcctgcaacattttctttttccacagtgaagagggagattcccactctgttattttttcagatatcacctatcaactattatttttatggaggcattttattgaaatacaatagtaaatctagttataccctcagtaaagctttgcaatctgcaacctttacaaactatcttactatagagttgttcagaaacagttttctataaaatctgtatcccttaacaagggcagactattttaaacatggattgagaatttatgttaatgtgaatttatttcaaagcaatttttactgagtgaactttatacttcagataatttatgccccttcctagtttctttcataaaaatatctgcagatttttttttgtcactatagaatcccaccaagtccaaatgagccctggtttgaagctggctgcctcctgtgcttacgaaatgggctgtaagagaagacagagcaagaaaagcaggtgagacctgtcacaagactctctgggctcatcttcaccgagcatcccaccctgtgcaaggcatcctactaagcagctgggtaatacacaatgaatctcacctgatcctgctacctggaaccagaaaaggaatgtacaacctgcagtatctgaggggggttggttccaggaccttcctccaagaacaaaatccatacatgttcaagtccctggtataaaatagtatagtatttgcagataacctagatgcatatcctcttatatactttaaatcatgtctagactacttgtaatacctaatacaaagtagctatgtaaatagttgttacactgtactgcttttttacttgcattttaataattgtgttgttattattactattttttccaagtatttttgacccatggttagttgactgtgtggacacagaagggccaaatgtatttcaggattcataaagcatgggaaaatgcaccaagagccacaaaagaggtgcagataaagcaataaaggaatttagaagagagtaatcattcacagtgttggaaaagcaattaccctaacaataaatggtgccatttgtactaccgtaacagtggtatttcaaaagcagagatcaaacatcgtgggtggttttttaaaataggaaaatggtagaaatgttgtttctactattggaatataatatgccagtaattaactacagtgacctaatgtgcttactgtaataatccaacctgaatttttccacaattaccactgtatttaaaacagtaatttctgtgtttatttttaaaaactcaagatttgactatatgactataacaagacaatgcagcctgtctaatatgctaaagttgcctataaactaaaaagaactgacttaaaagccctggagtggttgcctcacattgccccaccccgcaaggctgtactacggttgggtaaccaaatgctcctatttcaagcatttagctaattgattcatcctatcccgatgatgcattcaatgacttaaacttagatttctagagccccaactagactgtgagacacaatcagccattgctgtgtgaaaggtccccttaaaggacactagggagtgggggccccaccctctttgtgtacccaaacacacagctgtgcaagagaggactcccagtgctcatttattctattgtttgttaatgccagaacacatttacagccagaaagggaaaatgaaagactataaaactgacctccttcttatattaagaaggtaaaaatctgtgtcttgctcagaattgcaactttttttttttttcctaaatatggattgtaagaacagtaattacccaactatgtgaagtccaaagcaagtagagaccagcagcatctgggcgcttctttttttttttgagacagagtcttgctctgttacccaggctggagtgcagtggcatgatctcggctcactgcaacctccgctgggcgcttcctggaaatacagaatcctgaacccacttcacatccattaaatcagaatctgcattttatccagatccccaggtgattgtgtgttgaagttttagatacctgacttagaaaaagaaacagtcattacaatgacttgaaaaacaaagatgagcaaacttaaattgttctaattttacaagcagaaaaatggtccgtaaggaggagcactgtgtgaaagacgaaggcttgggtgtgagttaggcatcctgctgttgctactcttttgcctcttagcctaacaaaatctcagagtatcctattttctcatttgtaaaatgaggataaaaatacctctgccacaaaattagtatgaaggttcaataaggtgacaattagttaatgaacttctaaaatgtattaactgaatagaagaaattcaggtccctgcatctgaaacatctgactttctcaatgctgtcacagcttgggtgaccacacatggaggtgggcatgacagtcctacgttatgactgccatcttggtgtgatcaataatagcactcctttctttcttaacagcatttggagctgggcacggtggctcacgcctataatccctgcattttggagggccaaagctggaggactgcttgaggctgaatgttcgagaacaggctgggcaacagaacgagacaccatctctacaaaaaaatttaaaattagctgggcatgataacaggccctgtagtcctagctacttgggaggctggggcaggaggactgcttcagcccaagaatttgaggtttcagggagctgtgattgcaccactgcactctagcctgggtgacagtgtgagaccctgtccctctctcaccaaaaaaggggtttggcttggacaatagatcatattgtcaccctattaataactaacttactgagtgcttcatatgagccaaacactgcatcagttgtccacagcctatgctatactgccttaccaaagagaggaaggtgtcaactgtatccttggggtaaacaaaagtggcaatgtttgttgaccacgcataggaacaaaaacattaaaacaaatagctttcccattctatgaagctagcacagcattttggaatgattctaaaaataacaccaaaaaatacaaatgtttggtaaacatagttatcacctgaattctctgaatattttgtcatgagcttaagttgtaagcatgtaatctcataaacttgctaagtattctctaacatttcacaatctcactagtctaatttaaataacattacattaaaagtttggtatcaaattattacagagctaagtcactgtgataaaataccttttttacttatgaccattgagaaaatgtactgtggtgagaagctgcatatatattaacaggtaagacaatctctggtacaagtccttgttatggtggtaattcaactcatcctgaagcagagaactcctactgctgatgtccctgggcacgtgataggtctaatgacagaaaacttgttgaaacatagtcatccaaaacaagaaaatacttcagcggcataaagccaggcaccaggctgccaagcagcagctctgatttcccagctgatcccatcccaccccaagctgtgtgtcacagcactgcatttcctcacgtgtctataatggaaaaacaactggattgcatgtctcaactagcttgttttgatataaccagtaatccagatggcacataatcaataaaataaaaatgttggctaggcccaaggagacaaaacctcaagcctaaatccacaggaaatactacttttcacttacttttaagtagtgttttctaacaaactaaataagatgatctaagatttaaaaaccctttaaaaatgcttacactttatcacagacccaccgatggtttaaagaaacataggtcagatggctttgagttttgcagggttcaacactaaacattttaatgtgtgatagggatccaacttccattttttctaaaaatattccaataatactgtgctttacagtttgcgtccattattaaatttgtccaaaaattttgaggcaggtatggaggcttgctaaattttaattttgacatatttattccatttattttatataaaggagcagaaaagtctcagacaagttcaatgactggtctaaagccagctgtgtatggtggtggggccgggctcagatccatctctacttccctgttcaatgcttttgtctagacataattgagaagcattaacactgaaagtaagaaaagttccaaaacaacctaaatctgccaaagttaatctaatgctagttgcactgtcatgtttaccttcgatgctttttcacatctcttgaaagaggatgacaggagaagatttattacaagtatgtatgtctccttgaagatagaacttaagcaattttagccttgggctgactttcacaaactaaggcgagaaactaaatcttacaatgatgcaggacagaaaaattctacaatgaaagcactagaatgttactgttctaaaaataacacttaaagtagatatggggcttccattttatgagacacattgtcagaagtttaggcgatacatattgaggaatttttaacgagaaaatacctggaaaaagaaaatactcacaatgttataatactgacttgatcaactctaactgaactttaaggaaattctaaggtgaaactaatagatctattgcccccctcattattattgtgtgatctttggaaaattacctaccctggctgagtctaaggtagccagggtaaggaatcacagtaactacagttagtccatacagtgtggacaactaggtaccaaccatcaacttcacagactgccagaaaggactaaataagaaaaaattatgagagtgagtattaacttctcttaacatcgctttaaaaatattcagtgagaaagacaactagagcagtaaacattttagtgtagtggctaatagacacaactatacaaaaaatatcaggttctctcaaaaatcaattggctatatttggtgattagtaatgtagctggggttgcaaaattaccaggaaaaaaaaaagattttaaaacaagaaacatataaagattaagaggataacatataaggaagaaaggaattgttcatcggggaaactatgcttttatgcatctaataaaatattctcaaaatatagagagcaaaaatggatagaactaaggggaaattatatatctatcattctcatggtagaagacttatacctctaaatttttgctatatcaaaaaattagttatatcaaagatctaaacaatacaattaaaaggttgacttaccagactagtatgaaaccgcagacccaacaattataaatatacaatctactcaagcacagatggaacatttctaaaaaactgatgacacatgaagccataaaataaatattaacaaactgcaaagaatcaataccagatagaccaattaattagatatcagaaacaaaaagataaataactcccctgcaaaggtttaaaacttttaaactatagctctaaacaagtctttgcttaaggaggaaattacaatggaaattaccaactttaaaaatattttgtattaaaatcacagaattcagctaaaacatttcatcacatcatttaatatttaaagcattaaaatttaaatgcttatgttaaataaaacagaaaccgaattagataaatgcctatgaaatcagaagaaaaaaacaaggatggaggaaggagagagtaataataaaagtaggaagtaacaaactgaaacaaacaaaataggataaacaaagtttgcattggttctttgaaaatacagtcagccctccatatctgagggttgcacattcatggattcaatcaaccatgagtcaaaaatatttggaaaaaaactgcatctgtatcgaacatgtacagacttttttcttgtcattattccctaaacaatacagcatctatatagcgtttacattgtgttaggtattataagtaatctagagatgatttaaagtatacagcaggatgtacacaggttaaatgcaaatactacaccctttcataaaagggacttgagcatccaaggattttggtagccacgttggcggggagtagtggcccaggaaccaatcctgcttagacactgagagattacagtgataaagtggacaaaattctgccaagattaacagagagaaaaaaatgagaaaacagaattagaaattaaaaaggatacaattatagcagaatttgaaggataaaagaatgctataagtaactttatgtgaataagctgaagaacttggctcaaattgataaatgtctagaaaatttcaaagtagcaaagtttatctgagaagaaaagaaagcccaaagaggcttatgactagtaaggattcagtcatttaaaaaatcttcccacagaggaaacaacagaccctgaatggtttcatagatgaattccgacagttttaaagaacaaatgataacaatgttataaataaatgcttgtaaagaaaagaaaaagaaacactcaccaactcattttatgaaatagtatatatttaagtgaacaccagcaaataatgacaaagaaaaatcataagcaatccctctctcataaacataaatgcaaaaatcaagaatataaaaatattagtaaactagcaaactatgaggtgggtggatcaactggggtcaggagctcaaggccagcctggccaacatggtaaaaccccacctctactaaaattacaaaaattagccatgtgtggtggcacacgctgtaatcccagctactcaggaggctgaggcgggagaatcacttgaacccaggaggtggaagttgcagtgagcagagactgcaccactgcactccagcctgggcgatggagggagactctgtctcaaaaaaataaataaataaaataattagcaaactaaagccagctctgcattaaaaaataactattatttaggaccaaggtggcttaatcctgaaatgcaaaggtggctaatgtttaacattaacattcactacattaacagattaaaggtgaagaacaatctgacagctcaaaagatgcaggaaaaaactatgataaaatgcaatacccattaatgatttaaaaaaatagtagcaaactggagatagaaaggaatttccttttcctgatatctccaacaaacctataacaaacatctttctttacggtgacgtattaaaaacatttcctttaaacaccaggatcaaggcaggaatgcccataccacggcttttactcaacattaaggaggctctcataagtggagtagaacaaggtaaacagaaaagatacgtggttggaaaggaaaaataaagctgtcattatttttagcagaagtaattatctggttaaaaaagcttgtaaaagtctatagacaaattctgtgaattaataagaaagtttagcaaagctgctgtaaacaagagcactatacaaaaatggacaaacagcatttttaaacaccagtaacaaacaatctgaatatatatactgcttatagtatcaaaaaggaagggcatccaggacgaagcccaacaaaagctgaccaaggccctggaagaaaattttaaaactgtattcaaagacttttgaaaagacccaagaaatggagagatatgccatattcatggattcaaagattcaatattcagagatatcagttctctccaaattggcctagaaatttaatgtaatcccaatcaaactcttaccagaatttttcaaaaattagataacctgattctaaaatgtatatgaaagaatacaaaggtccaagagtagacaagaaattttgaagaacaaatcgaggaaggcctatccttccagatatcaaggcttattattacttattaataatagtaagcttattactataacttattccaaagctctagtaatacagacagcatggctttgatattaggacagacagcttaaacaatggaatgaaagagaatcccacaaactgacaattgcatgtacatgagtaatggcactgaagaaagggtaaattactcactaaatggtgctgggacagtttgttactcacacggaagaaagtaaaatggattcccgccttatgccaaacccagaaagaatttccaacttgattaaaaattgaaagagaaaagaaagcattaaaatgtttagaagaaaactgaagaggctgggtatggtggctcacgcctgtaatcccaaaactttgggaggctgaggtgggaagattgcttgaggccaggagtttgagaccagcctgggaaacacagtgaaatcctgtctctataaaaaatataaaaattggctgggcatggtggcatgcctgtaagcctgggcgaaagagcaagactctgtctcaaaaaaagaaaaaaaatataaaaactattaactataaagacaagattgataaatccaacaatattaaaaggaaagtgaaaacacaagccataaactgagacaagacatatgcctaaaaaggattattatttcaactaccaagaatttctgaaaatcagtaagaaaaagacaaatttccaagtaggaaaatgagcatgagacaaaaagacatctgacagaaaacaaaaacgaaaaataagccaggtgtagtggcacatgactgtagtcccagctacttgggtggctgaggcaggaggactgcttgaacccaggagtttgaggggccagcctgggcaacctagcaagaccttatttctaaacaagacaaaacaaaacagaaaataaataaataaaaaaccttaaaagtaatcagagaacactgctgctaattaagaccttaaaagtaatcagagaacactgctgctaattaagaccacaatagcatttcattttataatcacaaaatgggcaaaattaaaacttttgacaaaattaaaagtcaatgaggatgctgcacgatagaaaccattgctgagaggagtataaattagcagaaacattttgaaaaacaatttggcattatctcataaacttaaagacatgcaccccttacaaatccagcagttccaatcttatacatggatatacagaagaaagtataaaaatgttcacagcagtatcacatgaactagcaaaaacctggaagaacctgtgtgctccacgtgtgctccatgacaggagaatgagtaaataaatgatggaatattatctgcaattgaaataaatacactgcagctacatgcaacacagattaatcttaggcataaaatatatattttttaaataacagaagattataagcagtaaaataccatttttgtaaagttcaaaaaactgaacaccacacttcttaggaataaataatgtggccaaaaaatgataagaattgagcactatgctttcctctgggaggcaagcggggcagagatgggttcagagaagagcatgtggtaatgttttacttctcaggttggagaatggcttcatagctgttctttctacaaatactgtgttataacattaaatattaaataaaagagaaattcattacttggagaggcatctctttctgctctaatcatttacaagaagaatctcctgaactgaaatgagcctccttagaattcccttccactattcctagtaatattgttttttcctagaatgactttcttcctttacatggtatccttcaaatggtatatgaaagacttgagtttcatttttctagtctaaaaatgtcttttcttaaacccctcctaatgtgaagtggcttccaattttacaaataagcagcagccacccctcaggatggtttctagttcatcagcatcactgtaaaacaggccctccaaaattgatcaaacacactgggactggcagcccagctccaggcaatatgctgaggacaaagggatattgtgggtaaagataaggatagtggcagtttctgtaggggtggaggagttagttggaaactgaggaattgaggacaaaagggaacagaggcagctactgtgaagcaggggaaagggtggggcaaccaagcatctggactactcaggggctgggctaagtcaattaggacacatatattcacacatctggggaaaattcagtctgagaaagtgggatgggaacagaaccttagaaatgcaaaggaaaggtaaaagtatcagacttttgctcattttcagaaatttacctaaaacctgatgtgaagaaattgcaaatctagggcacagacaaatagatcctgcctccattaggaatcaggatctggggacagtgagagaaagaagaggaaaactctgagtacccaaatgatctgggcgtcggggacagcctagcttccccatggcgggggggggatgtggatgggaattgccttactgcattttgtgttgctataacagaatatctgagactgggtaaattataaagaacagaagcttatgtagcttacaattctgtaggctaggaacttcaagactgggcaacacatccggcagctcctggtgagagccttgtgctgcatcaaagcatggcagagaaatggaaggggaacctgatgcatatgtaaagagcaaaatacaagaggcaacctcgcttcataacaacctgctctcgtgggaactgatctgttcccatgagaactaatccattccagagagaacccagcctccagagagagctattactccatctaaaggacctaatcacatctcaaatgcaccacctaccaataccaccatgttggggaccaagttttaacataagttttggtggagcaaaccatattctaaccacagcagaggtcaaggggcaggctattagactgcacggtgaaggtgcttagcattttcaatgctgggtataggggtttagactgtcttctttccttgaatctaagaacccaatatttgtaaagagccactgtgattttatgacagatttggggagagagcacactatgccactgctatagcttgagtatctgtcccctccaaaacccatgttgaaatttaagccccaatggggcttaaataccccttctccaggcagtattgagagatcactgggtcatgagggctctgccctcataaatggattaattcatccattgattataatggattaagagattatcatgggagtgggactgctggctttataagaagaggaagagagacctgagctagcatgtgagcacactcagtccctcgccatgtgaggccctgagccaccttgggactctgcagagtccccaccagtaggaaggcgctcatcagatacggccccttgaccttggacttctcagcctccataactgtaaaaaatagattccttttctttagaaattatccattttcaggtattctaaggaacagagaacagactaatatagctattaaatataaataggtaaataacaaggggatcccactttcagagaatgatcaaaacattaaaaaaaagaaagttgcatcttagaaaggtttaggaaggacaagaatcatgcttccaggagaatgaggccacctatatataattctgtgctaatttggagcaacggcgaagaagttacgcggaaggtaaaaatctacaagcactgagaagagaaacaatgacctctgggtccttaggcaccacagctccactaaggtagcctaaaattgaaggagatttatgggaaaacccatcagactgttaatccatgttaagtttattatgtctaaacacctgaactgcagccaagtttgtactccttctatacctgtggtattgatttcaagattaatttacaataaattctactttggctttgatgttgtagcttgtcaagacgttctgaatcttgaatgagcacctctggtatctgctatctctgacagctgcatgacacctgcaaatctgataagcatacttctaattcttccaccacaaggaattctttgactatgctatgatatagttctgataaaatacctgtaggtgttaataagtcactgattatcctctacctgagacctctctggaatatatttcataatgttaaaaaaatcctttcctgaaaggcagcaggatagaaaattaggcataaacatgcaaccctgttattttttccttgtgagattaaatgccatttatttacaaagacttggattttagagaattaacttcttatccttaaggctaggactgcacttaagatttaaaaaaaataaataaaataaaataaacctccttggtgccttcattagtgacaagaagaggcaagcccttgtgaagctcaaagcatttacatgtctcttgcctttgggcacgctttccattctccatgagaatcacaaaattttagattctttagagactacgtctgtaagtcccttaagggcactggatccatcttctgtgtctgaaacttgaattaattcaaagcagcttagtgctttcttcctatctcatctatcttggattagattttgggtttactcttgttttcttgcatctagttcaacaatacatcttcttacagaataatttagtaagaatacaggcattgagaagctctctccttttgcaccttacatcacacttggagcagtgactccagcctttctttgctcctggttgttctataagtagatggcaatttaaaaaaaattgacatttgtatatgtggtaaatttccactccagattttacttttaaaaaaatgactactgtgcaaggctcctggtcctcttgtgtagtcacccccgcgtgtgtgtcctcccacgccctgtgttcgcgcccctcgccagaccctctttccgcagccctgcaccacgcgctctcactttggcagcggccacctccgaaacctcagactcctcaaactcgcagaaacccctcctggcggcagtgatgctccccacgtctcccacactaagtggcgcctcccttggcctgaccctgcggaaccctcggaagcaggatgcccctttgctgtcccctgcctcccaccctgaccccttcaccagccgtgtacttgtctgcgggttgctgggtcgccagagctgaggccacccagcaagggtgggtggagagaggccacgcgcccgggatgaggggagaggggccgagcccccggagccggagcctgcctctccaggaagcctctcaggctctatccgcaccccctgcgatccgcttcctccctgacaccagcgtgattttcttgaagtaaaaatttgattcccgcctgaaagcctttactggctgctgctccagcagcagaagacccaacccatatgcccgtgtttttccctgtgtaacttctcctcagcctttagctcccagctcctggccaggcctccccagcagtctagaggttgctcctcccctctcctgggctttgccttcgggcggtaacaccctagtcaggctctgtctcagttcccctaggaattaaagaccgcgggcaatgggatgttgcctgacttattcttggctgtttcttggatgctgagaatgcagactggtaaatattaaaactcagcaagtgttttctgactgaagggcctctctgtcctatgtcctcaataaatgtattttggtggaacagatgaataccgctgagagctgactggcgaatgccgcttctctttttcccagacctccttcctcctgcacttctcctccccagcctccccagttcccccagggccctcgtggccctgcctgtgcacagggctctaagcacctcaggcagggagcaatcactgaactactaatcattcccagttcccaaaatacacagccatagatggattatgctatcacgtggtagggtatgcctctctatgttattggccaagtctacataattcccagaacaattctttgtagattaatggatgggtagttaattggatcacaaatctgccaccgtaataactgaaatatattatgttgaagagtcactcagattacttatccagaatatcatccattattcttttttttttttttttttaacagtctcactctgttgcccagactggagtgcagtggcgcaatgtcggctcactgcaacctctgcctcccaggttcaagtgattctcctgcctcagcctcctgagtagctgtgactacaggcatgtgccactgcgcctggctaacttttgtatttttagtagacacggggtttcacaatgtagcccaggctggtctcgaactcccaagctcaggtgatccacctgcctcagcctcccaaagtgctgggattacaggcatgagccactgtgccagccagaagatcagattattctacagataaaatcaagtccaaaaaaaaaaatgaccaaataatattacacatctggagacataatgagaagaagagtcacaaataaaggtggttaaggtccttctgtttctaattctattcgtcccctcatttaatttctttcagtgcttttttttgattctaggtgctaagtattcacagatgaatacaatttacatttgtaccgggagtacatacagtctgagggggaaaaacatcacctcacgtaatacggttctagtataatcagaattggagggaagggaaagaacgcatcttccaatgtacacatggacagtaaacagcacaatgttgacaacttacagctagcttagtgtaaggtacctcacattttaatttaaaaatctttaatattagaatgcatcattgaaatttaagccttaaaattaaggacttttcagactaaacatcacagagatgctaagcatactggcaaaatatggcactggattcagtttaatgagacaacataaaaattcagaccaagagaataaatattcagaagcaaaggctttttagaagtgagacaggctcgaatgcctattctactacagaacttgtttcttcatctggaaaatggggataaagtgtcttccttatggggaggttatgaggactaaatggtagattaccaggcatgtaataaagggtagctatttttcaacacatgactatatgctaggactatgatttaatagactggcaaaagaaaagatagggaatcaggaaaaaaagaagcaataaaaggtttgttactaacagagggtgagttctgaaaagcaagaagagttcaatttatccaggatgtcataaacgccaactatcacaacccaaaggacaagacgacaatattactgttcctacctgtccagtctgataatgtctggcaaattggttaactactcgataatcatttgcaaagtactccatcagaatagaaggaacctcagcaaaatcagtagggcacctggtccctaaaacaagaaaaaaaaaaaagttggcatgaatcaaatcaatatatttatctactttttgtgtgccctttaaaacttttatttgtacttctgatgaactgtaagttttaattcattaaatcaatatttttcttctataaatttattgtacatatttgcagaaaagtttattataatcctatatattttcctttatatcaaaattaaaacaaaatatttgcacagctgctaaaacaccttataaagccatggctcacaccttttgcaaacaaacctgtcttcagctatgctggctatacatgaaacagattaaaacatttctaatattaatatagcgtttgtatttaattcactaaattccattacctaatacttttatccttcctttgttttacaagtactttattttatccatttattgctttttgtaacaaagtcaattctcagtgaggaaaagaaatattttaaactcaaaattacttaaagtaacaaatcctgtaagaaatttagatgacatttaacgattgtgttcagcccacctacagtcttttcaataccttctccttgtccaaaatactgtgtgtaaagttagttaacaaatgctggatgccaacaattcactagtggtctaatgctgaccatatgtgatagggagcttaagacttaaggataagacaatgaagaaggaagtctgtaatatcacaaaatatagccacatagcagcataaaaactacaaagcagaactatgattttatacaggggaaagtatatgaaaaattaaaaggacttcatcatactttttaagcatgctttattttcttctctgattttgaatataaagagagaccattcattcacttacttattaactctgtgggaggtattaaggagatacgtttttattcacacacacatagccacaaacttaaattcaatataaaacactgtaaaatgtaaaaagggacaaacttgaaagacaactgagattattccctggtgaaagctgttagcaagcatggaaaaaagcatggaagatcaggctgcacaaccatggggagggcaggatgaggcaatctgagataaagaccacaggacacggtaaaatgatcacattttccaaataaaaagcccctttcccaattcaaagaaaatgtatgtttgtaaaggactgtagtaaataaaagccctcctcatggctcaccagtgacgtgttggtaacgagtacgtcctagcattgaatgcatggcatgtcccatttcatggaaaagattttccatcatgctaggagttagcaaagttggagaactccttgaggaacggggaagattcagcataagaactacaactgggagttgatagtctccatcttcctttagtctgcctccacggatagtgaaatggcaatcctttaagaatcagaaaacataaaaggaaaagaaagtatttggtaatgtgaagagtaaaacagtcttaatgaatataaaatttcaccaaaaatgtgtgagtgcaaactttaacttaattatattcttattctatctatttacatatatacaccttttcttgacattttttattctgctaaaattttaattttttaaaacatcaagaacacattcagtttctatggattaactcattactttggtcccaaaacatgcattgaaatgatgctgtgccagaagctggaaacaaagtcagcaaagaacttacgaagggacactaacatttattctgagtccctactatgtgtcagataatgaactagtaggtactttccatgtctcttggctatttttttttctttttttaagatagggtcttgctctgttgcccaggctggagtgcagtgttgtgatcgcagttcactgcagcctggacctcctgggctcaagccatcctcctgctttggcctactgattggctgggactacaggtgtgctccaccacacccagctaaatttttagatttttttttgtacagatggagtcttactatgttgccagggctggtcttgaactcctggactgaagtgatctgccagcctcagcctcctaaagttctgggattacaggcatgagccaccgcgcccagcctctcttgacttttatcacttgaacgagatgggatctaaactagtgtaaagcaagggatccggagccagaataacttactctgaaacaggcactacactgagactcacatacactgtatcacttattctccacaacaaccctatgtagcaggtatctcacttttcagatgataaaactaaaactagtcttaggattattaaataacatgtccaaggacacctagctagaactgccacaccttggatctgaacccaggctgactattaggagccagggctcctaatcactaaagttgagtctccaccacccacccatttaagcaaagaggaagaacactggcctcagagtctggtgacctgcaccctgttcctacctttcacacctactagacaaatcatctcggaaaataatttgcttctgcaagcctcatctctaaaatgcttccttgtcaaatcccacagtggctgtccagaattcataagctcacatctgttaaaatctgtgctttggaaattgtgaatcactattcaaacataaggtacattatttctgttataacttataacctaaactcttgacatttcccatcaagctacatgaaactgctaaagctgactggctgtcaaagtcggccaatgctaaagaaaaggagatgagctgcctcaagtcttccacataaggagctacttggtggttggtaaggtttccacatggagtatcttccgcagttttagaataggttcattgtcgagtatggaaaagagttaaaagttggggatctgctcaggatgtatgccttcaagtcctagcacttctggccaagtagcttaacctctatggcttcagtttcctcataatgtgagtaactagtcaaaagggtgaggcgaacattaaaaggctgatgtgtataacgggctcagtgcactgtttggcacaaataaggattcataaaatgtcagttgtcattgttactataattaataccatgacccagataaaagtgacaaatatagactgatgtaattatttccataaactttttaattttaaaattctatcttaatttcaaatgtatatatttggtaaccatcattagtaacttttaaatgtcatggaatttaaaaaatgatacaaagttcacatcaatacaaatgaaatgccgatcggttctagagagaccagtttataaagaaaggatcacctgatgtggtttgtctgctcgctgaaaaaaatcacagtaaatgtaccccaacaatccttcagattcatgaacaacagcctagaaaaaaaaatttaaatttggtggtaaatgaggccatctgattctctaaaatccctaacacaagaatctgtatattaaacatccatagccacacatatagacattttaattacattctacaccccacattatctcgagatagattctcttttccccgcatcctcttctgctccatctcttgaatgattttggttttggaattctgtgtccaggacaggaaatcctcctcatgagggccttttgtcctgactgcctatcctctacaatacctttactaaccacccacaagagctgggaagaagtgctggctggacaattttaggagcaaattatttttccttcaaatcctggaatgtcgtgatatacgcccaagcaaattataacccttgaatttgaaaacaccacaatgcagctcccagcttgagttaaaaatcagcaatattactatctatcccctctccaagagacatagcttataggagagactcaatcactactctccatcttgccttctttgttctttcagaatttaatgattccatcaaagagaaccccgattttgtgctttaaaactacctgcaagtatatatttattgttcatcaaacatctgttaagcacctacttggtgccaggaactcttcaagacactgaggatacagaagtgaatgcaactgacaacagtgctggaccccggtggagtgcacattctgcagttctggggaaacccttcatcacccgcattttgtcctctcagtctcctcttataaatttttctttttattatatctcagcattttatcaatctctatcttttttggaagtttgtaatacagatagtgaagtaaatcaatgcagtgatgaacgtcctcccaccctgactctcctttcaatcccaccaccacacctactctccactcacaagacgtggccgagagacaatgagactgtttacatttcttaaaatatagtgaagaaagcagtgtggtaagcatgctagcaaaaatcaaacaacaaaacaatacaaagccttagtgacacacacaggtcaacaaagcctcaaatcctatgaggaaaaatttaaaatattcatgcctcatataaagtgggccttcacaggagaaagatgattgctaggtttgaagttattatcaaagaagttaaataaatcagaacacggacgtaaattaatatctgatgcaaatataagcccctacaacatgggatgggggttggagagaaaaaaggtcacttatccaatggatttgggaattaaccaaaacggacacacagctatgaaggtatatacaaagtaaaggacaattttcctataaatagaatttgtggatatatgaaggtgcatatatattcaaccttctatcaagttccaaaaaacttttttagaaaactctgctgttttatgtttggatcctttatacagtgtcttaaatcagaagtgcaatttggattttttttgtgaagcagaaataaggcaggggacacactcagtcagggcaaagttgatgtaaacctgaaactgctgttgactcaactgcccaaccgaaaggtaaatgcctgcaactgcaggctgagcaggaggagctcaccagttttcggacatcttcgctccacacctctccttttgcaggctgctctgcatataatgaaatccccaacagtctgttaagcaaaatattcaggccttccatgcatgctccaagagagaaaaacgggcaatataggctgggctcaatattatacctaagagaaggaagagaggttcaacagcatctttgtttatttcaatttctgaaggtaaattcaattaacttttcatttaatacttaagatcactggagctaaagaaggattcaaaacataaaagtgtatttatatcatttgaggggttttcagacagttttcttcagaatgacagtctgattattactagtgttagttataagtcagtaattaaggtagatatatcattccctaacctttgtcccttccctgttatttactctttcactaacccaattaagcagtctcaactgctcactgtatacattccttatacatacttacatgcaaaatatgatcagtttcagttataatggtaactcttaccttatgaattatattctagaaacttgtgacctatatacataaatattaaatgaataaaaatcctgaggcacattaagtgaatttaaagttctcatccagtaaaatattcatttatgaaaaaaatgcctgcaatataaataatcagatcttatctgttttatagttagatatcttaaattaaagacaacgtaactagtaaggtgaattattcttcacccaaaaataactttttctgttctatatattccaatataaaccaaagcaaatccaaaatacgtgatttgaatgtttacatttgaatcattaagtcaagccaaaatatatagccatagccaaaaataatggctctagaatattgtaggttctcattatatgtctactttttaggattaccaaaatacacatttttttttcaattggctttatttgtgattctagaactgcacaacacttcgttccataaaatgagtccccacaacaaatttatatataaaaatataaaaacatagttactaataaatgaatgagtttagtaagtgaacataaattgcacaacaaatgagactttggctatggacatccacaaatttacaccttaatttctgactgatttttctttaaacagaatcctagtgttgaaagagacgttcatgatccagtgccctcgctccctggttcgttcactcaagcatgctgtcagcaaacctgcggggtgctggaagagaagaatgaagagcctttgtgtctaagcagctggcactgaaagaggcagagaagtgaaccaactacactgtgtcctgggcctggtgcagtgggcacacggctggcgctcaacagacagtgctgaagcatgaacgaatgagcactgcaaaatgggagggcaaaggagagcatgatgactttacttgtggagtgcagagtagcaccagggaaagcttctcggataggaatcaagaaagaatcggccgggtgctgtggctcacgcctataatcccagcactttgggaggctgaggtgggtggatcatgaggtcaggagttcaagaccagtttggccaacatggtgaaaccccgtctctactaaaagtacaaaaattagccgggtgtggtggcgggtgcctgtaatcccagctactcgggaggctgaggcagagaattgcttgaacccaggaggcggaggttgagtgagccacgattgtgccactgcactccagcctgggcgacagagcaagactctccatctcaaaaaaaaaaaaaaaaaaaaaaggaatcagactttgcaaggcagggctgggatgaggaatggaaaatgggaatcataataggaattctaggcagaagcgacagtataactaaagtatgatggcataaaatagcctggtaacttctagaaaggatgtggttaaagatgaagcagttaccaatgcagggataaatgtagaaagaatgggagcggagtctggaaaaggcaggcaggggccagaaaacagagggcctggtccactaagctgaggaactgggaccatgcaccataggccatggcctctaagcttcctcaccaatgcacactaaaataacttttgagtattcaaccttctattagtacactcataaagtatatgcatgtggtattgttttatcacattgcaaaaagaaaagcagacatttttataagttgagataaagaaaaataaatatacatagaatttctaatattttatgactacactctcaatgaattgcttacagatgccatttgggagacagcttctgtaggccataggggagcatctgatgttttctggaatgctgcacagtggacagcatggagggtggaatgcaggaggcagggagggctgacaggaggacagacttccaggcttcagagggtgaactctgacagagggcagtggggtcagggatgaatgtgtttttcctttgagatgcaaacgtctcaggactgtgtgagtgattggatttggagggtgatgagaaagacagaacaatctagaataacactcaggtttctggcttggacaaataagtggatggtagagtcactgaatcagccggcacaatgaacacaaaaaaggaagaggggaatctgggtgtgtttgtgggagaagagaggagggtgaggtgcaatgatgggaggaggatggagggctcacagaaaataaactccattttggaggaaccgactgtgaagtgcccatgagataccagacactcaggacccaaagctaaggagaacaaggagacttcactgtacagatattagagccatagagggagacagggccattagggaagggcgatgcgggcagagaaggtaaagggcagacccctgaactaccagagggaggggtgggaaggaagacacagaacagttcagaggtactgaagaactgagagaaaggagtgcatggaaagaggggagaaaataaactataaaaggaagtggtccaggcttgaggtttccactcctgcacatgaggaggttgaaagtcaccactccatcctaacaagcaggaagctgaacaagctgaaaatcaagaatcttcttagattcagcagagaatcaaggccacagagcaaactgctgcccccaaaactggaaagaaaggcaggcagccatagagaatcacagcttaccagagcagaaacctcccatagaacctactaccaaggcaagaaagtttaaactataattggttataaaaagcaattcatttttttgtttccagacaataaaaacacaaaaataaaggagaataaaaagaaactttacatattaaaattctacccttcttaagattataatgaacatttatttttatggaaaagaaacacagtaaagctagtaacacagcttattttactaaactataacctaaaaatatttactgtcttatccaatgaccatgacaatcattatgtgttgggcaaaattcaaggaaacaatttatcttggaaaaaaaatttaagtatagaatataagttcatataatattacaatattaccctaaaatgattgggaacaaatgaatttctaaactgcctgttttaaaataaaaacacctcaaaaatattaacaatgggcaaaaagtatactgtcttgtcccctggctcactatgcccacccccagaggtaaatatcttgtgtatccttccaggcatttcctatgcacactcttagaagcttatgcatgtaaactttatgtatatataaacctactttggcacaaatagaatcataccattcacactatctcgcaattttatttaacataaaaatatatcaatgatatgtatttttacacatatatttttcataaaaatataacttggaatactttccagtttagtatataaagctctagcctgttttctttcatgggtgtagtcatccacagcaaacacatgacaaagctcatttcatgcatctcctgttgtgttgtacatgagcagaggaggcaaggtcaatgagagcctgaagcatcaatgggggaagcatccgaccactgacatcgtttggaatttcccacatatggggatattaaaggaacccagacttttcatcagttttattattgattttaacttttttacagaaaatgcatcccgttaggccacacccagagctcacttccctgccttggtctgcctctgttccttttaactgacggtaagctgctgttagtttatctgttaaagtgatgccatagtgaaatgtccttgtcacacccacacaagcctatccataagataaactgaagaaatggcattgctgcaaagagtacaagatcttaagttttttgatatgtatttccaaattatcctctaaaaaaagctgtttctaacttacattcctacctgcagtgtatgaaaatacctagtgctctcactctcgccaatgtaattctgttacgtttcttttaatgcttcctttattttccttctttagctatgtgtgctgcatttcctttttctttctaataatttgatatattagtgatatttatagtctatattttagcttctctggtggtttctctattgtttttaattttttttttttttgagacggagtcatgctctatcacccaggcgtgcagtggcatgatctcagctcactgcaacctccacctgctgggttcaagcgattctcctgcctcctaattttgatacttttggtagatacgggcctctattggttttaaaataaacatttatttattggtttagcaattttagataatatttactgattcccctcctcctgccttgacctcctgatctgtcttgttgttacatatagatatagatatattgatgctctttttcttaattttgctaggcaccagagaggagaagaatagagatatgccctttattttgccaacatttactggatctccccagaatgcatacaatgggggaatagctgctattagtagtaaggaagaagaggagagacatgacaaaatcctgtgctttagaaagattattctggcagtgacatgtaggtcagtttaaaatgcaaagattcatgattattatagcaagaggaagttcaatatagtttgtgtatcccttatccaaaatgcttgggatatgttttggattttggatttttttttctattttggaaaatttgcatatacataatgagatatcttggggatgtgacctatgtctaaacacgaaatttatttgtttcatatacaccttatatacatagcttgaaggtaattttacagaatagtttaaataattttgtgcatgaaacaaaattttaactgtattttcacgacaatctgtcacatgagatccacttgtggtgtcatgttggcactcaaaaagttttggattttgaagcatttcagattagaaatgcttgacctgtattgcaaatatgttgcccatttttccctaaatttaatctacaaacagaaaactatcactaccaaatgatgatgatgatgatgatgatgatggtaactaacatttggtgagtactcactatgacagtgggctaagccctttatacatatctcatttaacagcaaaaacgatcctttaaggtaatactatcaccctatgttacaatggagaaaacaggtttacaagacagtaagtaaccttcccaaggctacgacaacaactaagtagaaggcctgagaccatcctttataactgcatgataacagcatggaagttgaaaaaaaatcaacaggagggcacatctttgtttaggctgaggtactgaagtttttcacaaatatctgttacaagttaaagcaagtactaaaggaagcacagtaattgtatcattcattcttacacacatttcccaaaatgctttcaagagtgaggagctactggtcacaatgagaacactacatccctgcattgactcctacggcagcctaacagtgaacaaagattgagaacgatcaatttagagaagtaaaaagagaaatgagtgtggtgataaaaaaggagagaacaggaagtctgagggtatgtgttgaagaaagaattttaagaaactggacatggtaagcgccgtcaaaaactgcagacattaggatctcaaatccaagctaaaaaaaaaaaaaaaacccaaacagaaaactacagacatcacggatgttgagcagtaaaacaaattactgaatttcatgctggcaggtggctgataacctggaaacactagctgggtagactgacaggcctataaaccagactgtagctattagaaagaggaggcatcaggagagagtaggactgggggaagttcggcaggaaaaaaatgagatagtaccacagtctctccaactgtcacagaagggtaattatttgtgttgtaagataagagatatcttagcaggtctgcaggcaaagggtttgaagctaatacaaaggaagagatggtgattgtgataaagttagaataactggtgaagcaagatctatagtggtttgagataatattatcttatattgtcttggtgcttcacaatttacaaagcactttcacatcaagaatcaagaatctccttattccttacatgattctgtgagacaggtggagcaagaattattaccagaattattgttcgttttacttgaggaatctcaggctcaaagaggcttgtgacagtctaaggcaatctggaatacaagaaagagccctgggtttgaaaatactatttctcattggttccatgctttgagcaagttacttaggtttctgaagcttcagtttcctcaccagtaaagtagaaatactttccaggctccattaacaattacagaaacacatgcaatgaacctggcatggttcctggagaaaagcaggcacactgtaaattatagccactattattgctgttagacagagacacggacagggacaagactaaacccagcggtttctacttctattccagttcccttcttctactcctattccagttcccttctattccccaaagctgaccttacctctaaaaagaaatgcaacactgtgtcaagaagctgtgtagatgcagtaaactttcattaatcacctgccatgtgcctgcatgacaactcctcagtgtggaaagatgaacacattgtaacaataatgacgaccaatccaaatgatcaggggcagaggagcactgcaaacaaggcattggctcaaagatgaggctgtggtcagttacacctggcagaggggagaagctgggaatgggaggaacagagagaactacaaagaagaggcagcatctggagcacacctggaaagatgaggctcctagaagagggggagggcactcaaaggggaagaaagagggcagcaaaggcccaaggggattcaagcaaatggggcagacaagctcaagcaagcactagtgccttagtcctcactcagctgcctcagccatccagagcgagactacatgcctctccacaccctcagtgactctcaccaaatgcaggctacttccttcctgaagaaaagccagaaggagagaggtccagagagggtggaagagattcaaaaagctacagggtgtttcccgcagctccaacccacatctgaggggccccaaggagcagtcccacatgaccagccagtcaggagggcgtgactgctgtgctctcagctcacgtcttcaacacggagtgaaaaaacatgcacagagggtgtttgggtggtcacaggccccagtacagccctccacgccaggctcatcatgtggctccgcctgcctccacagagcactccgaggctgaggccgacctgtgaacaaccaactgcaccatctccatccacagcttccttatctgcatagatgctacacataagaacattttcctctctcatctagagacccaagacagtgggaaagcaccatgggcagcatataggacctcacagcacagcagagccacaaccagcagagacagagcttagatgcattttgaggatttggcttcagtgccatccctgtcaccacctcagactcttctacagttttacaagaattttatgactattttttgtaaagaattccatggatctggacccagaagtaagggatctctagaaccctttgattcctctgaagaaagaaagtggaagaaaattgtgttatccactacaggtgactgaataagtccaataaacactctgctattctggtttataatacgttacatatgagtttacagattttcagcaaagaaccagaacataccactatcaacatgatacaatggtataattaggtcttttaaattaagaacaatagaatttagtaatgtatcaaaatcttcatctaatcttcatccaacactaattatgattgaaatgagcacagaaatatcagtcaagaagagactttcaactgaagaattcatcattgtaaactgaattttaaaaaagtcaatggatcactgtatttatgaagcacactctatgagtcagacttatatttcaacctctgacgcacctggaattaaggtaaagaaagaacttggatattacgtccaaacaccatggcctcaaacttagtgaaaatataaaacacaatcaagtacagtcagagaatccaggttgaaacacaggtaaacacagcttcagtctcaccttattctattcagtgagtgagagcaaatgtgacagagaacatgtgcaccaaatggcaaatgcccacagaggcttgttacagaatgaacaagatggcctgccggagggcacgtgtgggcgaggaaaaaatggacacctgtaaaggacacagcacgtgacagtactgtcagagaaactatttttaactttatcaaaagcaaatgaaactgtatttttggcatcaggaatgactaagtataattctcatgttatagctgggtgacattttgaaatgctgccttgaaaaccacagggagagctactgttttatttggttacatagagaaggtagcagtaaaggaactgaatgatactggaaacctgtttgccctttaggtaactatatagaactgaaaagacctttccccctgttctataaagaatccaccattgctaatttggttctgtcttgacttctgaagctagtggcaagaaaattgctccagtcaaacttcctggcaaccaggaaataattttcattaatggtgcagatcagcaacacagttcactgaaaactgtggttaacagaaatcaaagctaaagaaagacagtacaattccatcatcatcctagggattaggaaagtaaaccagtaggcctgacttcagtgagagatgacaccacaccaatgtgccactagatgacagaattctcgccatagaggctggggccaaatctcactacagcaaggagacctctattgcaatggtctctcattcagcttaagctgtatcaaaatgtgaaatcaaacagccatgtctaaaattgaacagtaggaaagaataaccaaaaataacacctatgtgctgcctcttgctttaggaagaacagaatgggagttgtggaaatgtcgtgagagaggatccaggttagccctggaacagggaggaatgaaaacctagtgagaaggaacaagtggcagcagcaaaagggaaataggcagagattttctcccccagagccttgtggaaaacgatgaaaggaaagtggccagacagccatttgctttgcctaaggagcttttccaagcctctttgaattactgagtccagcaacagaccctattctcagacctctccccaggttgcagacacgactggcccagaactggagaaatcaccaccccttttctgtcctgcagggatgcagcaagtggttcaaactcaactgggaataataaacacaggtattttgagtctcactcaacaagctcctaaaagactgacttttcagtgcaattggccaagttatgacagatttggcatccctccaaaatgactgtaatagactgaaacacaatgaatcaatggaattccattagtttataatgacgctttacaaagagaaagccagataatactcatttgtcactagttcagaaaactattacaataaatccttattttgagaattggtaattaaaaagaatgactgactcagatgaagactatcaatgggtgttaaagccactgggtaaatgactgaggaaaaactggacatttccatgttgctgggaacaccacagagatccctttctagctgagagggaaaccctcatcgcagactgcagagatcctgtcagcatcaatctacctagtggtccatcttcacatcaccctctgtgggcaactgatatttcatgtcttttttttaattttcttttttttttaagagatggagtctcactctgttgcccacgctggagtacagtggcatgaccataacttgctgcagccttgaactccaggattcgagtgatcctcccacctgagcctccaagtcgctgggattacagacatgtgtcaccatgctcagctatttcacatcttttgatgtgatgtgacacaaagtatacaacatcacctatgggtgtccatgccaaaaacgggaaatgtttaacagtgagttattatatgtaacatccagcttacaggaatgataggaagagaggaactagtgaaatgatgccacaaggaagcacacagataaatccagaaagttagaaattctgtaggacaaatggcctggtctcttcaacaactgttgctgataatatgacaaaaaagagagtaagaagagcatgaggcatggggaattgctctaaagtaagagacaggagacagaaaagccaagagaatgtggaggctttgttggagtcctaattctaacaagctaacggggaaaaaagctgatttgatactaccaaggaaatacgaatatagactagatattaaatgatgccaacaaattgctattaaatttttattaggtaataatgatacaagagttatgtaagaagatgttcatccttttcaaaagtacataataaacgtataagactgagatgacatgagggctaggatttcctttaaagtaatcacaagccaggtaacaacacttctgtcagcaatgaaccacatatgctacagtgggtggtcccttgagatgataatggaactgaaaaatttctatcacctagtaacattgtagctgtcatgtcagagtacaaggcattactcacaggtttgtggtgatgctggtgtaaacaaaactactgtgccgccagtcatatgaaagcctaacacacacaattaggtacagtacacaacacttaataaatgaccatattactgattcatgtattaactacactatactttctatcactattttggtgtactccttctaagttaactgtgaaacagcctcaggccggtccttcaggagggattccagaagaaggcattgttatcacaggggatggcagctccatgcctgttatttcccttgcagaccttctagtaggacaagatgtggaggtggaagacagtgatgttgatgattctgaccctgtgtaagccttggctaatgtgtatgtttgtgtcttggtttataacaaaaaaatttaaaaagtacaaaaaaaatttttaatagaaaaaagtttatagagtaaggattaaaaaaagagaaaatattgttgttcatctatacaatgtgcttgtgtttcaagctaaatattattacaaaagtatcaaaaagtttttaaaaactaaaaagtttataaggtaaaaaaagttacaggaagcaaaagttaatttattattgaagaaagaaccatatctttctataaatttagtgtagcctaagtgtacagtgtctataaagtcaataatggtgtacggtaatgtcctaggccttcacactcaccaccactcactcacagactcacccagagcaacttccagtcctgcaagctccatttgtggtaagagccctatacaggtataccattttttatcttttatacctattttcaccataccttttccatgtttagatgcatatatacttatcatgtgttgcagctgcctacagttttcagtatggtaacattctgtgcaggtttgtagcctaggagcgacaggctataccagagagcataggcgtgtgtgtaggctatacccttaggtttgtgtaagtgcactctaagatcatacaatgacaaaagtgcctaacgatgcttttttttttttttctgagacaaagtctcactctgttgcccaaactggagtgcagtgtcattatctctgcttactgcaacctccacctcccgggttcaagcaattctcctgcctcagcctcccaagtagctgggactacaggcacttgccgccatgcccggctaattttttgttgttgtatttttagtagagacagggtttcactatgttggccaggctggtcttgaactcctgacctcgtgatccacccgcctcagcctcccaaagtgctgggattacaggcatgagccactgtgcccagcccacgatgcatttctcagaatgtatccctgtcattaagtggcacatgactgtacattagtaatgagaaaagagaaaggaaggaaagcagggagggaaggaagaaggaaaagaagagcaaagaaagaagaaaactgaaaaaagagacaaatgaagcaaacatagaaaaatcttggtaattggccaggcgcggtggctcacgcctgtaatcccagcactttgggaggccgaggtgggcggatcacaagttcagcagatcgagatcatcctggctaacacggtgaaacctcgtctctactaaaaatacaaaaaattagccaggctaattttttttttttttttttttgtagaatctgggagatcaatatgcagaggttacttatattgctctacttctgtttgtttaattcatttttttcttaaacaattttttctttgttctttttcttttgactgagccatccatttcctatttgtttattttgaaagttttcataataaaggttaatttttaaaaatttaaaactaccaagatcactaatcctatactaacaaagcatgagatttctcacatcaaaaaaaaagtccttctgtgagagcccattttttgaatagtttaaaacacaaaacatctgtatttcattatgtgaatgcgcttgagattttaagaatatatcttagcaaggaatagacaatactgaattccctttcccagtgatatcctaatttaaaaatagcaccaaaattggcagggtgtggtggctcatgcctgtaatcccagcactttgggaggctgaggcaggcggatcacttgaggctaggaatctgagatcagcctggccaaaacggtgaaactctgtctctactaaaaatacaaaaattagctgggtgtggtggtgcatgcctgtaatccctgctactcgggaggctgaggcaggagaatcacttgaacccaggaggcagaggttgcagcgagctgagatcacgtcactgcactccagcctgggcaacagaggaagattctgtctcaaaaaaaaagaaaaaaaaacaataaacaaacaaacaaacaaaaatagcaccaaaataaatgaaatactgaaactcattactcacagaaaagaaatagtgtttccaaagcatcaaaaacaaaatccaaacactggaaggatacattaaacaacttaaaagtggtgacttctggggcagaggtagagatgagtattctcaattaatacttcttaacattgttgattttttgagccatgtgaatgtattgcctaatcaaaaataaaatttaatttcaaataaaataatttatttttgtatctgaaagacgtaatgttactcttccatgaagaatcttacaataaagctttaaaaaggaaaaatgagctgctctttaagacttgctgacagtcacttatactactacggtattttccaggatcaacctttggcacttttaaaacatgttaatttctcctcctgcttctaaacaggttcttttctttagatgaacattaaaaacttgaaataaatctgaggtatttaacataaaagcaaaagactccctgaggttaacttgaaaaaaaggctcgaatcaaggaaagccccttctatatttcattttgtgtcaagccacacatttaagtctttacttgaaaggtgatgaatttaacaaggatttagaaatcttcactttgttccactcttctaaccccaaacccaacctatgatatttttcctttcttttctcatccattacctgtgcggcagcctcctcttgtcaatcaagattactgaagcctcaaaccaaaactcagtagcctattaagctacttaaaatagatttttaaaacccgattcttacaaccccttctgatgcatttctgcatcccttttcctggttcttttactgagttaatagtcaaataaataaattagtattaaaactttaaaataagctaaagccccacatggatatctggcagactacattgtgttcccagcatacctggtgatttcaaggacttagcaagcaggtggaagactccatcaaccagtgagcactgcaaacatgtcatgcaaaaacatggcattctctttctaaaaaaacctcatcactggattgcttttcatggttactggtctagatacaagtttgaataggggctatgaattagtatgtatttactgagggtccagaatgtttgttcttgcagagctttaaaatatggttgacaagacacatttaacatccagaacatcttagcaggtcaactgtgtagcacacaggctgttaagcacagcggagccaggagctacacaaggctagtgcagactcagcagcttcatggacacctggcaagatgtcacagatgtgtaagacaaaccagggaggcaatgggaacccactgctcccctgacagaggttctgcctttgagacagaaaggggtttggctgggataaactgtggaggaagagcagcggtggaagaaaaatcagaacaaataaatgtgagtagagatgtttctttctgtaaaacaaaagtaggttgtgatcagatcctacagtgcgcccagagccaggcttgtgggctgttggcagctatatttatacccactgttatttaaatgcaaattaaggggtgggttaatgcaaattgggggtagattattcagaactttctaggaagggggtgctaacttcccggtcattggccttggcactagtaaactgtcaaggcgctggtgggagtgaattatgctaatgagtagtgagggcagccagaaatccctttccttgccatctgttggtctgggctggtttctttacttcattctgtttggaccagatcctgttctggtcaggaggttgtgaccagaaaacaagtcctgctgatctcctacctcggaaccaccatttgggcatgctatatttacagagtatagttagtgaaaaaactatcacttatatttaaggccaaggcattaatgaaaataatcaggtatcggggacatgatatgaaaggaatacctgataaaaatgagagtagcaaaaattagaatatttattaaattagaatatttaatattctaaatattgagaattaaaattagaattctaaaaattagaatatttaatatcaaatatatttaatttacattactctccaatgtcaaaaatcaaatgctttacataaacatggaaagtacaaataaattttattactgatttatgctacatctttaacaggtgaaacaaccaagccaaatctttctttgacagaattttaaaagagacattttattttttaatgcaactatagggagcagggtttcaagttctgcaaccagaaaacaattttgtaaaacaaatatattctaaaccctcgttgtttaccataaccaaattattatagactttgaataacagtttatgtgttttcactaaaaaaaagactgatgctgaatttgagatacatttttaaaaaaatggtagctaaccaacctgggcaacacagcaagaacctatatctctacaaaaaaatttaaaaatcagctgggtatggtggtacacacctgtagtgccagctacttgggaggctgaggcaggagggctgctggaacctaggaggttgaggctacagtgagacatgattacgccactgtactttggcctgggcgacaaagtgagaccctgtctctaaaaagagttgtttaatgaaaaataaaaataaaaaatagtaactgaccaaatattcttaactaaaggttaggacacaattatgccttgtaagtaaaaatggttttggcaacagtgatagatggagaccaaagagaggaaaataaatgaaaattaagtgagtaagtgcttcaaaacactaattgatcttaggctacctcatcctgctggtatagaaaagaatatagaaagttattgttttctgtttttatgacaaatgctgaaataaataattaagcaaatacttcttattttggagaagtacctactatgctttacttgatgcttcaataatgcatagtaataaaaatattttaaagcttaataccaaataaatacacgtatcatcacagtacatgctggtatgctttaatgaggaaaaaaaaacaaaaaacttacattttcttctattacctaaatcaaccttaactctcctacttaaacagcatatctcaaaaactaactacaagggaaaaatgttaataagttgttaaagagtaggattctgagatttttttttaaaaattcctattgggtatataaagttgcttcagctataaacattttaaagtgtgttcactgtgaaaagagctctatttcttgggtttataacataaaaattacagaaatagtgtgtctgtagggagagaagggcatacctacttttctccaatataataaacacaggaggatatagaagccagaggagtacttctgtcaacttaagttccttaaatctttatttcatttatatccttccagatggaccaataatgtgttgacaatatatgtgtccaaataaaaatgagaaaacataagagcgccactgcactccagcctgggagagagcaagactccgcctcaaaaaaaaaaaaaaaaaaaaaaggaaaataacgtagtaccacgccatgtaccactttattcctttactggttcagtaaacacatgctgagcccctactctgggccagcaatgggatacaacaaggattccagcaatgctcacagcctaggaagagaaccagaaagctacgcaagggcagagctggagagggaccagattgtagaattttaaacaaggaaatgatacaagcagctgaagaatacatgagtggagcagaccacgccagcagaaagaatggtgtcaggggaagggtttgtactgtgggcgactcagtggatgacagtagctgctgaataaacattagtttcctttttccttttcctgtacgggtatttcttgaaaaacttacctttctgcacgaatcacaccactgtagtaaggggggtcccagggcattacttcctacaatggaataattcactgttaaggaaagctactgactctttcatagtttttatcagcaacgtggccagcctatagaatgtaaaccagctactgttcatgtaaatcagaacaattttatagaatcccttaaaaaattgatagcttggcagaaaatacctggctccttattttgacttccctgtaatcaagagatagtgaagtataactaagacctaccccagaatctggggaaaagacaaacaaatgtcattctgaagtggtatctaacaaaagtaaacattaacgaattatattagccataatgaaatttttcccaaaatgtaacccatgtattaatccataaaacacactgtaggtaagatgagtgtactaaaggtaggattaaggttctttctaaatctaagcaagaagctttgggtagatatcaaaaatgaaagcagcaatttaaaatgtaaccaaggcagaattaactctaatcttggcaaagaaaatatgtcataaagaagtactatagtactagttgcttttgatgattggcacataatactgaaagaagggaaagcttgaatacttgaatgactgtccttccttctaggtgtccaggtggacaaaagagtggttaagagaccaggctgtgaagacagactgcctgggctcaagtttccaatccataccagactataaactgcatgatgacagggactttgtttgcatccttccctattacattcctgtcccctgaacagtacctggcccagggtagtcactcagtaaatatttgttgaaagaatcaacagtacctcccaaagaagactgctgaatgtacttaaactattaagtagaatatctggcattgagtaagggctcaacaaatgttggctactctccttattaccattatcctttaacatttcagtttaggcataatctcctccaataacaaggtgttatttcccatattccatggtaatacttatatcatgggatgcatgacaacctaagatacttgtaggcttattttctttctcctcatgagtgcctgaagggcagggactgcgtccatggaaccctagccccacagtgttctggtcctggcacacattttctctaacagatgattatttgctatctgctagatgcagacagagtgcaggctgtaatcagacaaaaacaagaggatgatagcctaggcagtagaagggcaagtgactcaacaatcagaggacagtatgtcatgtctacattgtgccatgtaaaacacagcccacaagaagagtatttaaatcacagcggaaggttaggaaatgttctcaagaaggcaaagcctgaattgagttttatgatagaagcagttaatccagatgagaaagggagaaaggcattcctgtaggtggtgtttgtaaatgactggaagctgctcaccatgccatatttatgtggccggcacgtaaatattaattcaaattaaagaatcaaagaaagcaaagcaaggaaagaaagcaaaactaagtgaatagagatcacatgagcatcacacaggtattaggagagagcaaagaacacagcctcggcttggaggggcagcagaagatgaagctagagaaggaggcaagggccaaatcatgagggcttggcgggagcagcagggtagtaggaagggaaactggagaataaccaggagctactgaataattttaaacaacagagtgacaagatcagatctgctttttagacaaatccctctggtggcaattcattcattcattattcattcatagttcaaataagtgttgacaaccaattctatgcctaacactgggctaaatacatggctaaactgtctgaatccaagacggcttcgagtggagcaaaaacaaaaggctagaaaccagttaggcaatcccagttaccatctgggtgagaataatgattgggatcatagcccaggctatggcaatgggcacaggagaagacacaagagttcacagggagggagaatctgcaggacctaacaaatgattatgggggaggggagtgtgcagtgcctggggtgcttgttgaaacacagattgtggagctcaccccagtttttgattcagtgggtctgaggtggggctcaagaatttgcatttctaacaggctcccatgtgatgctactgcttctggtccaggaaccacactttgagaaccactggtctggattaagtataggtcctgaccagagcagcagggtgaatggtggcaccattcaccaaagcagggacttcatgaggagattgggcatttcacaaatatctgcagaataattgtatccataagctatatacaaatatctacagataacagtttaaagtcatattcacttttactgaattagcttttggcaacacattttgttttttatttttctgtttctatagtcaccaaactaaattcttacctattatctggtttcccaaataagcctacctaccaggtcaaggtgtgcagatgactgtgcagatgactaacagtagttactttgctagacacagctccttccataaattaacagactgacatgctactctacacatcgctgagtttaatgggattaatctgtttcctagtggctgtatctgggaagctagtaaacagtttgtaaatctgcaaggcccatttccctaaatcttccttatgactatggctctggcagcagcaactaagtcaagaactaataacagcatttggaaaagaatggtgtagacaaccccggcaatcctgtagtgccctagaaccaaatgggaatgagtcctaatatctggactctcgacacttttcagggcactcccccaatcacctgggcagcattctggccataacaatacttgtctatactcttggatcacataaggaagatcatataatcatatgattgaaaacaacacttaagtgtttttagaatgtggtatactttgttagtcaaatactcaattgggcaccataaattagctaacaaataagcaaatgaactgcaacattaacactgatggttaaaattgccacctgccagatgaagcctccactgagtctccttaaagtctgcttcaaactgagaagccaacattccacagaatgaaagcagtctttgcatgaatatatacacattgtgttagtgtatatacataaaatatgtcgactcctcaacaaaaatgctgtatgtacaggcaacatcagtttgggacataagaatcaaatatttcaacatctttattcaccaaaaccgaggatcagaaacaagactaaatggacctgtagcctatcacaagaaagttcctgaatcaaaagatattgatttcagttgacagactgtctatattataataaaaatattccaacatacttacggaattttgaggattcagtttcattttcatccctcgtatcatctcaaaatctttcagagttctataaaacaggtttatcattacttgttaggacaaaattttaacaattacattatgaaaggactagtttgcttatgttacattccaatattcataagattagatacaattagtagtgcacacataaatcactattaatccaaattttacctaagtgtcatgagaaataacaatatataaagcagcatattactgcgatttctaccttaaaaagcatcatggtggataaatgtctcaagagtactaaagcttggaaaaactagcaatgtcattacaaatatgcaaagcattaatcactaactttaaatcactactttttgctatacctttaaaagagacttaacaaattaactcctagaaaggaattttatcattggctacatttaagatttctagtcatttttcccctttggaaaaactctagctggtcaataattaaataggtatttaatatttgtagaatatgacatgtatattggaattaattcctatatatacctgtaaaatgatgaagctatgcttgctctaaaatctatagctatgtagagaaagactactaacacttaactaagtaaagcaggataaatcctcaataagtgcataactaaccctctttctttattgtatcaaagacacagtggttcaccaggatcattaaaagaaaattttagaatttataaacataatccaaactagagaagaatgagttctaaggcatgagtttatagtccaaaacagaaatgtgagccaagatccaatgtgttggtgtagccacaacaggcaaacaaaattttagacagcattacaagagaaaaagagaaaacatcatccttttttacaaacggtgactgcttcttcctagaatccttagtacctaaaggtgtgctgcctctcaactaaggcctagaagagggccagtgaagggcaagtgtatgatcgaaggcactgagcaggggaggggcaggggaggcaggaatacaggttgagcctccctaatctgaaaatctgaaactttctcagcactgacatgatggtacaagtggaaaattccacatgtgatgtcatgtgataggttgcagccaaaactttgtttcaggcacaaaattattaaaaacactgtataaaattatcttcaggctatgtgtataaggtgtatatgaaacataaatgaatttcgtgtttagacttgggtcccatccccaagatatctcattatgtatatgcaaatattccaaattccccccaaaaaatgaaatccaaaacatgtgtggtcccaagcatttcagataagggacactcaacttgttataacaaacggacacaccaaaggcagtagaacacttcagcttgaaattacaaatgttgagatagaacatccttaaaatactacacaaaattaaaaagacaccacatccatgagcctcctgtatttaggccaaaagaagagaaatactactttatgaacttgtcataaaattcatggtacaagttaaaataaatagtttcaaaaacattttggtaaagatttttaaagtgcaaatgaaagatgaatttctaaaaacaattgtttaatgaaaggggacagcttatgttttcaagaatggcacataaggaagacaactatggccttttaaagtatgtctcatagtgagacaggtctggtccaatatgccaaaacttatattctaggtcacttcctaattttttataaatcaagtcttctttaaaaagactaaataacatataaccaaaaaactaaatagtagaataaaaactaacctttcagaaagtttgtcagatagtttttcaaggaactgcatgacagtctctaaaacgaaatccaaaagaaaatatcttcaattatgtgaaataaaatgaacatatctgttaaaattattatgtgatgatcataatctatatcccacaattcccttaaagtgatgattttcaaagggaagtagagctaccaacatataccaaacatatagtaaatgcttctaggtgatgacgatcttttaatcagaaaaaaattaaattggcatactaataatccacagcgtcagattctatcccaaaattaaaagagttaatgggaccaggtggctcatgcctgtaatcctagtactttgggaggctgagggcagggggtggatcacctgaggtcaggagttcaagaccagcaaggccaacaggctgaaaccccgtctctaccaaaaatacaaaaattagccaggcgtggtggtgcatgcctatagtcccagctacttgggaggctaaggcaggagaatagcttgaacccaggaggtagagactatagtgagcccagactgtgccactgtactccagcctgggcaagaaagtgagactccatctcaaaaaaaaaaaaaaaaagagttaatgggaggctaaagaaaaaagtacaaaatttcaaggtgtttctatctattcatatgtgtaagaaaaaaaagttctgagacatgtctgacgttttcagagttttaaagagatatctagactgctttgttcataaaaataggtgcagtgtagaagtataattccctgaaataaattttttaagatcaatgtttttcttgataacaattttattgttatatacaactgtagaataatctattcaggataaatatgaaaaaaatagcaaaataagaaaaataaatattaacttctgatagaatttttaaagtatttttattaaaatacttctgccatagttgtcataatttacaaacccataaaggcagtgcagtagaattatcaccgtttcccacaagaggaaatgttttgcaagtatttctgaatgtagcactttttatcactgacttatgtgtacagagctttcatatgtattttagttcaccacaaacactatgtttgtattttccagataatcttttatacagttttaagtttcctgccctctcttcaatttaagttatctccttttgagtgaaataaaagactaaggaaataaataatggtggttaacctaaacccaaaccatgaggtttcttgccactgtcaatacttaacaagtcctgtgtatacgaattctgaaaacactggctcatgtgccatatgaaacaacaataggaatttttggggaacaaagacattatttagtcaacaatgaaatctcattttaggattatattccaggtaccataccaaactgttttcaaatgaatccctatgtatgcttgtatacgttttatttcttaataaccgtgttttaacattcacccatcttattcttccagtcattttacatgtgaagaatctgcctcaattaatttttttttttttttgagatggagtcttgctctgttgcccaggctggagtgcagaagtcccatctcggctcactgcaacctctgcctcccagggttcaatcgattctcctgtctcagcttcctgagtagctgggattacaggcacccgccaccgcgcccaattaatttttgtatttttagtagagatggggtttcaccatgttggccaggctgttcttgaactcctgacctcaagtgatctgcctgcctcagcctcccaaagtgctgagattacaggcatgagacaccacatctggcctgcctcaattagtgtccccagagaattgtcatattaagattcagtttgaaaccccccactaagtgcctcaccgcagttacctcctcattcactagccacatgaatgcccgccttagcctcagtcagcctctctgtcttccttctgctctgctgaggactcactccatcactgtgcatgacagtttcatttccctcagggcgccttccacagccacagatgcatctgacaaatgccccgagctcctaaatcccatggcattgttttgtctgtactactccatcgacaccgaaaacgtgccaacctctattattatttatctttttatatgcatatatccagctcctcaactaagctttaaatcctcaaggacccagagcacatcttacgtgatgatgtgcacaacagccccctgccaatacatcagcacaccaagcacttagtgcacaagggtgacctgccagtcacggaatctggagctgggtgctgcaggtccagtgagctccacgctgctacagccagtggtcatgcccagccctcctcacatctgacctggccacagcatgagtcagctgatctctcccctctcctgtagacagaccttctgcgcggcctccaggaccacaccctgtaatcactttccacctcccttagtggccgttacatctggcagcgttaactagcagttcctcacatgcctggcctcttaaacttgaaggccccagagcgcagtccttggacttgttctttaagttcactctcttagtggtatcagaatctcattttagaggttcagacttacatatgaagctcagaactccacactccatctaactgcctacccaacttcaccacttgaacctcatttggtatctcaaacttaacttgaaacaaaccaagtttccggtcctcccaatcttagttaacagtagtaactcactctctttctagttgcttaggtcgaaaatgttggctccctcttccaaatactctgtacccagaatctgatcacatcttaccaccttccctgctaccacctggtcaagatgccaacacttctcatcatggttactgcaaaacagcatctaaacaggccctcttctaccctggccctgctgcagtcttctctcaggaacagcagcactgactcaccattagcactggagtcagatcatctcactcctctgccccaacccccacagtgacctgctgcacttgcatcaagtctctacttaatgccgccccttgtcagtctgttcccacctctcgccactctccttgcacacgctgcgcttcagccactctgccctcctcaaacgtggcaggcatttttctgcctcaagaccttagcacttgatagtgactctgcgtgaaacctttctcccctcaagagccacagcctcatgcttgtgtctgtcaagagcacgctcacattccacattctaagtgagccttccgacaatgctctctaaaactccaacaccagcctacatgcccacataccttatccccttccctgttcagttttctccatggcttgtattaactaataacataccacatactttatctacttatttcgttctttactgttcttcccttgctcccaagaatgtaaactgcataaggataggaattttcttctgctttgtacactgacttatttccctgaccgagaataatatctgacatacagtgggcaatcagtaaatatttgctgaattaataaacaaaagggggatgtagatgatataaaacatagggcattaggtctcaagcagcctgtggaaaaccataaatgtagcatatgtgtttaggcttcagttctgccacattttagcaatataacctaaccttagattccttatctgtgacacgaatacaaatacctacctcacaaagctgcagaggaaggaaatgagataacaacaggataagcactgaatgatattctaatattattattttatataaatataaaataaaaatatggtactattataatcaaactgttgacaacagcgactacagaaaaacatacttttcaccaaactgatacttacaaaaaaagaaaaaacatacactaaaaacacacatttaatacataacatacatattatatctgtttaggagcttcgattatatgaaaaaaaatgtaagtgttttaagggttcggggacaaaggagtccaaggaaagtgaaaaagtttaaccagcttcatgaaagaggtgggttttgagctgagcactaaaaaaacggggtaagattttaacaggcagaccaggaagaaaagctgctctccataggagagtgacacgagcaagggaacccaggccgcaatgagcgtgacacgcctgtagcttaaccgagagccctgacaggtcaagggaaacagttgtttacgaaagagtaagaagtaagattgagtgcatttagagaactttggagaagagaggaacatgctagggtgagaagggataagcacagaaggaataaagacaagcgaggattcaggttgtgatctgcccccagtgtcccctctgtcggtgagtggaatgtctaaccagatgtacaaccagaaacccagggggcccaccacaatgcctcctcctccctctcaccctcactaagtcttgcaacttcactgccaagaccttgagtctcacgcagctccatcatcacggccaccctactcctgactcaccacctaaattacaactgtaagttaataaatgcttctgaaaaaacgtattatgtacatttatattattattgtgtaacattttctcttagacattatgaatcataaggaactcaacatagcacaaggcaagtttatgacaaacccaacgacacacttccgtaacacctcacctagcacaaaccttcctaagcagtactcttctctctgaaaaggaggcttatctgactgtgtgttttttatatgacctaacctacatttaaccttgacctcagtaaacatactgatctttcattctcttacactaattctaaccaatttgtcaaattcagcacagaaactgtgttaaaatgaaaacaatttagactaacatcaaaatgaaaatttaggttatgattttactctcaacattcacataaaataaaattctttggttggacagaattatgccaaattattagctctatttaaaaatggttcctataaaaatacatagaaaatctcaataaatggttctctacatgtattaaaaatagaacactaatttacagctatttaaaatcaaaagctcagtttcataaaaatcctattttgcccttaaatgttggataaacaggcttacctggatttttagctatcgttccttggagagccctgtgagaaaacgtggaataccccaccaactttgccagaagatctctgctgctgagcaattcttctaaacatttcaattgaccagcattgggataaagaaaaattttataagcagcttctcgcacctacgtttaaaaagtaaatggtgaaggctataaatatcatcacacagtcctatgcaacaataacacaggctcatgctcaccacttgatctgcagatgatcactgctttcaaaataaagcaatggtctacacgaggccataaagcttccagagtcataaaatagcatgggatgcaatagcatacttgactgcagctctagggtactgttctgaggtacggtggggcaaacctctacccagtgcgtggatctctatgctataaagcgtcttaaccaggagaagtaaggctgcatgaatttaaaagtctctgtagtctagaatgtcagttaatggtgttattaatcatactttaaaaataaggagtcttgtatgaaatataagtaattaaatcattttcattctttaaagtgtttatggcattaataattccacaagttaaatttttagggcttagtaatgctaaaaagtttttaaggatactattatattatcactgaattttgggttaaaacagtagcaacacacaaatgggacctaaacaacaaagagaatgaaacatacataccaagtcatctggtgattctgcgtggagaccatcaattatgatatgatccccagcagatgtaaagttacgacgaatgtgttctggtaagagatgcttctcaatcttgttgggaaaattggttcccataagaaatgtactactcaaatccaagattttaacattgaggtccactgctcttttacgctgtatgcaggaggagtaaaagttatttaaaggcgttttgaattaatatttcacaatttaataaacaaaatataaatatgtcaaatcaacatatatattgttgaattatcacttaataaaatattagtttagtaaaatgaatatattgttactatattataaataatatattaattttacttttaacagatatttaatattctaacaaaaagatcatacttatggttttctgatgtttctatgttttaagatttacataacttctagttctattttatgtctaggttatataactaattgttgaaattaacaacattgaaaaacacatgccaggtgcagtgactcacgcctgtaatcccagcactttgggaggccaaggagggcagatcacttgaggtcaggggttggagaccagtctggccaacatggtgaaatcccatctctactaaaaatacaaaaattagctgggcgtggtggcacgtgcctataatctcagctactcaagaggctgaggcacgagaatcgctcgaacccaggaggcggaggttgcaatgagccgagatcgcaccactgtactccagcctgtgagacagagggagactctgtctcaaaaaaaaacaaaaaacaaaaaaacagttatttgcaaaagtgtagtgagcctccagaagggggaagcacattttaaaagttctgattttgggtgtggtagcacacgcctgcagtcccagccctatgtggggctgaggcagcaggatcacttgagcccaggaggtaaggcttcagtgagctacgatcacaccactgcaacctgggcaacaaagcgagaccctgtctcaggggggaataaagttctgattttgcatgtgcttgagctgctacagaatgatacagtgaagtctaagaagcagactggaaccccagggcatggtcctttcttctactctgtgtccctgccatgtggcacatggtccttgctcctgccaggccttcaaatggtcagtgatgaggacgtggatggtgcggacacatctgcttaggtttaatcttgcagtcatatctttgtaatacacaataacctgagaaaacgtgtattagcaaaggggttgccataaatgctctaagattaaatataaactagaaaccacataattaggctgactggaggagaagggctgaattttcagttattggctactcaaaaactagacaggctctgcagatgaattttcagttattggttactcaaaaactagacaggctctgcatatgaattttcagttactggttaccaaaaaactagacaggctccgcactgggctcatgttgggcttcaggtgaaagtgtacacaaatctttctgggagaggagatagcaattaacaagttctaaactgttctatgctcctaaaaaatgattaagccacaatactaatatactttttaaagataaacatagatgatgtagaggcatgcttgataagatgctgaaaaaattgagtatatatcaatatccccagaatttcaatatagaaaattcaaatttcatggaaaaaagttttaggagactcccatttccttacagtccagatttctctttgcttattttgtttgatatggccatttatcaccacctaatggtaacaagtggaataacaaaaaagatgaacaagattttgaaatcacattacagttccaaaattgtcttcaaaacttttactttgaaaaaaaaaatgtgataaaattaactactttgaagattttatctactgataaaacctctggaaaaatcaaaactgagttcatgccaacttcaatgatctgccaggcatatcacttcatcattctgtggtaacaatgaaatgtacaataatctgaactcttgaaaaattctatgaaatttctgtgttattaaataatgttaaaaataaacatttctattacatttaaacttataagttatatttgtatgagaccttaaaaattaaggccgggtgcagtggctcacgcctataatcccagaactttgggaggctgaggcaggtggatcacctgaggtcgggagttcgagaccagcctgaccaacatggagaaaccccgtctctaccaaaaatacaaaattagctgggcgtggtggcacatgcctgtaatcccagctactcaggaggctgaggcagaagaatcgcttgaacccgggaggcggaggttgcggtgagccaagattgcccaattgcactccagcctgggaaacaagagtgaaactctgtctcaaaaaataataataataataaataaataagaaaccaactggaaagaacataggctttgatgatttatagattttgttggtgggtttatttcatggtctctcttttgaaaaatggaacatgtctactttatatcctgtcctagtggagcacctctgagaacaaacatggaagttacaagggaaaaactgagcaggtttactttagttgcatattcaatattgaggggttccctgggagctgctcccggggaaagaggagctacactgtaatcatatgttagataaaagcggcaatgtctatgctggtgaaactgaacatatactatttgtcagcaaaatttcaaaagcacccttcataaggatacattaaaactattcacatggattctctactagcaaccttccttctgaagatatcaaacttgatgatagctagcattatcatgatttgtcatacattcactcaatacttttactgagtccaaaactaatatgcattaaaaaacatgatccacgttcttgatcctttgtaagcctagaagttagataagcaacacaacaataacagcatcatcatcaacaaaaggtaaagaagaatgccacatgactgaaataagtaaaatacgttcggatgaatacaaaattccacctgggggactgataaaagcttcgcaatgtggcgtgaggatgaagccttcatggggacttcagccagggaaacctggtgagcaggcctaggaggaggacagcaaacacatgggggaggacactgtgtatgaggggctgacagccggagcacagccacgagtgtgagctctttgttacatgttaacttcactagacaatgggaagtccacaggaggattctgggcaggaaagtaacaaatcaatactttatgaaaactaatccagtgttcacagacggggaagactgaccagcaggatggtgacatgctggccatggaggctctggagtctgtctggcttacaaaataacgtcccacaacctctacagccttggtctaaaaaaagccaggaataatagtagcaccaagctcaaaattgttgtgaggatttgatgagaaatatatgatttaaagtagcaaatactcagttgatgttaaatcactgttaggaagacagaggcctttagaacagcccgggtgtttggtgataagaatcaaggtgatttgcttttgggatgcagacagatgcaggactgtaggaacaatgcaaggacttggttagaagatatgacaatattaggaagggaaagaatacaactaactcccaaattttattttacagagaagtattaatgaagaattgatgtggaaagcggcaaacgtggtcaccttaggcaatgtgagtttacagtagagcccataagcctcatgggctgctgggaaggcacgtcctggctcagggtcagaccaggaatcacatgctgaacctttaatgccacacaaacacatcagatgtgtgaggggttacagcattactcaaactcagcacctatcaaaatggtaacatctattgtatgtgatacatatttccaaggccctgccttctgcttttccagatattttgataacttaatctcttcataggtaagtggtttaattctaccatatttactaggaaaaatgtattactgtttaaaacaaataaacaaaaagccataatagtctagactgcaggtgagtgggggagactgtggggcaggctgaacttccaatggtgtcaagtccctcctgttcttccaactctgaatttacaactgaaatgaggcacttggtttctcaggatgttatgtgctagaaagaacagtggccagtgttagaaattttaagaacactggccatttgttagttaggatggcaacttgaacaaatcactttgtcttgtttccacatctgtaaaatgaaggggatggactaggtagaaggcctccatcccagtgtaaacactgtgtaatctatgcttgttccatcagtcaaacacacgtataatataaataaatacacttatgtaaggtcttatgtgatattccctgtactaccaatcttcaatgacatcagctttcccattcacttgccagtctttcctgatattgcctatctcatcctaattccatgattatctaaaacactccacttggctcaagcctgtcttaattctgaattatcatggtgtgataggtcaacttccagagaggggactatattcaaatacaatctaaagaagaatttcataacagataaaagacctgcacgtttttgcaatatgcaaattcaagcaatatatacaaggactgtagcaataatggtatcaactaaatgttagtaaaactggaagagtcaaaaaaacagcagaaagatgtaccttttctttgtctagatggattccactaatttcaaaatcaaacataaacagttcagccactcgcctataaatgaaatgagccccaggttataacaggtaataaaaattgctaacaaaaaaattgtggttttttgttaaataaataagtctttttcagcctcactgccaaaagtttcttcaaaacacacacacacacacacacacacacacacacacactttgttttaaacaaggagcttaatatcctcagatattaaggcaaacatcaggcaaaacacctatctgactgacaattatgattggcttgtcatgtaagagcttattcctttattcagagagtacaaacctgtgaaagccacaggtttgtactaaataataataataattttatttagtacacaggtttgtaataaataatttagtaccacaggtttgtaataaataattatttatttcaactcaatccaaatcccaataattaaaaacataaaacagttttatatttggacaatttttcaaaggccctctgcatgagatttttagtttttcttctagccagtagcagctatttagaatattaaattctttgatgctgtgctggaagctgagtttcttggctaatgagaattgttttctttctttttactcctgcttcatgcttggaaccaatttcaagtgtaacacctttttttttttgtcaatggtattttttttaaaaaaaaccaacaacattgaatggaaataatcaaatatttgatctactcttttggctttccttgagttttcaaaatagatatatttaccttcctgattattacatcaaatataccttgaatggaaatttatagtgtacgtttatcgtattacacaatataggtctattatgtaacaaaactaatgcagaaacatatgaaacatttaaaatcactaatcctatcaaagataatgactattaaaattcttgtatttcctttcaatctacttttaatgttatattatatatttagaataattaaggcccaactgtatatacttttgtatcttgctctttcttgtaaaattatatcacaaacattgaacagttctccatgtctttaaacgttcttcaaaaagttggcttttgatgcttgttttgtgttgttatatagactgcaaatgtttttactctcccactcccatgaaccacaatataataaaaatccttgttacagtttttaatccttgtttgtttccttaggataaattccaagaaattaatcacaaagtatgcacattgatatatattaccaaatgctcctccatgaagtcttatcaatttacccgtaactagagaggatccatcatcccaaaccagaactactattcttattctgtttcaactttgtcagctgctggctgacaaaaagttttgcttcattctatctttccttaatggtggtgggtctcatgccaggtacagagcagagcactttacacaaattatttcccttacatctcatatgattcttatgaagtactttttatttccgttttacaaaggagaaaactagggtttagtgagccctgaagccaaagtccaaccccgcagttccattctagagatgcagttccacccacttcacacttggtgccactgttacagctgtggcacactgctatcaatttaagggccatctgttgctatgccttattttgtgaaatgagagtttcacaaacagaatcttttgcccatttttctataaggggggtttttgttcttctttttttaaagtaatttgaaaggtctcttaacatagataatatattaactctttgtcatatcagaaccatttgtcaacatttgtgtgttctgactttgaatgtggaagcgttttgccttaccaaagtttgcaatgtttatataataaaaatcaatgaatctttctgttgtatgagtttgtatcatgccaagaaagaccttccatatcccaagattaccagtagttttataatttcttttaaaaatatttaaatctttaatcaatctacttttttaccccaaatggttatccattggtctaacatcatttcctgaaaaccaagtctttccctactgatgtgaaatgacacttttatcacataccaaatagtcttactgtttatgtatctgtgtctgtgtctaaaatttctctattcttccattgatctaattgactattctggcatttttaagtataacgctctttaaatacagcatttttatatgttctactatctggtataagtccctttttagtacttttccttacgagagttttcctgcctattctggcatatttattctctatgacttcaaaatcattttaagtaacaataaaaaaattctttataaattggatagcattaaacttatagtaataaacattactgagctttcttcttccttaagaatacagcatgtttctccatttcggtcgcttgcatgcttcctaggtgttgtgtatgttgcggttctgcactctaccttcccaagttcattccaacgtgtgttacagctttggctgttcttgcaactagaattttccctccattatattttctggagaatgtgcttattatagtctttgcatacatgaaagctcttaatggctttggaaaaaccccaagttaaacaggtttctttatggcctggcttctcagagactctaaactactaaaattcttcaagcagggaaatacattgatacatcagatttccaaacttactgactgaaggaaccattctgagaaaagttctgaacatctcagagactagtatttcaaggactgaatctaagaataacatgatgagttactcaatttaaatcattccctctgtacattaacttacaagactttattaaatctttaattctttgttttagccactgtcttatattttgccatatgcatggttctaaaatatagttctttctgggtgctagccaacactcaatgatatctaagtgccacgatactgcaataattattacttcaaattcttcttctctcctacttccaagttgcttttcttttctagactgttgatattctacccagtttattttccccaatatatttatcattttattatttaaaaatccctattggcatttttaataatatctagaaatgtggtatgtatcctatcactacaagtcctttctatctaaaatggtctgctagcccactacaattctttatacacaaacaggggcatgtcgatcttcagtaaatagagattatgaataaccttctatttttaacattgtttgttgttatgtaaagtcagtaccagttccgtataaatctggcacaattaataggcattcgacttttccttgctttgctaatgaaagcaatataacgataaagcttaaactactgtgatgacacagctagcttcactagtgtcctgagcatcaggactgataaagtgaaacaccactaggtacctgcatacctgccaggcagatgaaaataacccctcaaagactgagttactcacataccatgctgctcatgtattagattaacagcaaactggatgatcaattggtccctatagaaaatggcttcatttggggtcaataagccacatatggagacaaaatagaaggaaacaggatcagaaagaatcaagttgtcagaggaagtgtcccaccaacaaaacgtagataaacaggaacaaacaaatgagaaaaaaaattaatctgtgttatgacatacatattataagcaggttaaggacaaaccctactccactcacaattgcatttgagcaaagaaataagatatctaggttcctatatcaaatattctaacatgttgatttaaaagtaaggcctttttgatgcagatttataaatgtagcctaatgaaccaaagcaaatcattacaaggatcttgacatcctcccagtagataaaatcgatttgcttacattttctgatagtatcaattatggaactttgagcataaagctaagtgtaattattaactgtctacaggagtccactcattagttgagcactgaccacatgccatgaatgtgtaggtactgaggatgcagctgggaacaaaacagaccaagccctaccctcaaggagcttgcagtctggtgagatagatgatagacaaataaacaaacaggatacgttggaaggaacgagggctatgaagaaaaataaatcaggatcagagggtagagtctgaccctgtgcaaagattttggaggagacaccatttgagtggagtcctagagaaagtgcaggagtcatagagatacctggggaggaacattccagacaacagaggctgcaagtacagaggccctgagggagagtctcccaacctcacctctagagtcacagtcacaatcaaggcaaagaaatgagtgagtaccttgtttctggatcaagggaatccacaagttttttatcagctagtaatttttgcaaactttgatataaatccacatttgtgttcaacctagaaaaaatagaaatttaaaaaattagatgattttctaataccttatttttaactttacatgaaaagaatggtgtcagcttgtaccacacacatgcccagaagctgaacagcataacctaccaggaacagtgtaaccatccttccttccttctttccttcccttctttctttctttcccttattttggagacagggtctcactctgtcacccagcacccaggctggaatgcagtggcacaatcacagctcactgcagcctcaatcttctgggctcaagtgatccttccacctcagcctcccaagcagttgggactacaggcatacaccaccacgcccagctaatttttaaatttaaaaacactgtaagggagagctcaggacacaggcttcagagccacccaactgggatgcaagactggccttgttactgctgtgggaccttggacacgttatttagactttaggctgccgtgaggattaaatgagatcatgtgtgcagcacacatttcctatgtgaatgaaccatggccactgttgagcagttgtgccatccagagagcaaagggcccaatgctgggcagtggtcccaacccaccccatagtaccactagcaggaacccagtcctcttccctaaatgcaaatgccatggccccctcaaaactaaatagtgagctgggtctagatacaatctgcaccctgctgggtaggtcttcaaggagggataaggttgtaagaaccactcaccagtcgctactcagagactcaaggatactcctgttcctcagttggttcacaaaaaaacacttaagatttatatgaatcgaagggtttctgctaccattctcatgggccttcccaaatactagtgaaacgtagatagtcattacccatcaaaaaaacactcaccaagaagggccagactcccacacacggatcccagaagtcagggagagagtgagtgtggaggcctacctcctcccaacctgctcacccacggagccactccatggcaaaggaacagtagctcagaggctgcccgcactgcccccactgcagaggtttaaggaaatctcccagtagtatgttttatgttggaagaccctgagataaagcccatacttcagtctgtatttgtcctccgacaaaatgaagagtgcttgtccatgagaccagcccacgtctaattcggcaggacacagcatgcagagagcctcgagcaggcagcccactgctgactccttcccaggggcctttccccgagaggcaaagctttctcccagggagtccccactttcagccctgtcagcatgcccagtatctgcactctgcagggccccgttctgtcccattacgcaagttggttttcagcggctatgggaaaagtcacacacgattgtgccaaagtgaacaaatgttggcgacctggggaaaagcagcagctgcacatcttgaagtgttgggtcttccaaggaagcctcgtctaaccagagaagccatcactctcctcctccaacaatttctggcatatgaaattgtcttatcgtgttacccccttttccctgttgtaaatccacgctggcgagcccagggctctccctagctctatacactgcctggcatggtgccatgcagctaagtgtgttggaatacagcgctgtccaccattcagttattttaacaagcattatggagctcttataagtggcttaaaaatactcacatttaccccaaaatcactttaaaataattcactctatcacagcctcagccagagcatgctccagccctcccacagacttttacagcctccctagactcccctaattccaactcaacagggaccacaaggacactgtttatagagcattttggcttctcgccccgtggcccacagccattgatgcaacagcaatttaatcaagcgataatctagtaagtccaacttgccactaggacactaaaaagcccttatttaaggtaagtgataatggtgatgacaagaatcctgggtgtctgtcatctcagattatcaagtgacacctttacattgatctcatttaacactcacaaggaccctgaggcagggttaacttttcgaccccatttacagacaaggaaatgactgagagaacagacaaccagccctaaggcccagtgcctgcctgcgaggtgagccaatggcctgtcctgagccctccctccggccacccctggtcacacacacctcccaccctgctgggtgagggacaagcgctatggacaaaactgcctacggcacaagtccatgaaaccggatcacccaggacttggcatggaggtggggaggggaacagcacatacttctctaccatggtgccaatacttctacaagcttcttccgcagcttctctgaatgctggctcagggtgagcgattttcacaaaatcagcctaataaaggggaaagacaaaaccaaaagggaatttgatgagaagctttcttccaggatctgagggtgaaaatgaaaactgggttttaagatgtgccattggcttgccctatgcatttccattactgactttttcctaagcgagtaaagcaaagcagcttctttctgaacatttaattctgttattccttgaaaccaagtttgtttcactccaaaaaaagacttttattatttcagaaaagtttttctctttcaaatataaacaccaagcaaattctttctttcttttttttttttttttgagacggagtcttgctccgtcgcccaggctggagtgcattggcgcaatctcaggtcactgcaagctccgcctctcgggttcacgccattctcctgtctcagcctcccacgtagctgtgactacaggtgcccaccaccacgccctctaattctttatttcaaaagagcagacactggtttcaaatattctacaactttctggctaaaattctttgcagtatggttttcacatgttaacttatctccagaaaacaactcttaaaggcttttttttttaactgacacatagtatagtttcaaaacccatttaactacattctagtctttgatttaactacatggtagtctttgtgcagaaaacaaaggcacggtctcttcatagtcctttcaataaaatatgagttcgtagtctccatgtaatactgtatacagctactactgctgctgctacttaagtcattagacattaaaatgagtgacagttcttttttaaaaagataaaatgatgtaaaactaaatttttgttttcatgtcaactgtaacaaaaagcagagaaactacaaaacactacatattttatttgccaagaaaatgtgactataacatgaaataaaatcaccacaagataaaatttcttaattttattatcaaatagtttttaatgccaaaacatttaaatccatagtttggtatatttgttgtaacaattggtaacgataaaataacattagtaccaaagtacctgaaaaatgagttatgtaaatttacaacattttttttttacaaattactaatctacgggttgtgaatttataatcaatattaaaattcaaaacactagcatacatattaaaaactgatttgtaatagtgatgaggaaaacagttgttacataaaaactgtattaaaaaagaaaacaaaataaaatgactatttggtgaaaaacagtttataaaacgattgccttataacagtactaatctcactggcaggtaatatcttaaaaattcagatatttttaagatattaaaaattcagataatcttactggcaggtaatatcttaaaaattcagaacagagaaaggttcttttatacccagagaactacatatacaaatcacatcttttttttttaagttttcaaaatgagatattattatacatgataaatactaaaaatgtcaaaataagatatagcgcagagaagttaaaatcttttagtgaagatcaaaagcaaaaatgtagaaaaaaatcctagaatactgattaagatgaagactaagacaacaaatacacagtgaattctgggatttgtgacagccacgccaagtcacccctcagtatcaatggacaatggtttgatcctcccacagatacccgaatccacagatgctcaagtctctgatataaaatggtgtagtacttgcatataaccgacacacagcacaccccatacatcaaatcatatctagattacttgtaatacctaatgaatgtaaacaatatgtaaatagctgatacactgtattgttttatggaacagtgacaagaaaagaaagtctgtacatgttcagtatgaatgcaaattttttttccaaatatttttgatccaaggttggttgactccacagatcccccaatctggagggttgacgatacagtgaaattcactgacacagattttccttttctgatttctgtgacacaattaggtgaacagggtatgaaacctccttttggcagtgcgtttccacagcttccccatcattcaaagacacatttcctatgcacatactggaggcacagaacaaaaacccagtacaacagaactactcagagcctgcaacttcactccagggaaaaaccctttacagtaagatactttatcagttttcttaagagcgggaggcttgtggtgaacatataatcatctgaaaggtgttaatgctcaaatcagttgtatgggtggaaggaaattttccaaaaaaggaaaaaaaataaagatggggatgagttatgctgggtgaaagaagtcagtcaaaggtatacaggattccacctatgtgacattctagaaaaggcaaaactatagggagagagaacagattagtggttgccagaggttagtggggaggggggggtgtgactacagggagatttttgggggtggatggaacagctttgtatcctgattgtggtgagggctgcacaaatttatacgagttaaaattcatagaactgtaccatcctccaaaagaagtcaattttacagaataataattttaaaaacaagtatacattttttttaaagatggagaggctaacaaactttgcaacctttccaggtaaggattcatgagacctgagcagccagccagccctgaaatggttggaacaggagaaagaagaagagctcgacagataccctgcctgggctggcagcccagctgcaccacacgctggccagctgacagcgggcacatcccttcatcacccagtgcctttcttccctcttgtgaaaatggagatatgctgagaaggttacctcagctcatccagggaaagcttcttcagctaactaggctgtagaaagggcctacagtctagttaaatttccaaaaacaagttaatgccagaatataaactccatgaagtaacagattgtgtctgtttcattcctgcatgtatccctcatgcctagacagtgtctggcacacagtacgtgctcaacattgactgaatgtgagggaaaaacctatgcagttctataccatgtagacaggatcataaatgatcactatttaaattgtgtgtgctgctttccttgacaagagtaaccaagagtcagctccttcaagctgataggaaaccctgcttcctggaaatgagtatatcgaagagatatctgcacttccatgtttgctgcagctctgttcacaacatccaagatgagaaagcaacccaactgtccatgaacagatgaatggataaagaaagtatggtacttacacacaatggaatgctattcagccataaaaaagaatgagattatgtcattttcaacaacatggatggtcattatgtttagtgaaataagtcaggcacagaaagacaaacatcacatgttctcactcacttgtgggacctaaaaatagatacaactgaatcatggaaataaagagtagaaggatggttaccagaggctaggtagggtagcagggtggcatgggggaggtggggatggttaatggctacaaaaaaacaggaagattgagtaagacctactattcgatagcacaacagggtgactacagtcaataataatttaattgtagattttaaaataaccagaagagtataattggattgtttgtaacagaaaggataaatgcttgaggggatggataccccattttccctgatgtaattactatgcattgcatgcctctatcaaaacatctcatgtacctcatgaatatatacatgtacccacaaaaattaaaaataaaaaaaaaagaaaattttgctatctcagcaatggatttcctagttgctgaagagatctaggtatacacttctatttcaaatttaaaatgttaaaaaaaaaaagtctttacaatcattttgatgtcaaaacttggtttttaattaaaaaaaaaaaagcattcctgaaaaggtttattaaaactggttttcacacctcttatgaaaaagaagtggctcacacttataatcccagcactttgggaggccgaggcaggaggttcacttggggctaggagttcaagatcagcccgggcaacacagggagaccctgtctctattaaaaaaaaaaaaaaaagaaaaaggggaattttgttgtaaatgtacacataaagtgttcttagaattttgggagacactttcataaatgaagaatctctgtcaaatgaatatatatgtaaatatatattacccaaatatagcaaatatttgctatattagtattcattcattatatattacatgtatattttattaaacatacgtattaaagtacaagttctaaatatcaccttttcctataatattttcccattcctaatgacatatttcatcataaaaaattatacccaatggatctcagtttcagacatttttaactttataatctaatattaatagtaaacaacaaaggataaatttcacttaaattttaacaagttgaaagagaggtagcttcaagtctgaggtaaagcaccttaccaagtcggccactctgcataaggaatccgagagctcatcgaagatcagcacggtctggggcccaggtggggtggaacatgcacggtccacaagcaattctgtctttctcaaggctttttcttgtgcaatatgaaatccttctggggcactcagctcaggaactccaaaaagacccttagaaccaaagaatacgtctgatttataaccaaaattcaaaattgtgctttttttatatttactaaaattacttttatcacaaaggagatcttgactttcattggtgtatcatgttatacctgtgatcacagataccactatcatactccccatatcactccacataaattacactaaaaatgttttcagaacataatttttcttcaatttttaattattttccggaaaaaacaacaacaacaatggtatgggttcaaaatccagctgtcacttctacagaacctaagagtggccgcaaagattaaatgagatcatatatgtaaatatatatatatatatacataaagcagtgtttggcacagagcatttatagatgttagccataattattattagcttataaccctggtcatgttatttctcctcctaggagaaatatttttttcatcatgtacaatgggaatgacgatacataccttacagcatggatacaggtaataagtatatgtaaagtactaacagcagcagctgacaaggtgagatctcagtacatagtaccaattattctataactatcaaatagggaggatgagttgactatgaagcaatagatattttagaaaaatgtaatgaacatattaaaatcataggctgaaactgggagcaaattttatacgttacaaagacatttcaatatcttgataaaaacaaaaatcactgatctaatggtaatgaccattctcttgttacctattcaatcacacttgttagcacactcaggaaggcagggggaaaaagcatttaatatgcacctactgcataccatgaagtgtgcctgctactttacataggttctcatttaaatcacacaatcctacagaacagagtatcattcttttacagatcaggccacatgctttaagacgttagaaaaaacttgtttgaggtcacaaattaatattgggaaagacagaactcgaacccgctctgtacatctgtaaagcccacacttttccatacttctctattacaatttatctgtttgaaagtcttctctcctgaaaaggtgagcttccagacccaagagccctgcccttcatttctttaaccagctatccaatagaatgtctaacacatgggggaactcaatgaaagaaacaagtgaccggagcagatgctaggctttgttaattcactttgtaggtgcttaacgcatagattttcagaaatacgaacaggtaaaccttcaggcctgacaagccctactgtttctacaagaagggatggatgaagttaagctagtaatctctcttcaaaatatattacaagataaaaaataaaataaaagaaagtcagtgggagacaaaggaaaatcaggaccaaaaacaaatgtcatctttatactgatttaatttgattcaagcacagactacttccacttcccagtacaacctgcccatattgctctcgggaattctaactatcggattaccagtgaccataatgctaaaaaactgaataaggctttttttttttcaaggcaaaaatcaattctaaaatttgaaaatctgctatcagtgccgaatatcatgatacaaaaagggaaaaataaaagctaaaattagttatatctcatccacccaaaatcaggcttcccctcacgtctttctgctcagcgcctacaagtaggtctcttcacaccaactatgttaataccaacactacatacccttaaggaaggtggtgtagcaaatttcacacaaaataatttttaaatagacaaaactgataatggagataaaacaagaatcacacactttagctcagtgcaacaataccctagacttgtctttataaggcaatacagtataacgaaattttaaaaggcaaaaataaaagtaatccttaacctaaaacggacaaaatgtacaaactccaagtagaacaggcatcaggtaagtcctttccaaccttgccttcctctcacctttcactagacaacgcaggctagtgacttcctggggtaagaaatcaaagtgaccaattccatggcactatgggaagtgagactcgtctcaacagagttttgtgttttaaaacaagaaagcccaaagctttgaaataaattaattaatagatgatggaatttcaggtattaatgaaattaccattactcgactgcaggcagccgtgtccttgcaaaaagaccatgtgatgccgcctgtgaacgcacagggataggcctcttaaggcaggactgtagcgctggagctaaagggctttagcaggggtgcgcctgagtgtatgcagagggcgggtcctggcaggacgaattcaccgccactgccagaacgaactattcagattcacgtggagcaaggggctcatgcagaagcagttcccggacccgacactctgggtaggagaccactaaacccggcccctcaaagcagaggtgaccttgccctcatcgagagcgcacacaagacgccactgtaaaaggtgggttcgctgctcgcctcctcccaggcccaaacaatctcgccctgattgttgctggccgcgcggagcaggggtcggcttagctcggggactgaggggagctcctcctgcgccgctcacccggcgctcgccgaacaggtccaagcggctgccctggggcttgacattgaaggcggcgcccacgggagaccagctggtgctgacccttcgggcccggatcccggcttcgaggcttccccggcccgcccggcggggcggcagagctgctgctctggctcccaagccgcccagccttccgacgcacagcattctagcaccagagcagtcccttcctccaacgcagatccctgccctgctgctttcgctgggagcgcgcgctccgcgtttccaaggcagcagcccacgccgccccacgtgacggccccgcttccgggtctgggcgcggcctcaggacgtgggcacgttgtcgtccagagagcaagagcgtcgctccccctcgccttctcggccgccctcccggtttaccgccccctgtgtccagagtaagaaaaggctagggttgcgcttccctcccaagttgactaggggtgggcgcgagtaaaatcatgacatattcgaattccagtggacattagatattctttgagagacggcaggtacttgagtaaacaagaaatgcccaccataggcctgaaggagaagtttcccttttaacctactctcttggtaaatttatcctgcacttctctgtttggtgtctctgtccggtaactttttactcttgcatagctcagttaaaaattttagatgggaaatagtgaaagaagtctaatgggattttccctccagggtttcagaattgcctgggacccgtgaacccttttttccttcccctttctctcttttggaatggattgtctaccctatgcctgtctccccctccaacccccggtcttttagaagtggattaactcgtctcgcttcacaggatcacagatggagagacattttgccacacgatgaatcacacagtaagtctcctctgtagcttatttaaatgatgtagatggtgagaggagttgatgcggaaagtgttaagacttttggtaatgttgacatggtgcgaaaatgtattttgcacatgagaaggaaatcaattttgggaaccagagggcagattgggttgaactgtgtctcccaaaatagatgctgaagtcctaaccctcggtgcctgtacatgtgaccttatttgaaaatatggagtttgcaattatgattaagatgggtcatactagattagggaagctgttcttgtaagaagaggaaaatttggctgatacaggaggaggacagccacctgaagatggaggcggggactggagtgatgctgccaccagctgccagaagctggaagcagcaaggctgcatcctcctgtatcccctttggagggaggatggccctgctgctacggtgatctcaaacttccagcctacagaactgtgagaaagtccgtttctgttgtttaaagactcccagtttgtgtactttattagggcgatcctagaaaacaagtagagattcatgtctggcaaataatgatcaaacaatgatttgttggatagaatggtgattaaaacctaggttagaaaatgagcaaaatgggagggaaagcaccaggacaaatagctaatgcatgcagggcttaatacctgcataggtgatgggttgacagatgcagcaaaccaccacagcacatttttatgtaacaaacctgcacgttctgcatatgtattccagaacttaaaaatacattttttaaaaaaagacaaaatgagcagtgtctacagctttctggagtgtgacagcatcaccagcttaaagctgttactagtactaaatggaataaacatttccctctaatttccccttaatgtcctcagaaacacagatgagggatacatcttcatatgactcctcagagcactaaaatgatatcaaaacactcttcccacaagaaatgcacagacaaaggattcttcagataataggaataagaaatgtgaaataaattagaataaaccatgcagctattttaaatatttactcctggaaaaatagtaagttacatagaatcagttttgggaataacttttccgttttcacctttttatgattattgtaataattggaggaattaataaagtaaaaccatctgaataagttcatcccaagctgattctgatggatggtctggcagatttataaactctcctctgtcactggctgctgaacagaaggaaccctgtgaaagttgtgtcatcgtcctcatcagcaaacaagccattgaacctctctcctcctgtcacctgcagccacatctcatccccgagcttcagctgcaggacaatgctgccagaggcctggtcctcagagctcacgtaagcatctctggtgtgcagtatttttactccgtttttgaccaaagacacctgaacattcctggagaaaacagtgatgtggtaggtgaagtaatagaccccagcaatgtggcacgtgaatttccccactgctgtatcataatggttgaattcattatacaggatcttatcaaatttaatgggcacatctgaagaaggaaacttgctcagcaccgtgagccccacagtgaaagcactttttggcaagactagagtctcaccgattttccctttctctcctcgatctcctttccagcctcttattccccggactcctggctcaccctggggccccgtgggtccagcttctcccttgggaccaggctttccaatagggcccatggggcccggtaaaccagttgggcccaaaggcccaatgttgccccttggcccctcaggaccagtgggacccacgtcacccttattccccttctgcccctgaggcccagtctctcctcggaggcctttctctcccatgggccctgcaagccccttggggccatgttttcctggggatcctcttgagccttgatcacctttgatgccttttgcttcaacttttccatctgctcctaaatagagaaagagcaaataaagagatagtttgtgaaagattcccttgtgaacaactttggtttttctataattgagctcacaaatgaaacaaagtagtacacaggttcagtatatgcccagagtttaaaattcaattactccatctgggtgcggtggctcacacctgtaatcctagcaccttgggagaccgcggcaggaggactgcctgaggccaagagttcaagaccatcccggccaacatagcaattccctgactctaaaaaaataaaaataataaaaaaataagaaaataaaattcaattactccagcccagctcagtggcttatgcctgtaatcctagcactttgggaggccaagagaggcagactacttgagtccaggaattcaagatcaggctaggcaacatggcaaaacctcatctctgcaaaaagtacaaaaattaaccaggtgcggtggcacacaattgtagtcccagatattcaggaggctgaggtgggaggatggcttgagcccaggaggctgaggctgcagtgatccgtgatcaaaccactgcactccagcctgggcaacagagtgagaccctgtctcaaaaaaataaataaaagtcaattactccaattacacacgtgtgtgcacatggacacacacacacacatcccaacacaccttttgactactgtctactaaattagtgtcagggctcacattagaaattacaaccctaccatctaagtctaccatgctggctattaaataatgtcaatccatgacaaaaagcactctgcagagcagagacagacagattaactgacactcaaccctagtcgtgacatcctctaaaaacctcctccctggagtgaacataaaataaagcctgcatcgaggcattgccctctcctgcccaaccccagccccaacccacctatcccaccggcaattcatcatctacagaaaccttgctgcttccttgcacccccacccataccaaagagccgtcgttgcaagtgtggactctgaggctaagtgccaggtttccattctgtccccatatgcacacaggacgtcagacgagctagtgagcctcgtgcctctgttccctcacctacggaactggggtgataaaactacctagtgtctggggatgttgcatttggtgagtcagtacatgaaaagcacaaagtgaagattacacaagtttgccactacgactacatcccaacccatcagggaccagttctagtgccacctcctccatgcagtgctgccagatgcaccaagtcaaaaactcagtctcactcctcagtgctcatccactgcaaggttcaaagttcagcaaactacagccacaggccaaattcagcctccctcccgcaagcaaaacaaacatggttgacattttttttgtttttctggtttttgtttgtgacagggtcactcactctgttacccaggctggagtgcagtgatgagatcatggctcatggcagcctcaaactcccaggctcaagtgatcctcccatctcagcctcctgagtagctgggactacaggcatgtgccaccatgcctggctagtttttttatttgtatagacaaagtcttactatgttgcccagggtggtctggaactcctaggttcaagcgattctcttacctgggcctcccaaagtgttgggattacaggtgtgaggcatggtgctcggccatggtttgcatgtttaaatggtcacaaataatattccacaatacatggaaaccatgggaaattcccatttcagtcttcacacatatggtgtcactggaacagagccatgcttatttatggagcatctacagcttcttttcactacaaggggaagttgagtagtggtgacagatctgtgtggagttgagaatatttactacccagccctctgcaaagcctgccaatccctgcagaatccccccatctggagagtaagaactgtgttgcctttattataagattataatcagcatggaggacttgtccatggtaatattgttaaatagtcgacagctcagaattagagcaccataaataggaactactaacctcgttctcccttctctccactcgtcccatccttccccgggctgccaggacatcctggttctcctaggtggaaaagcagaaaacaggcatgagttgaaattccatttctgatttttctggccattggtctccatcagccatgtgttggagagtctgggggtgacccccgccctgacgggcactctgtcctccacacgagcgcaggtggagagaggcaggcatgagcgggcatctggggtgctgagctgcgtgggataagtgacctaagaaatgaactgagtgacttcccaagcgcccatctctaggacgtgcctagagcgcacagcaagacaggacgaagagggagtgtgtgcaatggggactgactgtcacaattgattgtgttcctctcctgcgacaaggacttgggacgtggtctgaatgttggaggtgcgaggaggtttcctcactctgtttctcttccattactcttgaggagagtggaatggaagatttactaggctcctatgaaaacacagatgactatggttacgtgacactatcccaagatagaagagagagttctggagggatccctctagtgccttacactgggggaaatgctactaatcgagctggcagagaacatcaggtgagtggggctctgctgactacactcaagtccttgtgctcagaacaggcccccctgagctccaggtcggcgtgctatccgtcagcgggttgaaggtggctctggctatggcagtagagtgctcattgggccacagctcaccccagactctggcttctcacaaagcagcagagactcccatacttcagacccactgacgtggctgtggggcgacaggcgcaggctgggccggcttgcaggtcctgagacaggactgacacaggcagacttatttctgtcacgatgtctgttctcctgggacaccagcgctcctgagtggggccttggtcagcgtgggacctctgaatggagggggcttatccctacatttgcccctccctgcgctccccttccctcccctctactggctgctcccctgtgtcttcctctccttccctctttttgttcccctgcttggctctcgtttctcccattctctagagcagtggcctctgagctttcatgatcacgcaccacaactcacaaagcatgaacacagaccccaatcagtagacatttatatgtttctacattatgcacaggtagtatatgaaaaatatgtttggtataaaacatacacaaaaatacactttaagatggtaagataaaaatgaagtaaatttttagtgtgagcaatgtgattgaatgtccttctaagaaagaatatatattacaaataatacttatgaattacatagaaaaaatagatataacatttgcttctaagaagtatgtaaaacttgaaagaatggacattggtgagcagaggagagaaattcaacacggaagaggtagagaaatttggtattgaatatagaagtgtttgtcttagttctctgtattttgtatcacctatttatctccttttatgtgtaatattttataacaaaaatttaaaaaatgaaaatcctaaacattcagaaataaaatacacacagacacagacatacacacacacacacacacacacacacacaccactgtggtcacagtgtgagggcagaagacctgatttcattaagggtaaggttttagtattcatttggactgggctatttgctaccgggggactggaacagtctcaatgagctggagatgtgaggagccaggagaagacacctcacagagcagatgtgccggttagaaagaaataaagttgcttcctggtgacccttggcttcatccagcccattcaaaaaactatcaggccaccaaatgccataaagtgagacatgttagaaacacaaacttatttgtaaaaaggtccatagaagttttgatattttctttctaatgccactgaactgtgctcttaacccagtgaatcattctgcataagtcttagatatgtgaccctatggtcaagaccaggcctcaagaatggtaccccattcagaaaccaagtctattggttgttgttatggaaagcactcagacttccaggctttggcaaatctccctcccagaggatggattctgtccccagatccccagaccctgcctaggtcatagattcataagcagcagctgtatgtgtcatctgtcactccgcatctcctgcttcatgacatgatatggtattagctctcacctgcactgcagctgggtgcttgctgccaaataattcatgatcagatctctctattggcctcgtgttgccaaaaatccaacatacctgtcacctgaggtgggaggatccatgacattgtatactactgaaaatgtcctgcggtgtcagagatgagagaacccaggagggcaggggtcatggcgatctggccctgtgctctccaccagcacctggcacagagtctggcatggagcagaccccgtgagtgttgctgggcagatgggtggatggatgaatggggtcaggctccagtgaatgttgctgggtggatggatggatgggttgtgagtgggtaggtggaaaaccacacagatgatgagtgaatgagatgaaagtaatgaagagagaagctcaaaggcagccgaagccgtcaggtgagtacctgcatcgcctttgtcacccttcgctccgtctcgtccatctcttccaggcagaccattgtgaccggggttcccagggattccagggtgcccttgcctgcaggtgtcctgtgagtttatgttccctgtgcagatttcaatggcaagcagaagccaccagatcctcatggttcagatgacagactgaactgaaagagggaaacagaaacccagaggagaaacctttgttgctggggccctggacacagcctccgttctgtgcagtgggaaatggatgagctgtcccctgccccagacccacacctggacagacttggcagaagactcagggcaggggagcaagctggttattaccaggatgacattgtccttggaaggtaacacttgtgattggaaccactcttcaagctgaacgggcaataaaaaaaagccaagtttaaggtcaggatactcttccgttcatcatttcactttgaagaaatcacttctcttaaccacagaccaatgcttacttatctcacaggactattgtaaaaatcaaattttatcacaatatgcataaaggcacatgacaaatagtgaagcaaacatagcattaccatctgatccagcaattccactgctgtgcatctacacaaaataattgaaagcaaggactagaacagatgtccatgttcgtagttgcattattttccatagcaacccaagggtccctcagtggataaacagatacatgcaatgtggtaggtccatacaatggaatattcttcagccttagaaagaaaagaaattctgacatgtgttacatgaatggacctcgagaacattatgctaagtgaaactagctagtcacaaacagacagacctggataacttcagttataagaggttcctagagccgtcaaactcatataaagaaaaagtaggatgatggttgccagaggtgaagagagaaggaaatgggagttgtttgatgggtacagagtttgggaagattttaaaagagttctggagatgggtggtggtgatggttgcacaacaaagagaatgtacttaatgccactgaactgtgcccttaagatggttaagctggttagttttatgttatatattttttttaccacattaaacaattaaattaaatttttaaaaaagtaaagcattccaaacagtcttactgtaatgagaggtattctttgagtcagggtcttgtttttctaggaggccactgtgaagaagggccacacacacagaaaacatcacctagttcgggagaagtgcattttcaagtcctttcctctgtagacactgcccccaccccaggttatccatgcagtttcccccgcagcaggagctaagacaacgcttgggcagtgctccaaacggagcagcaaacgcaaggcctggaaggaagatgaaacgtggatggctgggcctcctgactcagcaacgctcccactcagggctgtggagcaccctgttactctcccacatggcgcttgtcatggcaggggcttgacacttgtttacataattgtaggatgaagaatctgactccccgcctgactgtatttcctcattattgccttcccagtactcaatattaaacttggaacagcagattgaacaaatacttgttgaatgaaattaatgtatcatcatgggagatgtcttaggatatatatataatttttggagacaaggtcttgctccatcaccaaggctgaagtacagtcatgcaatcacagctcactgtagtctcaacctcccagctcaagtgatcctcctgcctcaacctcccaagcagctgggactacaggcatgcaccaccacacccggctaattttttttttttttttttttgagatgtagtttcactcttgtgacccaggctggagtgccatctctgctcactgcaaactccgcctcccaggttcaagcaattcagcttctcgagtagctgggattacaggcgccatcaccacgcccggctaatttttgtatttttagtagagacggggtttcaccatgttggccaggctggtctcaaactcctgacctcaggtgatctgcccgtcttggcctcccaaagtgctgggattacaggcatgacccaatgccactggccctaatttctcttctcttcttttcttcttttttccttccttccttccctccctccctccctttcgttttctttctcgctttctttttttttttttttttttttgagactgggtctaactctgttgcccaggctggtcttgaattcctgagctcccacctcagtctcccaaagtgctagtattacaggctaaagcccctgcacctgacttttaggatttaaaaaattaaagtaaaacaaaaacgtgggcctagtgcaactggtcagaacccagatcctctcacagtgctgatagccacgtaaatctgcacatctttctggaaaagttaaagagcaaaagacatctatgtctttcaccctgtattcctatccctaaagttcttcctaatgttccaaaactgtgtgccaattgtgtgccattacctgcagcattatctataacaggtgaaaa

SEQ ID NO: 529 - DNA, 47031 bp, Homo sapiens
gcgcagcagggagcagagcgagaggccgctgggaaagatggttctcaaaagcagaagcctcacgccaggggacatggcccatcagcaagcacatgggtgcctcttctgggcatgctggctgctggggacccagaatgggatctgtctgctcctgggtctcaagaaagacctgtcttgtggggtagacagatgataataagcagacttacccataagtgtaatacactcagaaatggggacatgtgatacagagggtgaagagagaacctttatagaaaggacctagtttagttaatgtagtcaaaggaagcccctttgaggaggtgacatttgagtggaggctcgagaagaaggaagcagccatgccccagtttggggaaagagtaaatggcagatgcagagtccctgagacagaaaggagctggtttagttgtaaactctcagaaggccactgtatctggagtgatatgaatgagagggtggggctactgtagatgggctggtcagttggcagggccaggtcaggctgggtctccaggccagggtcaacatataggtctatagccaacatgtttaaataaggcccataagactgtcttcttgctgtccctgagaactgggtgtttgcatatttggaagggactgaatcctgatgcctaggctgggaaagagggtcggggggtggggagaattcttggcttctggccctagaaagctggaacaagaatttggaggctgcatcccactgactcccagatgggttggagggtgggtggcctcagccaccagggccctgtgataaggtggcaccacatactgatagctgtccagatatccttccacaggtgaacggttcatcaaactgtggcgcatccatacataccatgagtaccactcagcaataaagacacaaacatgaaatgagcaacaccttggaagaatctccagggacttatgtggagtgaaaaaagccagtctcaaaagagtacatcctatatgatttcatttatgtaacattttggaatgacagttttagaaacagaggacagactggtggttgccaggggttaaagatgggagggaagttagtgtggttctataagggcaacacctttttattgttagaactgttcagtgtcttggtggcagtggaagatctgtgaattgacacgggtgatgaagtcgtatagaacttaatacatgcagatgtgcgtgcacacacacgctcacaactagtacatgtaaaactgggaaaatctgaataagatcggtacattatatcaatgtcaatagtacagagttactgtactattgcttacaattgcatgcgaatatacaattatctcaatagaaattttaattaagaaatgaaatttggctaggcatggtgaggcacgcctatagtcccagctacttgggaggctgaggcagggggattgcttgagccaggagttcaaggctgcagtgagctatgattatgccactgtactcgaacatgggtaacagtgataccttgtctttaaaaattttttttttaaaaaagggaggctgagcacggtggctcacacctgtaatcccagcactttaggaggccgaggcgggtggatcacgaggtcaggagttcgagaccagcctagccaacatagtgaaaccccgtctctactaaaaatatgaaaattagctgggcatggtggcgcgcacctgtagtcccagctactggggaggctgaggcaggagaatcgcttgaacccaggaggcggaggttgtagtgagccgacatcacgccactgtactccaggctgggaaacagaacgagactccatctaaaaaaaaaaataggaaatttaaggcccaaagcattagatagaatgatagagatatttgtactaataaaattttcagcccatggaaaaaaaatctgaaggctctgctcaaggaggtctcttgtccttgagttagcaaagtcacagggaggtaggcagtgtgcccccagctgtgggagcaagcagggtcaccctcaggacactcaatatagagcggtggtaccctcagaccctctgggtaggtttcccagcttagccttttgggcctccctctgcccctcacccctcaagctgattgaccacgatcacaagggtagagcagagctacagcaccccccgccctccactgctgcttggtctttcatggagaacagacattctcctgctccccactccaccaggttaggtaaggacccttcctggggaggcccctgtgtcaactgtgcttaaccgtctgtgcctgtgtgtcccccagcagcctaagactcctgaaccttcagaacaaacctgatgccaattccaacctggagggcacgggagagtgtttgtttgaagcactgaactacatgggaaactgaccaagcctggggcaagcccatcctgagaccccaggcagggcctcagctttggtccaggatttgtggggtggttttacaagatcctgggatttcacatgtgggccccactaagacctctcttccagaatgttggctgcattgggcactgtctcaaattccacctacagagtggcagacccaaggcttcccgccatagtaccccaacacccacagagccacagctgcatcctcaaattaattgacatcttcccatgggctgagcactttgtttcatttatttctctcaaccacattacaaggtaggtcttctttgtgtatttattttgcagagaaggaacccagggctcagagaagttacgtaacttgcccagggtcactcagcttgtaaatggcagagcaaggatttgaaaaggcagtcctgacatgtggcaggcctgaacgagtccctgcagatgcaaagctgaaggagaaacattgcctgctcttaaggagctaatgataatatcaccagatatttacatagtgcttatgatgggtcaggcacaggctaggctctctgcatgtgttatttcattgaatccacaccacaacccagtggaataaggttatgcctgttttatgatggaaattgaagctccgtgaggaagagggacctattcaaggtcacatagtgagttggaaagtctgacctcctcttgttggcttcttccatcctccaggctggcctcccaggcccctccctgctcgtggtctgtacaccccttctcccttacactcggctaagccttgtccatggcccctgcccctttcatgtctattcttagcatagtttggagcctgcggttgggccacattatctggatggtgacccctgggggtacatcttctaccccagtgtgtcctttagcccttcctgtctcttccagctgtgcagcaaggggcgtgttagaggggcccactacccaggcccttacactgcggcagcctacctaagtatgcacagcgcacgtagcgtagaggatggagcccgcaggacacccttaatgcccttacctggcagggaggccagcacacaaggggctgggggcgggactgggcttcttggggttgagtggttctggaagccgatatgagcagcagcaactgctggcattatctaggctctaagaatagcttgggatgaagagtcagaggttgaggccagggaagaggacaggagcctgttcctactgccccctcctgctgcttggcctggaagctgggaagcctgcctcctggctcaccatttgctctgggatggttttgcatagacacatcttgtccaccactggactggaggaaagagggtacccctgggactcagacctaggctgcttgacctcaggctgaaggcagtgggcccactctctgaggaccagccctcacccaggcccctcaccactggcacagagtaggggtttgtatttttcaaggatcatgctggaagtgacccttattcatttagcaaacactttaaaaataggttatacatacacgatttaaagttcaaagggtttacaagggaaaaaaaatcactctgcctcccttccctggcccccagctaccaaacactgttaccagctttcttgggtgacttccaaaggcagtccatccatagataagcacacagatgcacaaatgtctctctcccccgatttttacgcaggagatggcatagcccatacattcttctgctccttttttttttttttttttttttgagatggagtctagctctgtcgcccaggctggagtgcagtggcacgatcccggctcactgcaacctccgtctcctgggctcaagcagtcctcctgcctcagcctcccgagtagctggattacaggcacctgccaccatgcccagctagttttttgtatttttagtagagacagggtttcaccacgttggccagactggtcttaaactcctgacctcaggggatctgcctgcctcggcctcccaaagtgctgggattacaggtgtgagccaccgtacccggccacaacttttttttttttgtaacctaatgatctatcttggaaataacagcaatgacatattgagtctccactagtgtcaggtactattctaagcattttagatggtttaactcatataatgctcatcacagcactaggaggtaggtcctgtttgtgaatctccaccattaagaggtttagtcattctccaagacttcgtgcctggtaactggcagagccaggactaaaacccaggcagcctcactttagatgaggtgctccttcctcactgctctgtgctgcctcccaagcttgagacatgttgagactcacatcatgccctccctcttcctaagggccaaggtaagccatgtacggtgaacacttaccacgtaccaggctgaggctgggctactgcagtgtaagggagaccaggcctctgtcctcatggaactgtcatcccagtgcccatgagtgtctgccagccaaggcaggaggagggaaacccacttgtctcatacccatgtgcccttgtataggtctgctgttcagacacaccctggtcccatgtccactagtcctgtagtcacaccgcctctgagctggaaggccttagagcccagagttacagatgggaacataggggcccaaacagaggtggacacgagagatcatcaggtggccctggtgagactcatcccctgcctcccgggatctatttcagcagggtgggtggggggtgactttaatccagggcccaaccattgtttgaagttggaaacaattgaaggacaagggagctatagatagatccacagctgctgtcacttgtcccagcctgggcactgggcctgagcattgtctacagaggggcactctaagcagtgaggcccactcctgggggtaggaggttggcccagcccagctcagctcagctcggctctagagataaagagtcagaggccaagacagaaatacagagtcttggaaggcagagagtgggacaggacaacatcgaaagaacaagacccttgagagatacgatggactcccatcaaatatcgacaatactcagactggctgggggtgggagggcagacgcagggcctgagccacaggttgaactcaaggatgcggcatgtcagagacctggaccagagtgggtgctggggtctggagcacctcagcccagctcaggtctttctgtccatccctccagaacagctgttcatgttaatcactcttgggggcagccagtctgaggtacccttgtgtgtgctcggggaggcctcaaggtcttccgaagtgagaggttgtgctgtcaggcctggtcatggcttgaattcactgtatgacatcaagcaaggacctgcctctctctttgcggctcagtttccccagctgtccaatgagagagctggttggcatgatggctgaagggccccttcatcctccaatgatgtcaggagatttccttttatgtgtctaactccctcctcttgctgtggctgaggtcgcagtcccctcctttctttgtcctttgtgaagatgggggacagctggttccccaccccctccccccagtaacctttcagccataaatccatgctgaggcatctctcctctggataaacagccctgatgccttttggctgccctcgtcctattttttgcttcaagcctcagagctggggcccacttgggccctctgcagctgcccagggccccaggaggggtacaaacctgggacaagcaggggcccaaccacccccagtgtgccagggtcgtgggcccctttctgggcctcaccaccttgcactgggaccattatggcagcctcctcctgagtccttcttcctgccaccggcctcaccccttcagtgcatcctccacaccagctgccacagggagcttaggaacacataaatctgaccacactgtcaaattccgtcgctcagagctctttgatgcaaaaaataaataaataaaaatgcctttgatggcgccccaactcctgcaggataaagctccagatctgaatctggcctttgaagcccttcacagtccagcccactacccagtcctgccccactcccctttatgcccctggtggcccagctgcagctggtggggctgcttgggcccatcttcaccccctaccctgccttggagttctaggtcatgctgtccatttcctgtcccctcttgccacctccatgccagacccatccgctctcacccgggtgacagcagcagctcgccccgctgcctcccctgccccttccaagccgttcaagtggtcactatgaaacttcagctcactcacatttctgctctcacaggctccctttgcacttgcaatacaaccctgggtcccttccaagtccttcaaggctctgaatgatctgcctgtccaccctcaccttggaaaactctccccttgttgaccactaggacggcaccttaaacatcccaagctgttttctgcctcatggctattgtatttgctgttccttctgcttggaatactgttccaagggcttcccgcctcaccggcttcttggcactctctggtctcaccttcagtatcgcctcttcagagaggccctccctcacccaccagaacgaagtacacgtaccccattaccctccaggccatacttcttgtttcatgcttaccacttgccacaatctttaattaccttaaaaatgtgtttgcttgtttattttttgcttctccaggggagtgtcagctctatgagggaaggaaccttgttgccatacccctcttcctggcagtctgggtgtcacacttgtttgttttgagtcagggtcttgttcctgttgcccacgctggagtgcagtggcatgatctcagctcactgcagtcttgaactcctgggatcaagcaatcctctcgcctctcagcctcctgagtagctgagattgtaggcgtgtaccatcatgcccagccaatttttaaattttttgtcgagacagggtcttgctatatcagcctaggctggtcttgaactccttggctcaagtgatcctcctgcctcaagccttccaagttactgggattatcataggtgtgagccatcatgcctggttaattttaaaaatatttttttgtagagatgtcacagggagcttacaaacacataaatctgaacacactgtcaaattctcttgctcagagctctttgatgcaaaaaataaataaataaaaatgcctttgatggcgccccaactcctgcaggataaagttccagatctgaatctggcctttgaagcccttcacactccagtcccaactgctcagtcctgccccgctcccctttatgccccagtggcccagctggtctcaaactcctggcctcaagtgattctcccaccttggcctccaaaagtgcagggattatgggcataagccactgcgcccagccttcaaactagcttttatccttcagactcctccgtgttgatgtcttccttgagtatctttcctttcctagacaatgagtgtcttttgttccatgtgtccctcccagctgtagaagcattattcacagagtccttcgatgtctttacccaaagaagaaattccaggcattgggttacattgagggcagatacattttgggctgggatctaaaatcctggagtctcgctctcctgaaatcggaacgaacttcaaaggtcatccagttcagaggcctcagccctggtcgacctctgcctgagtcttccttggtgctggcaggctcactttcctccaaggcagcctctcccgctgctgatgggctgagatggtgaaaagtccccttttgcatgcatccgcatcctgcttcctgtcgctgcccatggatctacttttgaggctacacaagtcacatcagctccctctgctccaggacagctcttcaagtttttttgattttttgttttttgagagggagtcttgctctgttgcccaggctggagtgcagtggcacgatttcagctcactgccacttccagctctcaggttcaagtgatcctcctgcttcagcctccccaagtaggtgggattacaggcacacgccaccatgcctggctaatttttttttttttttttgagacggagtcttgttctgttgcccaggctggagtgcagtggtgcgatctcggctcactgcaacctccgcctcccaggttcaagtgattctcctgcctcagcctcccgagtagctgggattacaggcgcctgccaccatgcctggctaatttttttgtatttttagtagagacagggtttcaccatgttgaccaggctggtctcaaactcctgacctcaggtaatccacccgccttggcttcccaaagtgttgggatgacaggcatgagccaccatgcccagccttttttttttttttttttttttaagtagaaacggggtttcatcatgttggccaggctggtctcaaactcatgagctcaaatgatccacctgcctcagcctccgaaagtgctgggattacaagctcttcaggtattgaaagtcagtatcttacttaagtccttgcaggttatagtatttgttgcaaatcactcagagcattgggtttcctctttgcgttgtcatgtttgtttgtgagcttatctcagcaggaagatgcaccctgggtggtggaagggaacctacgaggaagatctagacccattttgaggcttggtttctcagccccaggttcatacactgagtaggtaactctaggactcagacccacatgataggtgtaagttagacttgctagaggttctgattctccaggctaattctgttggtccctgacaagaaaccctaccttctgagcatccttgaacaatgaaaagaatttttcccactttctgggctttctataaattgctccagcccagctctccagcctctgatgccataggagattaaaatcctattatctatcaggtttggttcgttcacttactaggtatttattgactttctatgatgtgcaggcacttggcaaggtgccggggacacagaccaagctcctgcccttgtgcaggtcttttctagtggcaggaggtaggcaaggtacaatctaagctctacaaagagaattgaaacagtgaggttctcacagagacaatgcggagagaaagaagaaaggaatacataatgtaggattccattcaaacaaattctgaaaatagacaacactaatctctgaggttagaagtcagtattatattgtggatcaagcaagagtcggtataaaaaaaataaaaataaaaaagaagtcagtattctattatcctaggtgagggatggcccgaaggggataatttttcataatttctgtttttgtacagggtacggttttgttttgttgttgcttttgagactgggtctgttgcccagctggagtgcaatggtgtgatctcggcgcactgtaacctctgcctcctgggttcaagcggtcctcccacctcagcctcctgagtagctgagactacaggtgcatgccaccatgcctggctaatttttgtttgtttgtttgtttgttgtagagatggggttttgatgtgttgcccaggctggtcttgaactcctgagcttaagtgatgtgtccgcctgggcctcccaaagtgctggaattacagacatgaggtactgtgcctgacccagggtatgtttactttgagaaaattcatcaaactttataagatcattcactgcagccttgactgtaatggcaaaagactgaaaacaatcgaaatgtctaccgagaggggacccgcgtcatttcctaatggagacacactgtaggactaattcctaatagggtctgggcggctgtaattttgataaatatcgccaagtttggcactgtaatttttttttgagacggagtctcgtactgtcgcccaggctggagtgcagtggtgccatctccactcactgcaagctctgcctcccgggttcacgccattctcctgcctcagcctccagagtagctgggactacaggcgcccgccaccacctctggctaatttttttgtatttttactagagacggggtttcactgtgttagccaggatggtctcgatctcctgacctcgtgatccgccctcctcggcctcccaaagtgctgggattacaggcgtgagccactgcgcttggccggcactgtaattttaaatgtgttcatgtaatatgcacacagtaaagtgcatacatcttagatgtacagcttgatttgttttgcaaagtgcacgcacctgtgtctcatggctctactcagcgtatagagcatttcctgcctcccagaggctctctggtgcctccagccattaccctccctcagaggaccactctgccacttctgtcaccataggcgagttttgcctgttttgaatgtagatggttgaaaatgtagctgggaaattatttctctatatttcgtctagcacacctgtgcatttggaatgggagcgcatcggtcggaggacttcccgtgtgagcctggtctggcctctggctggaaccctggatctggaactccattgttccatgtgtctggcgtctgaggttctcagatcctttcattctcgattctaaaatcctgtggcgtcacggagccctgaatggggtgatggacaggagagcctggaggtgccctgacacattccaaagactgtatcaggcagatggactgccagcgccctgaacctctgtcgagagtgggccacgggaaggtggcttcctgtgaatcttcaatgtggggatctgaaggggctcctaactgggttacatttccttgatttgcttccatttcagccaaacaattccttgattctataagttccagggctggttttcttcatgtatgatttccccagggggtccccagaaagaggatggggagggaggaagagggaaagagggcatcgatgtgctcccacttccaaatgcacaagtgtgccagataaaatatagagaaataagtgcaaagctacattttcagccatatacattcaaaacaggcaaatctcgcctatggtgatagaagtggcagagtggacctctgaggtagggtacagagtggaggcaccagagagcctctgggaggcaggcgatgccctataccctgagtagagccgaggggacacaggtgtttgcgctttgcagatgtctgagaaggatgtccctctccccctacccctcccccctctctctctccctctcactccttctctttttgatctgttcttctccttctctctccttctctttttgatctgttcttctccttctctctccttctctttttgatctgttcttggccattgctcgtctgtgagacttggccaatgctttcctttctctgggcctcagtttccctggatgtatcaagagggttggactagctggtccaatctcagtaggcattctgtggtttcccctctgagtgtccttgctctctgtatctggaggtggggtatttttctgggtgtgtcagactctgcgtgacttggtttctccccgtgagctcttcagtctcctgaacctcttactgccttgtccctgtccccgtcagtctctgcacccagcctccctgtctctcagtggagtgtctctctccgcctttgtgatcccctgacaatgggaggtaaaaatagcccaggggccgtgctggtggagataaaagggaatttgccttttgtgtcctgtggccaggctgggggggctgtgacacgtggagattgctgacatagctctcctcctctgaccttgacagtggcaataaaaggggtagcagagcttcctgccctcaccgtggtgccgaggtaggtgatcagggctggggttggagccgaagggagggcaggagggtgggcgggtgggtgagggtgcccatgggtggccgcgagtcttctgaatctggagtggaggaagccctggtgtttgagggtgtgcatgtatgctgggcactcacccaaggaggctgcattgggagccagagggagtcgcctagtatctggtcttgtgggttgggggatcgtgccctagttcagctcccttgtcactgccatcttccagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacggtaagtggagacagagggggaggggtcatagccacagagatgcccttatggactcagaccaggaattgggaggggtggcaccagctcagggctgaaggggcattggggcctgacagctggagccctggacctttcctgcagagtctggggcctggaaattaaaaccccagggacactgtatatcactgtgtgtctgtgagcaagccttggtttgttcccctgtgaaatgggataatagcacctgccttccggagctgcagtttatgaagactcaggctggagcccgaggcctctgagatgagactgatcggcatgtgtgcaggctgcctccgcgtgtccacaaaacttgtgctggggttatttttagtggtttctgcagagccaaagccaccctttattagggacaggaataaaggctgtactatttatgacctggtttgctcataggacaatactaacaataggcagtgtgtaccgaatgcttattgtgtgtcaggcccagagcagatgactttccatgcatcatctcaacaacctggggaggtggggccagcaccagacctagcttcacagggcgccaggctaagagggaccttgtgtttgattcgacactctgctgttgccgtcttgaaagttttaattgttttcaacaaggggacccacatcgtcattttgtactggggtctgtaggttatgtagatggtcctagatggttctagatggtcctgacccaggcacttggcagagcaggggacacaaactccggtttgcagcctgagtccatgcttctaaccaccatgaaatctgggctcctcaaagctctggggacagctggccaggcaggagagcacaggttacagttaggaggcctgggtttgagtcttcagtgaaatagggaaggcaggacccctccctaagagtcatatgcctgatattgaggggctgctctgtatgggacctaaggagatctccataacattttgcatgtgagggaactggcccagagagaatcagggattttcctgaggtcagagggcaaatatggcggaagcaggaattggaacccaaccattaacccagactcatcctccaataaggggatctctagggaccctcccagctccgcccttcctgagcctgggtttggagggttcttcactggaactcctgggtcctggcagaggggctttggggagggtcacagctgtatggataccatggcttgggaactccagctagaacctggaggtgcctcagcccctctctgagtccagagctctctctgcaacccagggaagaagcgagtctgggtgcctgatgaacaggacgcctacgtggaggccgaggtcaagtcggaggctaccgggggcagagtcaccgtggagaccaaagaccagaaggttccgttccccctttcctgagattagcctctctgtccctaggcctcctggccaacaggatctgccctctggttgaagggggtctgggtatgtgggtgggggtgacaggtgaggtcggtcggttcctcccggtcccccggcccctgacacgatctccctggtaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatgtgagccccaggcccgggccatgggcggggtggggcttgtatgtggggcggggctagagatgaggtgctgggggcgggcccatagcggtggggcggggctgtgagcggtggatcggggctgtgaatgatagagcgggtccatagcgggggtggggctgtgagcgatgaggcggggctctgagcagtgggggcggggctggaggttgggccttgggaccttaggggagcagctgtagcagtgcggggcgggtctagaactcacctgcggactatggaggccgtgcgtgtgggctggggcagggctgtgagcacaagtcaggggtgaggccaggacggccacagagggtgtggtgtggcaagtcaagtagctccttgaggaatatcgcagggttcttctgaagactggggcctggggcctggggatgggaacttgcgtatccctcccaaaaccctacctatggggggagaatgtggtggcccatgcctgtaatcccagcactttgggagggcaaggcgggcggatcacctgacgtcagaagttcgagaccagcctggccaacatggtgaaaccccgtctgtactaaaaatacaaaaattagccggtcgtggtggcacgcgcttgtagtcctagctaccctgggaggctgaggcaggacccaggaggcggaggttgcggtgagccgagatcatgccgttgtactccagcctgggagacagagcaagactccatctcaaaaacaacaacataaaccctacctatactctctcttcagacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcagtaagggccgcctggactcctccccaaccgcagaccccgacctcggtcccgggaggcctctgtaagggacccccttcccccactggcactgccccccttttgacgctgctggacatggtcgcccagccgttctgtccctccgcatgggagctgacctccactagggacagccccacctgctccttcccattcctggctctgggtggtggggtctgccccagatggatacccagggtgttccacctgtggctggccccacaccttggctgacttctctatccccttccctttcctccagaccgagacaaccagtccatgctgatcacgtgagtgtggggctctgggggtggggtggaaaatgctggccatctggcagaaagagggcggtaccacagtcatttcccaggattgaatccaaagtgcttaggccaggacttttaccacctggagctagtgtcccagctgaagctaaattaggcctgagcactttccctgcccccattctgaacagatgtgttcttgatgggggatagggaggggacacccacaaacggagtgaccaccagccccacacctcctctccccggggcctggaatctcccaccttgatcctctggggttctaattctggctcaggggcagcggaaagattcctctgcttttcctcctttttaccatctacttatgtctgaatcttacctctgatctttccattgcctctgtgggaaaatggtagaataattcttacatgccaggctcatgtccagtcaggccaatatggacaatgtttagtgtgagtgtgcatgcgcgtatgcagttaagagcaagtgccttggccgggcacagtggctcatgcccgtaatttctgcactttgggaggctgaggtgggtggatcacttgacgtcaggagttcgagaccagcctggccaacatggtgaaaccccatctctactaaaaatacaaaaaattagctgggcgtggtggcaggtgcctgtaatcccagctactcaggaggctgaggcaggagaattgcttgaacccaggaggcggaggttgccgtgagccaagatcacgccactgcactccagcctgggccacagaatgagactccatctcacgaaaaaaaaaaaaaaaaaaaaaaaagcaagtacctttaacccagacgggcccggctgagtgtggtggctcacacctgtaatcccagcacttggggaggctgaggcaggaggattgcctgaggccaggggtttgagaccagcctgagcaacatagcgagaccccatctttaccaaaaaaaaaaaattgaaaagttaaataaaaaatcctacctaccacacaaagttatgagtcagtgagttgatatatgtgcctggcacacagcagggacagccacagaactcctgaggcccagttccttgttcctaaaatgggggtgataatggagcctgccttccagggttttctgagctgtaactgagccaatggagtaaagtgccgggcactgagttagtccgtagtggacaatggcatcatcgtgtgttgtcatctcacagggatggtctacactggcttgctttgtacacctctgagggttgatccatccttgggggtttcaagctggggggaaggagaggtggagggctctgcttgaggggtgaggcattgggggtgggggagaattaggccagatgggcattggtgactcatgtttgtgtcgtccaagcggagagtcgggggccggtaagacggttaacaccaagcgggtcattcagtactttgccatcgtcgctgccctgggagacgggccgggcaagaaggccgtaagacttgcccactcgggcatgctccccgttgcttctcgctgtttttcttttctttcttcctctcttttttttttttccccctttttaaaaattttactccccagaaccctgagccctgcctgagcctcccaccctggtgggggactctggcctgagcaaggcttgaccacaaaggctgtggccacctgacgcgcctgccttcgccttcccattggtaaacatggaggggtggggccacgttgccgtttctaaatttgtgtaatttttatcttccattgtgaccttcatatattgaaagagtttactagatgggctgcttttactaagcgttgttgtcttggtttccctgacagttacctgctgctgacacattagacacagaggttggctggcatgcagggcactgggcattcccagcagccggggttggcagggcaattttgtgccttgtgatttctgtacagtttttggaaatttctgaaacaatggggccaagtttttttgtttttgtttttaaggcataacatttcatccctagccttggggccagttgttcagagccctgtggctacccctagatgggctgcctttttccagaagcccgaggcctccctccccacccagtccctgctcctggtcctgttaagccttgctttattctgggtgtttttcttgtttttcccctgttttctttctttctttcttttctctttcttttttctttcttttcttttcttttctttttttttttttttttttgccttttcctttttacccatttgattgtcttgatttttgattttcatttcagttttgttttgttttgtttttgctgttgactttttggtcctttttcctccttccctttcctgccctgtcttccaaatccctaaaaaggtctctggggacgtaacagaaagttgggtgggtcaagtgacaggaagagatgtcagggagaggccagagctggcagggacacagctggaagggcagaggagcacctgggcagaaaggagctgggacagtggagcccaggggagagggtcgggcaagggaggggtgggagaggctgcccgcaggagccatggctgcaggaacttaaaagattgatcagctccccttaccttggccccaaatttggccaaacgggctagagagagccctgcacaaaagcactggatgggagtgtattggggggttccacctcccctgcccaatgtccctgtgggtattttaactcttgggctccctggaggtgaatgaatgaccacaaagtccgtggtggtatatctgttccctccagaatccattccttcccttctctccctttcttccttggctcccagcatccggagtagggaagagaaggaaaggaaaaggaagggaaagtgaggatgaggctaggatggggagaaggaggatctgctcaattcacttagtccccctgggtgacacacaggaccgctgtggcgtccaggcggcaggatgctgggcacctgccctgccgctcctgacttgctgtgtggccttgagcagatccactccctgcccagagctaagtctcctcatttgcaaattagggctaataatgggcacctggcagggcctttgtgcgcactggtaggtatacaggcagacaaacaatgaagacacacccagttgcattacaaaggagaggtgtgtaaggtcatagtgggaggttagggcaggaaggttcagaccaggaagaggtctattccagctttggagcagccaggaggccttcctagaggagggggcacttgggctgggctctggagggccctagattttagtcgggaggcccctggggcttggagcagggccactgcatggagactagaaaatgaagggaggccagaggccgggctggggcagaggaggctgcaggtggagactctggctggggctgtgccactcccactttccagcattttgcctcctaacagctgcaggagggtcaggccgaggggctgagggtgggggccatgcattccggtgactaactccacccccctgtcctgctgcccgctgcctcccgctgataccctgccccaccccgcccttccccaccggaggcctggccctctaatgttgtctgtcttcttcccccagcaatttctggcaacaaagacgggggtgagtatggggccaatgtcaatggggcagccctgggggtacccccttcctctgcacaacagaggggccacgggtggctctggcctcccggtgggtaggcaccagaactgacagaccccctcacccccaccgccccagggcacccttgaggatcaaatcatcgaggccaaccctgccatggaggcctttggcaacgccaagaccctgaggaatgataactcctcccgctttgtgagtggctgaggtgggaggggtggcggggatgccgtaggccaccagcggcaggtcgggcacaggtggggacagtgctggctgtgccccttggctgagggctgcccctctgcccacagggcaagttcatccgcattcactttggtccctctgggaagctggcatccgcggatattgacagctgtgagtcaaccccctgcgggcggtgcaggggaaggaggcctgagcccggtcaccccaactcggcctctgtcatcacgacttctgggctcctgcctgctctgggcacttctctctaccccctggctgctgcccagctcaggccacctcacctatcaccagaacatcaccccagcctctgcctggtctccagcttcctctcctctacgcggccatagttttgctggtcatatcctgttcctgcttgaaagctttctctagatcctgtcacctgaggatggagacccaaatcctcatttggccagtcaggctcctgtgactgcacccctagcgtgtccccagtcttctctctggccaccaagagggcaggcctggcccacggccctcctgccccagctgcacagctacacgtagagtgccccatccttccaggcaccccgctgggaagtgccccagtaccaccagctgcatagaccccaggcgcctaggccacactcaagggggccagggacacagaggggcccccacgttggccactccccacattgggctgcatggctaggtcttgacggatgagcgcaggcaggcagtgacggggacagggataggctgtaattcacaccctgacccctacacagacacacacagacacacacggaggctcggccacacacgcacacacgctgacacaccaacagataaaaacctgcacacgcagacaccacactcaccccacacacacgcaaggacacacactgacccatctggccagagacacagacacacaggtacagacacacggctcgtgtgatgacgcaggcacaggggagataccctccccacacaagctggcaggtgcagatgcagcccccctgcacactccctgcccacctctctccctccgcatcgcccccttgggatgtccactctggggaggtgtgggagatggcaggccagcgtcccttctccccagatctcctggagaagtcgcgggtgatcttccagttgcctggtgagcgcagctaccatgtctactaccagatcctctcagggaggaagccagagctgcagggtgaggggcagtacgatgaagggggtgggagtcagaacctggaggggctgcctggcgcttcctggcccccatcaggccaggccctggtggtctttccctccctgtcctggggtctgtggcctctcttccttcttgggacttttggttactttcctgctagggaacagtcctcttagctccagcaacctgccaacgtgttatcgctgcctccaggagcctaagccctaaaccccacttgctgtcctgagactagagaggtcccacccagcaccaaggcggactgatgactgtctaggcccagctctcctctctggcaagcccgttgagggcagagtctggtcttccctgtgcgccagcatctagcatgggatctgggccagagggggccatgagcaacagtcaaaagatgagtgagacgtgaggactgtggctcattcctcagagaaccagaaaaagaagccagggtcaaagtgaaggccaggtcagggcccttcactctcagtgccctcagccttggcaggagtgaggatgagaaacttaggccccagactgggagatgaggtcctctgggagggccctagactcctgctgggcttgcccccgcaggaccccctatgctgcaattgttgtggggagaatagccggtaagcactgcctgaccctcccttctctgccctgtgtccccagacatgctgcttctgtctatgaacccctatgactaccacttctgcagccagggcgtcatcaccgtggacaacatgaatgatggggaggagctcatcgccaccgacgtatgagctctggtgggaggggagctgtgtggacgcctgtggtggaatcgggcagcactgccggtgcccccagctgcatgaatggtcccggggcagtgcctggctggaccctggaggagcccagacctctctgaactcgctttccctgctgccccccagcatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgaggggccctaacctggccttcaacttgacccagacctcagcatcctgtccatgatggttaaccccaactcttgtccacaacctttaacctcagtcttacctggccctgcctcctcagctccaaacccttaccctcctgaggctttgtttgctagccctgaacttgacccctcttaacttccctctcctagccccaggctgaggcagtagagcccctgagtgcgcatggtggtgtcctcctcccttaccccactcgtgccctgccaggtgctgacaaggctgcctacctgatgggggtcagcagtggggacctcctcaaaggccttttgcacccccgggtgcgtgtagggaacgagtacgtgaccaagggccagagtgtggagcaggtgagctgcctgcaggccaaacccatgggggacagccgggcagggtcccctccttgccaggtcccagcccagcctccctgcacctccaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgaggtgaggacaggccctcaccttggcctctgttctctccaaggtagaggacatgggcctgtgggggggcagaagccctggccttctgcctggaagttgggggtgaactcatgcccctccccgggcctccctttccccatctgcgagaggtctgctgagccaggcccctccctcttgtagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaaggtgggtgccgcggcaaggtcactttgaggaagggagggtgtgtgtggtgagcaagcagggatggatgaccatggcttgcatggaagcctgcaagtgtgcatggaagcgtgtgactgtgcgttgcagtaagcatgcatgtgagtgtagttgtgacagcgtttatgtgcttgtgtgtgaaagggcacgtgtgtgagtgggtgtgttggagttgaccatgagtgagccttggtgagtgtgtgagcagtgtgaatgcatgcatcccagtactgtggacaacagctcctcctgggtgctcagaattctgcagctcacaaggccctatttgcagccacaatttcactggatccctagaactgccctgggtgcagggcagggtgtgtttccttgtttttgtgattgtggaacattatgtatatttacccattgtacaaagaatggaagaaagaaaatttgaaaaattggcaggggaaaaaatgtttctccccattcctatcacagccagtcacatgacacttaggttcatttcctcgaaatcctttatccctttttttttttttttttttttgagatggagtctcactctgtcgcccaggctggagtacaatggcaccatctcagctcactgcaaccttcgcctccagggttcaagcaattcttatgcctcaacctcccaagtagctgggattacaggcatgcgccaccacacctagctaatttttgtatttttaatagagacatggcttcaccattttggccaggctggtctcgaactcctgacctcaagtgatctacccaccttggcctcctaaagtgctgggattacaggcgtgggccactgcgcctggcctatccattttcttttatagacacagatttcatttcatatcctactttttctctgaaaatgtattttgaatgctgctcatggcaagagtagttcatgcagtggatgagtttcatacgatgcatttctgcagtcccctacagctgggcgtttaggtgattgacagctttttaaatattatgtcagcactgaagacattcatcttcccactctgcaggttagaagactgaggcttagtgatgtcggagggccccacagctagtgagtgaggaagccaaaatgtgaacttgatggctttttttgacttaccccatgtttgtgtgtgacagccatggctgtggcgggggtgagagtgggtacagagatgccagcttgggtttgccattgttagaagtgaagatgacacctcagtgctgcagattttgcaggaggggactggagccaagccacaaacttttctctgttaggagatgggttcttggagtgggtgtggtgtctgaccatccggggagatggctgaagctggggatctgggaaggctcccagaagggaggtggcctggggaaccaggggttcagtccttccaggatggactggcttgatggtggcttttcaagctcgttctgttcccagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtaggtgcttgctggaaccccagccctcggccaggctcctcccgccctgctccaggtctcccacccgggctcagcacctgacttgtctctccaggtgccttacagcattgtgggctggctggagaaaaacaaggatcccctgaatgagaccgtggtccccatcttccagaagtcacagaataggctcctggcgactctctatgagaattatgcgggctcctgctccagtgagtatggagggacaagatctccactctgacaggggcccacagagcgacattccctggagtgaccaggccccttgtctctattagctgagccccccaagtctggggtgaaagagaagcgtaagaaggcagcatcgttccagacggtgtcccagctgcacaaggtaaggccccatctgggagacagaccctccctcttggcagcctccagccccgtccttcaccccctgccctgtcccctgtgccttgggcgggcggctgttaagacttgcagtgatgtttaactcctctccacgtgaacatcacagcaagtctgtgctgcttcccgtccctacgctgcctgggcagggtttgtggggaaggggtgggagccctggggctctgggagggacggggatttggcagggaagtgaagactttggtggtggtgatgggagacagcgaagggtctcccatcaccagaatgagagtgaaagagcaaaagtgcagggcacttagggccctgctcccgtctcggtcctgaccactgcggcatccaattctggttctctgccccctttgtgcctttccctcactcttccccactgccaggagaacctcaacaagctgatgaccaacctgcgggccacacagccccacttcgtccgctgcattgtccccaacgagaacaaaaccccaggtagtcacccagggctggcctggctggggccgggaggcatcatgggaaggtgacagggcagaggccgggaggctgagtacatcttccccctcacctcgcagggtctccactgctgctttttctctggggcctgcgggtgtgcctgttgacctctgaccttttcccctctcacgtccaggggtcatggatgccttcttggtgctacaccagctgcgctgcaatggggtcctggaggggatccggatctgccgccaagggttccccaacaggttgctctacaccgacttccggcagcggtgggtgaccccttccccctgcctgctgctccaggtggaggcctgaggggctgggcaggacacacatatcagagcccaacagacggtcccctgtctggagggggaagcagggactgtgaggggcctggccaggtatcccagcaagacatgggggtggctcagacctggccggggacttggggagaagtgaataggcttggggcaaatagtggaggtggagcctacaggcctcgctgataagctggacatggaattctggatgcagaaaagacgaatgatttctagttttgggagtgagcaacctgggagctaccagtggtagatttactgagctacaaaaacagggttttttgatttggaggagaggtgaagggatactggtttgagctctgttttgcgtgtatcaggtttgaaatgcctccagcagacatcctagaaaagtcatgggggagattgggattatcaatctggagctcagggcagcgggcagaaaggatgcagatttgggagttgaacgagaatcatgtggacgaggcttcatgagacacctggcacatagcaagcacctgggcagtgctgccagctcctccccgttccctcaatgggcaacaagcatccatcgttccttctccctccagaagtcatggtgtcatccacactatcctttgtaaacagaggttcacacagataccatacacgcacacacacgcatggtgctgtgaccttgttttttctaacagtctggcctggagatcgttccttatccccaggcgtatgcctgccatcgtcatccgtttttcttggctgtgaaacatctcacagtctggtggactgcatgctttgtttaatgagtccccctcatgaggggccttcacagcgtggctgtagcccacctgacccacacagccctgtgcatgtgtccacttagaagtgggcaggctgggagccctggctcttttgcattagaatttccccccaaatgggctgggcgcggtggctaacgcctgtaatcccagcactttgggaggccgaggcaggcggatcacgaggtcaggagatcgagaccatcctggctaacacggtgaaaccccatctctactaaaaatataaaaaaattagccgggcgtggtggcgggagcctgtagtcccagctactcgggaggctgaggcaggagaatggcctgaacccgggaggcagagcttgcagtgagcagagatcgtgccactgcactccagcctgggcgacagagcgagactccgtctcaaaaaaaaaaaaaaaaaagaattttcccccaaatgtttcttcagtgatagggtacagcatgtcaccttctactaatattttttgcctttaaaaaaattttaaaaatagtgcatgccttctgtaaaaagcctctttaaaaacttaatgaatgcatttaaaatccccccaaggttgtgtttttttttttttttttgagacggagtcttgctctgtcacccaggctggagtgcagtggcaggatcttggctcactgcaacctctgccttctgaggttcaagcgattctgcaattcttctgcctcagcctcccgagtagctgggattacaggcgcccgccaccatgccccactaatttttgtgtttttagtagagatagggtttcaccatgttgcccacgctggtcttgaactcctgggctcaagcaatccacccgccttggcttcccaaagtgttgtgattatgggcgtgagccaccgcacccagccaaccccccagggattttaagtggagtgtccctagtgtcccagtgtggtgacgcatccctggcccccttgtttggcatgtgccctgctggaacctctgcaccagcctcggagaggcccaggaacgagtcccctgctacccacacgagcctcctcagtccctgacttccccattctcagtggcctgtgccccatacccagccctctcctgaccagctctgccctcctttcccaggtaccgtatcctgaaccccagtgccatcccggatgacaccttcatggacagcaggaaggccacagagaaactgctgggctcgctggacttggatcacacccagtaccagtttggccacaccaaggtcggggcactgtgggatcagggctggccatggctgtggcggtcacactgggcagggttcatgcggatggttgggggttaccctggctgtctacctctccgcccccaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcaggtgggtgtgggaaggaggctggggacagggtgtgtcccctgcctctcagctcccagacccactggctctcccaaccctaacatgctgccctgtagtcagatcagcccctgtggctggttggggcaaggttctgttctgtgtcccccagcctccatttccccacctcaaaaaacggggtacggcacttgcctctccatttcaggacatcagcgtgtggcccggaggggtagcgatggcacccagtgtcttccaagactcttgcgggccgggccccaggcaagatactttctctgcattatcctggttaaagcgctgacggtcctgagaaacaggcgctgtgatggcctccactcagcagaagggtgcccgtgtcagagatccagagctagctggcacgtcagcccaggccgctgactccagagccccgtggcttaacagccctggtgtcttccgggaattgcagaggccaccaggacatggggggctcatgagccccttcactggaggcaggcctgtgggactgtgggcctcccctcaccctcacctataaagcagagctattaggagctactccatgaggctgctgggaaggcaaaacaagtgaactgtgctgagtgtcaccatttgtgacgggcagcactgagccaccttcacagcttggctgcccctccctagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgtgagtcagggttccccttgtgaccgggcgtccccagccccgagtacccctggctgctctgagggatagtacagcgagacccatggggctcaggccttatgtctctctgttccaaagatgccatgagatgaggcctccatgtcccagcctcaccaccccaaggcctcgtctggcacgtttcctggcactctcccctcgtgccaccttggcctcccgctaaagcagaggaaccccagctccccagctctcccctccctgcaatccctgaaaccaaacagacccatgctctcttctctggttaagggccatgggaacccaggtggcaggtaacagggtgatagccagagagcacagatcaaaggtctggaatctccccaggtccacagagcaagctttcctgccttcggcacatggctttgtgtatcaattgtgtgccaggctcaggctagtgcaggaggaacgttggtgggaagacagagatggccctgtggtcacaaaactcacctgctagtgcaggagactgtgacgcagctggacagtaaggaaatggggggtaaggatacctgagcccttccagggactgcctccaggagcccgtccgtggctgtgcagaggctgctgctgctcaccctgcccctcggaaggcctcagcccaacagcggggcagtgagcagcgggcttccctctcagaacccttgtttgggcctcactctgggccgccccgcacttctaactttcccctcttaatgctctggtgtgtccctctgcgctattgcccttccatgcccaagagcgagtcaagacattcctgagttctcagagcacagccaaactttgctacagaggcagtttcctctccagggcctggcctggtgtctctctgctggtttacctggccctcccccaacctggccccgttccgtgtgccctccaggagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctgaagctgacactggccaaagctgagaaggagaagcaagccactgagaacaaggtgtgggccgggccagctgtggggaagggccctgagccaggggccagctttggggccaggtggctgcaggtcccaccccggctctgctaagcctctgctttctggccctgggcatgtcactgcctttcctgggcctcagtttctttatctgtcaagtggggttagcagcacttaccccattagggtaggtggtgatgtgtgtaattggcctttactgagcacacgctcctaggccttgcacacggtaggtgtttagcacatgctggcaatcctcatccatcccggagtgcaagccccttgagggcaggaactccatgtccccagctcggcatcccgcaggtgacttctgcccttgagccctcgtgatggcccctgtggttcccagtgctggaggagggactccattacacaggagggaaagtgaggcaggggtaggcagcttaggttctcacaggtgctcactgaggaagccgggactaggaggcagctgccctgagcacatgctaatactgcacatggctggcatctgtggatttctcaccaggccaggtgtggtgctgagcactgcgggtgcatccactcgtgaatcctcattacaaccccatgaggagggtccttccctcaggcagaagcggtggaggctcggagtcaagtgacttgcctgagtcccatagctggaaggggcacttgctctgacctggtgtggtgtggtggccgctcagagtgcggggaagggcgtccccattctggccctggccctggcacaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacgtgagtcagggccaccccgagactgggtggcggggccggggtgccggctggcttgggccatggctgacccctgctgtgcctgctctgcagctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagtaggtgtggtggggcagcaggtgggggccttctgagcctgcacctggcccttgttcccttctggattcttgtggttcctgcggcattgcagaggttaagggtgggggttgacagatggggcactggggtgcaggggtagtgtcttgccctccctgtactgagggccctagccagggtccagggctgaggcctcagggcccagtgcagcaggtgcatggggtgaggtccctcagggcctgaaggggactggggggcgttatggggtcccaggcgggtgggtgggagttaaggcctgtgctggccacccactctgtggctcccaggaaggactccgagctgagccagctgagcctgcgggtggaagacgagcagctcttgggggcccagatgcagaagaagatcaaggagctgcaggtgcgtggggatcgggtgggtgaggcctggggtcagaggcccacagaggtgacagctgccccacgtgcccaccccaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggtgtccgtgccttcctcaccccatacccaccctgactttaaaccaatcccgatcccagcagccaatactgttcccacaccagcctccacccagtaccttatcctgagccctgacctcttcacctggtacacaaccctcatttctcagcctcctaccagtcctgaccttaagccgtgactcccaagccctgttccctgactccaggtcatttctgatccagcatctacttccagcctcagacccttgaaccagcagtagttgtgaccctagcccttgactcctgaactctgacttaatacctgtcctctcttcctgtcctgaaccccagcaccctagccttaacccctgacctttctaccacataatcctgacagctgacctctgaccattgtccccaggtgactccgcagctaccatcccaactctcaccctgacccactgccctgggactggcccagccctgtcagttctgacacctgttaagcccagcagtagaatctctttccctgactttgaacttggggctctgctctccctttgattcctgggcccacatctagcttaccagtctctgatcccagatcctgccatctgatgcacaaacttgttctgacatctaactcctgacccctgactcccaacctgggatcctaggccagtgcagagaagctgtgccggacctatgaggatcagctaagcgaggccaagatcaaggtggaggagctgcagcggcagctggcggacgcaagcacgcagcgtgggcgactacagacggaaagcggtgaggctggggctcagctggccacaccaggcagggctttggtgcagccctcaccagcctgacctgtccgctcgcctctttgcctgcaggggagctgagtcgcctgctagaggagaaggagtgtctgatcagtcagctgagccgtggaaaggccctggccgcccaaagcctggaagagttgcggcgccagctagaggaggaaagcaaggtgggctggcaccggtgaccatggagtgggcaggtgggcaccagagccactgggctgcactaacgctgaggtcactggtgtccctgcaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaagtgagtgctttgctggccaggccactgccatgcagagctttatgcctgtgcctgagccccgctgagggtgggtgaagggagctgctggggctgttctccctccttccatggtccacaccttgtctggttccatggcctagaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcagggtaggacctgccacacgccagggccagggtgctgccctggggtcggagcaactttgagttatgggggtgccctggtggggccaccctggaatcaggggtgagtggagtgacctgggtgggagtacaagccatgggggtggcctctcagcaccctgtccactgcagaggagatcagcgacctcacagaccaggtgagtctcagtgggaagagcatccaggaactggagaaaaccaagaaggcgctggaaggcgagaagagtgagatccaggctgcactggaggaggcagaggtcaggggctggctgcaggggtgggtggacactgacctgctgctccactggccatcccccccccccaccctaccctgcctgctctgtatccacagggggccctggagctggaggagaccaagacgctgcggatccagctggagctctcccaggtcaaagcagaagtggaccggaagctggcagagaaagacgaggagtgcgctaacctgaggtgtgtccatccttctcccgtccccacctcccgagagcagaaggggagggaagcagtgtgtactctgctctctagtctgtccctcccatgggactttgaggtccgggttgctgtctccattctagctgtgaacctcggagatgctaaaggacttgcccaaagtcacacagtgggggtggagccagtcagtccacctctgtctgcctgggcctcactcttgtccatgaacttgctctgatgggccacaggcagtcacaagagactttaaatcggggaggggtgactcatttgttctcaaaatgggttcgtttccaacggtccttgggcatttgtaaggacaggtatgcccttacgagaccccctttcatgccaccctcctcccataggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcaggtggggacaggagtccctggggacagagcaggtgcaggcctgctggctggctggctctgagactcctcttcccctcagaacacaggcctcctaaaccagaagaagaagctggaggcggacttggcccagctgagcggggaggtggaggaggctgcacaggagaggcgggaggctgaggagaaggccaaaaaggccatcactgatgtgaggctgggcaagggctgtggggagcctgggacagaattgcagagggacttccctgaggctgggcacctgaccagctcctcctccccaacaggcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtgtgtgcagcccctctagtccttggcgcaggcagggtgggtgacccaggggtgggcttggcatcaggctgtccccctgcctgcaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggtgaggcatcagcagcagctccaccctccaaggtcagtgacccagagggaagagagaagcttctaacatctctggggagatcagacctagctccttctcatggaacagaccccatgtgctttcccctggccaaggctggggctgcctctgaggggtggggcaggcacaaaaaggcacatgaagttggtgcgtcccaacttccttattcccgctgtggtattggtgaggatggacagtggcaataggaacaaagttgagaaccaggaggagctagctcccttcttggactggggcagggaccagaataagcatctcagtcacccaagcggaaccaaggccctgtgtgtgcccccaggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccatttaattggtttatttgctgttaataaattggcaacacaaggaagggccccatgtccaggctcaggcaggagcggctgcctcaggcagaggcagggcaggcacagctgccccgtgccccaagggatggagggaaaggcccctcacttctgggagaacccccttggatgaacacagcggccaatgagcaaacagaaccagaggagctacaggaaaatgaggcagaggggcaggcttgggggaaggcagcattctctggtacccaccacccctgcccagggctcagaagcctttgcctgggtccaaaggccagggacaagggaggcttggctcacagatggggggtgggggtcacccatatcttcctccccactctgggactgactgacagccaagaaaccggcaggagctcacacagagctaatgctaaatgtcctcttacctctgggtggccctgggccccagggttctgaaggaaaggtgggcatggtaccctgtcctcattatggggactgaggctctccatgacctagggccctcagacccagggggaccaagggcttctaggacttccctcccaccaagcctgtacccaaagacctggggcaggcagagagcagcagggaggaacgggaacagggcagggcgtgtggcatcgtacccacgctcacccacactggcccagcagcctcccgaggcctggcccaaggtcactcctcagtgaagtccctgtctatgtccatgtagggctcctcaatgtagctaacgagagcagagggtgactgccggtccgggttcaacaggatggacactgtctccttccagtatgagaagctgatgcaggagctctgggcaaagagggaggggctggggggcgcctggaggacccaggtcaagcccagcaccgggacacccctctgagaggccctgggtccgcggcccacccatcacccccttgagggtggggcactcacgttctctaggcaggtgctgtccttgtccttgtgcaggtagtgctgctgccagaagcgcagcaggttgtggaagttgttgagcaggaagccggggtacttcttgctgtgctccatccgctgcagcagccgcaggtacaggggcagccgctctttccgtcgggccagcatcaggatcaccaggctggtgttgaggcagctgacgttctcctgcaaggccacaggcccacagggtcaggggctggtgggagccccagtggcccctggtgaacctgggtagccatcaggcagggaggagagtggccccaggcctcgggccacccacagagctctccctgcacagaggtgagataggactgggggaagggggcccccagcagccccagtttcctgactgagcaccttcctcttccccacgcccacctcccaccccacctgaggcaacaacacctgtccctgtccagacctgggctcaagcatcactccttccggaaggtccgtcccaggcagggctgggtgcgtgtgttggggcggttatcccgcttcagaagtgccattcagcactagcctgcgcgcctcggtggggaaagagttctgccccactcaccatgcactcccacctggtgcttcacctcagaacggaaccaaagaccacctctgagaggtgctaagatcaccctcactctagaaaagaggggcaggaggctcagagaagggaaggctgcatgactattcagtgagggagttgggcagcctcaggtccgattccaaagcccagcagggcagaaggtgtgagggacgtggacatgggggaggcggggagagcactggcctgcaagtcagcctgtgacctgagggcacttgcgagccctccttccttaggccctgtctgtacaatgggacactgattcctcctgagcacagtcctcagaagagctgggtctccagagacgcacttctggagtgggggacagaaacctgctgggcaccaggacaaaggaagtggtttccaatcgaccttccctgctgtgtgtctgccggggcctctcacctgggtcagcgtctgcacgtggatgatgttgatgaggcggaagaggaaggacatctgcgtgggcacctgggatatgtaggcgagcaggcggcattcagacagtacctcggcaactgtggagggaggcaggggtgcagcaggtcaggcttaggcccagtggctgggtcgcccaggcctttcgtggagccccgcttgggtcctgactctgaagctaggagctcatcatcaaaacagcttcaacgaaagctgactgtggcagaaagaaggacctccagctgtcctgctaccaggcaaagccatgttctcagagtgcccaggagcaccccacctcatcctccagaaccaagctcagggcagctctccctcagccctccccagactggctccagacccgtgccctccatatcacacacagaagagttccctccacaggaagatggatccatgacgctgcattaagaaaaacaacgcaaaagttccactccttctgcagaggtcctagcgcaactggttttccacaccagctctcaggtgagtccggcccagtgctgagaccacaaggcacaggttctgctccgtccactagtgtcggagcaactgcttcccgcacaactgggaggcagggcaataaccgaaggtaccaaaatctgtgtggctgttcccctgaaacagaccctctggggcagaaaaaggaagcaaacggctaaattaccaacaaccgggatacttcttgctatcaatgacagtgaccgtgacaaggaacaagtgcctgactttttgggggtgtgggggggtcacaaaccctcaggagaatctgctggatgccacaagccctctcctaggaaaaaaaggaaacgcgtgcgcatacacatggaagtgcgttagcaagtccaggagggttcagatgcctgctgcaccacagggcacctgcgatgccacgcacagcacactgaggacgagggggccaactcatcgtgccaggcaataccagcccagaagaggaaggtctttttctggttttctttgcatcttgctagcaacaatggattttcaccttattaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctcccctcaccacccaggtactaagaggcactccccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttgaacttcatcagctcccccaggaggtcaaagtaactctggagcacatcccttgacttacactcgctgtccacaatgcagtaaaggatgtgctgggtgaggagggacagggtgaaggtgtcaacgtggctgcccccaccagggcctggcatggagctcagaccatgcattggctttgagcaagcatcctggggatggaactggcaacactgtctagattcttgtctgaggatgctggtggctccaaggacaggaccaggcctgacagacctcaccaggaggtggagcagactgggaatgcagcacaatctctcccctgcccagggcgtacagctgaagcctgtgacctgctctgtggtcaccaagatggccggggtgctcagctcctaggtgaggggagctgtcatcaccaggtctaaaacacaggccactgcctaagcactgaggtcattcaagtaaatgaaggacagaatttaaaagcaaaggacacattttgaccccatggtttgtctttgtgtttatgaacgaaattgtttaaatagagtttacaccaaaatactgagttttcatcaagagaataaagccaatttactcctttataaagttttctacattttcttgaagttacattgatttggatcaattcttttccacatggattttataattcgtgggtcagtttcttgtccatatgaaaaaatctgaaagaccaattataactttggccattctgctctaagttttactttttctgaagaccattattcaataaaggaaaattaacttttagtacaaaatatcttcagggtcaaaatgccttgctgggtaaccaaactgtcaccctcctgcatggcctggccaccctctaaacctgtcaccccgtaagcacccatggggaacccacagttggaaacccagggcaaaatctaaggcagcctgcacaggcatttggaagtcacgagatctgctctgctcctgatgaactgtttggggctcaggacaggacacagcaacgcgtgggctggggggagacggaacccaagacactggctgctccagatcatacctccaagaggcctcgcttcagcaggaacatctggtctgcataggaggtggtccctcggaggaaactctccacagcccgagcttgccaaaacctgcgacccaaatactggctcaggtggctaaggctgccctcttccggcccatgttcagttctccaaggggttgggagatgtttgttgccttttcatgtactcaacatttactgaacatctaccaagcatcaggcttcatcctgggcctggggacacagcagtgcccccatcctcacagagagccagctcagtggagaagtcttctatctgggtctgtctggaaggggctgtgtcacagaaagggtaacatctgggatcgaagggctggctcctgcgagcccccgtgaaacatactctaggccttgccctttcacaagaatgggaggacgtgcaattgaggggccaggaatgtgtgtgggaagcggacgaacacatgcagacaggccactgggctcacagacgatgggctggcctagggaagtagtggttgatgctgaccgagggacccagagggcacagcgggtatccacgacagggagtttggacaaggcactgaagtgacaaaggcccatgtgggcatgaagcctcctgacagctcacgcccggccctgatggaactctacctgtccactgacttcaagactcatcttagatgtatctaaggacctcagagaaggtctccctgtattcacccagcccccagccctagcagcggaagaggctttcctttgctgctatagctcctgggccaaccctggctccattccttcccacactgcattgaaacagcacagctctagggaattcatggcagggcccgtatcctagttctctcccacccataaggcaccagcacagaacaggtgcttggtgaatgctcggtcactgtgggctgcagaagaagctctcacatacctgtcgagtcaaaactacacaagatggcagtcaaaccacctctccccaacagtaattgtgcttcaggaggcatggacgctggtgactaaaggaggtattcctaacctcctgagaaacacctggctctgcagccccgcagaatcggcaggtacttttccccagactcacctgaaagacgactctgctggctccttcttcatgacctgcagcagacgagttaataagcccctcttcccatcacacaccaaactcctgaaatagaagagagatattggtgacagatctgagaggctgacaggggccctggggatgggtcattctgctggcttaggcggtgaaaaaccatggggacatttccaagtctgcaggatgccttcctgctccaactgggtccagagccccggagacccctgcagccacagaattaaactgccaagtgcattcccaccacatctcaggccagctttccttcccaggccagaaacatatccagaatcagacatggcttagaactgccagaggagagctgtttataccaaaagtgtgttgaaacaggtcatgccagtctgccagatggggaaagactctgccaatagggtgaggcccagcgtactccgtgcctgaggttcacttccagctggccttgggcaagtgtccacaactccaagcctcagcttcccagtctatgaagcaaaggcaggagatgaggaaatgactctggccccgtcatgggggaaggaagacggccaggcacgcaggggtctgggcccttcaaacagagcagctctgctgtgatccactgcagacatcagggcaggactgggtacaattttatttgaatgaagagttctgctaccttagaaaaaaaagattgggaggccaggagaggtggttcacacctgtaatccctggactttgggaggctcacttgaggccaggagttcgagaccagcctgggcaacatagtgagaccccatctctacaaaaaaaaagtaaaaacactagctgggaatggtggcgcacacctgtagtcccagctactcgggcggctgaggcaggagaatcacttgagctcagaagtttgtggctgcagtgagctataacaccactgctctgcagcctgagagaaagagcaagaccttgtgtctaaaaaacaaaacaaaacaaacaaacaaaaaaggttgggaaatcatggctcttgttggataaagtccactgtattctgacgcctgtgagactagccccccactgcctggctccaggtgaggcaaacctaacccaggtaatgcaacctaacacttggcagcaggtaagaggcttctgtctgtcctgcttggctgcagatgccaccaggcaagaaaggagcacataagcaaaggggctgaatgcacgagacaaggcggtggggcagtgcggagcacacatgacttctggcaggtgacctctctgaggctcacctcatctgtcaagtgcaggtactgatggggctcccctcctagggctgctgtgaggctccaatgagaaaatgcaggtgacatgaatacaatgcctggcacacaggagccctcaggacactgtagctgcatgtgagagaggacacgcgtgcatacctggatgtgctcaccggtgagcccccggggaacgtgggcagccgggatgggctgagggaaaagctgcacccctgcactcacctgtcggtgttgaggacagcttccacctcagggatgttggccttgagagagatggcactgagttcattcagctcctggttgttgagtaacaagtacttgttcctgaaacaaaatgggttggaggaggtaaaggacaggaactggggctgctgggtcagcaccaggctagtgtagggagtctcctgcccacttcctgtggacagaatctgagaagccaccaggcactttcctctagcacctctcactccagccagcacctgcaggagggaactctgggctctcaggcagtggaatctctccctggccccacccccatccccgacccctgcctgccacattcatcgacaaggccccttccctcagcagctctgggcctttctctttgcctacatttccacttgttttctcaaaggcaccaacacctcaacaggtccaatcacactcaagcctggccctgctgcagcagtcccaccaagcaccacggtcacacatcacacagaggcctggttaactgtgacacttcccccgacttgccatccaggcctgtcactgctgggtcctgtgttcccaggacaccagctccctttactaaaaggtatcccacaggaactgagtcatcacacggtgccaaaagtgatcttcagaatcaggactctgatcctgtcactcccggtgaaaacacttccacagcttcccactgcatttagaacagacatttcctgacttaggaggaggttatgtcctgataaacccatcgtatttgaaaatgccgttaagttgaaaacatattgaggccgggcgcggtggttcacgtctgtaatcccagcactttggaaggtccaggcgggtggatcacgaggtcaggagttcgagaccagcctggccaacgtggcgaaaccccatctctactaaaaatataaaaaattagctgggcgtggtggcacacgcctataatcctagctactcaggaggctgaggtagaattgcttgaacccagaaggtggaggttgcagtgagccaagatcatgccactgcactccagcctgggcaatagagcaagattccgtcttgaaaaaaagaaaaagaaagaaaacacatttaatatatctaacccactgaacctcctagcttagcctagcctacctggaatgtgctcagaacactgacttcagcctacagttggccataatcactggcaacacggcaggcacagcacagagtactggttgtctaccttggtgatcgtgtagctggtcaccatttttcttgaaatacattctgagctgcagctgcagctcagtgcccagcattgcaagagtattgaactgtttatcatgagcccaggaaaagatcaaaattcaaaattctacttctgtaccattgtgaagttgaaaaattctaagtggaccatctgtatataaaatccaggcctgtgactgtgacccacaacaccctgtgactgtgacccacaacgtcctgtgcagcccagcccagagccaagcccacatcactcccatcagctggccacaatggtcttccctcgttcaggggcttctggctagaacacacaccctctcacatgcctgttcactcaattcactacaagctgacacttcaggtcttggctggcaagccacttctgcaggggagagttcctgagtgtcctctggccagtcctggaccctgtcaaatgtctctcacagaccccgttcctctcctcctgaataccatctccacttatcactaatgctcaacggtggaatccttggatgaacaactgtctctgttttcagactctgcccttcatgagagcaggggccatggctgtttgcattcatcctgatatcccacagagtactcagactgaagagtctgatgaaagccagagactcacttcctcagggaaaacagcacagttccataacatatgtggtgccatttttcagaaggttaacatgcttcctggagcccttctatggctttcagccggaaaacctctcacagaggatgggtgcatatgatggaggtgccctggggccacagctgtctccaggcatgttctgttagctcaaatgcaaggtttttaaaatatttaaaccaacatttaaaatcaggacctttcacataaatcttaatttctgcctttgcttggcagaaaaaatcagaagttatgcaacagtgggcccagtttcctgtgcacacgcagctggctggagctgagctcactgaaattcttgttcactaagg

SEQ ID NO: 530 - DNA, 180031 bp, Homo sapiens
aggaggcagagcttgcagtgagccaagatcgtgccactgcattccagcctgggtgacagagcaagactctgtctcaaaaaaataaaaaagaatggaaagggcagtggaaagaaatgtgatggatgtggtgaggagggtcttcagggctttgtatgcccctctaaggtatctggattttatcctgaggtgaatggtgaacattcaaaggtgccgagcaagacggtgacagaaacagattcacattttagaaagatggctctgactacagaatacagtgaatgagcaagactgaatgcaaaaagacctgtcaggaagctgttgctgtaaacaagagataatctggacctaattaagagtgttttcactattctttttttttttttttttttttttgagatggagtctcgccctgtggcccaggctggagtgcaatggtgcagtctcggctcactgcaaactctgcctcccgggttcaaacaattgtcctgcctcagcctcccaagtagctgggattacaggcacctgccaccatgcccagctattttttgtatgtttagtagagctgggggtttaccacgttggccaggctggtcttgaactcctgacctcgtgatccacttgcgttggcctcccaaagtgctgggattacaggtgtaagccaccgcgcctggcctgtttataattttttttttttttttttttgagacggagtctcgctctgtcacccaggctggagtgcagtggtgcgatctcggctcactgcaagctccacctcccgggttcgcgccattctcctgcctcagcctcccgagtagctgggactacaggcgcccactaccgcgcccagctaatcttttgtattttcagtagagacggggtttcaccgtgttagccaggatggtttcgatttcctgacctcgtgatccgcccacttcggcctcccaaagtgctgggattacaggtatgagccactgcacccggcctgtttttactattcttaagagctaattttaaataaaaattagctgggcatggtggtgcacacttgtggtccctactaaggaggctcaagtaggaggatcgcttgagcccaggaggtcaaggctgcagtgaaccgtgattgtgtcactgcactctagcctgggtgacagaataagaccctgccaaaaaaaaaaaaaaaagctaattttatgggttaagtaagtttttctgggctttctaaggaaacaacattactgccgtagttttcatgggaaatcatattccaaacaacaaattacatgctaattagcatacaacctatttgcggactaaggactgtttgcaacttatttgcctttacaaatggtaacttctacagaagcctcatctgcttccccagttacaatcttaatctggatcatttccattgcaattgcaaaacctctttcttatgcagaggacatctaaaaacgggctgtttctaaatatgatcgtcaagaatacatctttttaaatgtttgtacaaaacagaggttaggctttggtatctgtgactgtaaactactcttggtacccagaaaagaaaataagaacacttacttcatgaaatactgctccagaatacggagatactcccaagtccaacagtgaaaggccttcaaccactgaaaaattagatatacaagttcactcagactaagcaggcagctacagaccaaattgttagatacccccacaaccaaaaagggccttagcgtttatctaaccccctttacctcatccccagcaagtggctttaagtcttgaacatttctgatgacgggaaactctctttcatggacagcatcctttttcattgtgggcagcactcattataagacagttttatgttaaactatctgcttccttttagttccttgtaactcttaccaactctcaaaaatgtctcatttatgcctaatcttccccattccaaagcacaataagataacaaattagaagctggtgagaaatgttgccatagtgtgaggaaatgggcagtcactctcatatgctgctcatttgagtgacatttgtattaacttttcgacagggcaatatgtgctttctaagtgtgtgccttctgacccagatatgatacttcttagggcagtttatcctatggaaataacctgacaagtacccaaagaggtatgttccttacactgttcagagtactgaacaattagaaataatctgaatgtccattaatgaaaatttatttcaatgaattatgacataatatatatctctatataatggaatgctttatacttaaaattatactgtgttataaataataaataacctctccctctccctctccctcaccctctccctctctctctctccacggtctccctctccctctctttccacggtctccctctccctctctttccacggtctccctctgatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacggggtttcgctgtgttggccgggccggtctccagctcctaaccgcgagtgatccgccaacctcggcctcccgaggtgccgggattgcagacggagtctcgttcactcagtgctcagtggtgcccaggctggagtgcagtggcgtgatctcggctcgctacaacctccacctcccagccacctgccttggcctcccaaagtgccgagattgcagcctctgcccggccgccaccccgtctgggaagtgaggagcatctctgcctggccgcccatcatctgggatgtgaggagcccctctgcctggctgcccagtctggaaagtgaggagcctctctgcccagccgccatcccatctaggaagtgaggagcgtctctgcccggccgcccatcgtctgagatgtgggcagtgcctctgccccaccgccccgtctgggatgtgaggagcgcctctgcccagccgcgaccccatctgggaggtgaggagcgtctctgcccagccgccccgtctgagaagtgaggagaccctctgcctgacaaccgccccgtctgagaagtgaggagcccctccgcccggcagccgccccgtctgagaagtgaggagcccctccgcctggcagccgccccgtctgagaagcgaggagcccctccgcccggcagccaccccgtctgggaagtgaggagcatctccgcccggcagccaccccgtccaggagggaggtgggggtcaacccccgccaggccagccgccccgtccgggagggaggcggaggggtcagccccccgcccagccagccgccccgtccgggaggtgaggggcgcctctgcccggccaccccctactgggaagtgaggagcccctctgcccggccagctgccccgtccgggagggaggtgggggggtcagccccccacccggccagccgccccgtccgggaggtgaggggcgcctctgcccggctgcccctactgggaagtgaggagcccctctgcccggccagccgccccgtccaggagggaggtgggggggtcagccccccgcccggccagccgccccgtccgggagggaggtgggggggtcagccccccgcccggccagccaccccgtccgggagggaggtgggggggtcagccccccgcccggccagccgccccgtccgggaggtgaggggcgcctctgcccggccgcccctactgggaagtgaggagcccctctgcccggccagccgcccggtccgggagggaggtgggggggtcagcccccggcccggccagccgccccgtccgggaggtgaggggcgcctctgcccggctgcccctactgggaagtgaggagcccctctgcccagccaccacccagtcttggaggtgtacccaacagctcattgagaacgggccaggatgacaatggcggttttgtggaatagaaaggggggaaaggtggggaaaagattgagaaatcggatggtggccgtgtctgtatagaaagaagtagacatgggagacttttcattttgttctgtactaagaaaaattattctgccttgggatcctgttgatctgtgaccttacccccaaccccatgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaaagaacagctttaaaaaataaataaataataaataaataagtggaagagaaaggagagcttttccctacagagaattctaaggatcaaatgtagaaggaacaaagaaatagaaaatcaccacttggcgtactccatccatagtaataatcacaaaaggcaagaatcatcaatggatgctaaaattagtgggcaaaaatatgagaaacagaatatttgcaaggggaaaaataaaattttacatgggcggtggttcatgcctgtaatcccagcactttgggaggccaaggcaggtggatcacctgaggtcaggcgttcaagaccagcctggccaacatggcaaaaccctgtctccattaaaaatacaaaaattagccaggcatggtggcgcgcacctgtaatcccagctacttgggagagtgaggcaggagaatcgcttgaacctgggaggcggaggttgcaatgagccaagattgtgccactgcactccagcctgggcaacagagtgaaactccttctcaaaaagcaaacaaacaaaaaagcataacctcagtctaactgtgagaagacatcaggcagacccaaatggagacataaaataactggcaagtactcttaaaaatattaagcctatgtacaactactaggtatccataaaaattaaatttaaaaaattgtaaatgttaagtctgaggaagtatcccagattataagagactaaggcgacaaaacaactaagtgcaaagtggaatcacaggttggatattggactagaaatggacattagtggggcaaattgataaaattctaataaggcctgtaattagttaatagcattgtatcaatgttaattttctggtttaggtcattgcactatggtgatgtagaatgttaacattagaaaaaggtgaatgaaaggtaaacaggaactcttgtaacttttttgaaaatctaaaattattttaaaattaagagttaaaattaaaaagtacactagagatctatatttaatgaagaaaagcagcccataaaatattcttaaatgaaaagtaggtcaaaagacagcatataaaatataataggtttttttggtgatttttttaaatgactattttagcaatttctcttggcttttacttattttcctttgcaaattttctgggggttgagggggtacatgtccaggtttgttacatgggtaaattgcatgtcatagaggtttggagtgcagataatctcatcacccaggtaataagcacagtacccgacaggtagcttttccatcttcaccctcctcccaccctccaccctcaagtaggcccaggtatctactgctactttctttgtgtccatgtgtactcagtgtttagcttccacttataagtgagaatatgctgtatttggttttctgttcttgcattaatttgcttaggataatgtctccagctccatccatgttggtgcaaaggacatgagctcattctttttttttttttaatgctgcatagtgttccatggtgtatatgtacattttctttatccagtccaccactgatgggcattcaggttaattccatgtctttgctattgtgaatactgctgtgatgaacatacacatgcatgcatctttagggcagaacaatttctattcctttaggtatatacctagtaatgggattgatgggtcgaatggcagttctgttttaggatctttgagaaatcttcaaactgctttccacggtggctgaattaatttatattcccaccagtcgtgtataagtgtttccttttctccacaaccttgccagcatctattattttttgactttttaataatggtcattctgactggtatgagatagtatctcattgtggttttgagatagtatctcattgtggttttgatttgcatttctctaatgactaattatgttgagcattttttcatatgcttgttggccacatgcatgtcttcttttgagatgtgtctgttcatgtcctgtgcccccccgccaactgtttttccaagacaggttctcgctctattgcccaggttgaagtacagtggcatgatcagggctcactgcagccttgacctctcaggctcaatcgatcctcccacctcagcctctcgagcagttgggacttcaggtgtgcatcaccatgcctggctaatttttgtattttttgtagagatggggtttcaccatgttactcaggctggtctcaaactcctgggctcaagcaatcttcctgcctcagcctcccaaagtgctggaattacagtggtgctggaattacaggtatgagccaccatgcccagccctttgcctttttttttttttttttgagacagagtctcggtctgtcacccaggctggaatgcagtggcttgatcttggctcactgcaacctctgcctcctgggttcaagcaattctcctgcctcagccacccagtagctaggattacaggtgcctgccaccagaccacctaatttttgtatttttagtggagtcggggttttactatgttggccaggctagtcttgaactcctgacctcaagggatctgcctgcctcagcttttcaaaattgcacatttttaaataggtttgtttgtagagttttatcttaaacttttataagcattcatttaattatttgaaagagagagaatgaacatgtactcaatgagaaatgcctggaaaaataaatatttaaatgttcacaatgaccatttctaggtgataagattacagaagatgcttgatttttttcatcttcattttatgaatctttagcaatgaggatgtattattttacaattattcaaaagaagtagtttttgtttttgttttggagacagggtctcgctctgtcatccagactggagtacaggaattacaaacgtggctcactgcagcctcaacctcctgggcacaagcgatcatcccacctcagcctcccaagtagctgagaacacaggccaatgccactacacccagctaaatttttttttggtagagacagtgtcttgccatgttgcgcaggctggtcttgaactcctgggctcaagccatcttcccaccttgacctcccaaagtggtgggattacaggcgtgagccactgcacctagctactttttatttttgaatcatgtgactgagttacctattaaaaaataggtaggcagggattcaaggagttcaagatcagcctgggcaacataaggagaccctgtctctataaaaaaacaaaaattagctggggcatggtgatgtgtgcctgtggtcccagctacttgggaggctgaagtgggaagatcaattgagcccaggaggtcaaagctgcagcgagtcatgatcatgctactgcactccagcctgggtgacagagggaaaccctgtatcaaataaacaaaaacagaaagaaaagaaaagaaaaaagaccactacatatttgtaaggagtgggctataattatgactttaaactttataagactaccctaaagaaggtagggtagtcctataatcaattttataattcatggtggccataaaataaaacaaagcatattgctcaagaccgttgtaactggtccttatactgcaaccaaaaggaaatctcaaggagctgcataaagaggttgctgcgtaatagctattaaatccttcactaacagctttactggagacccaaggagataattcatcaggtcaaatcacaaggcatttctcaatcttagccaatggcatcctaccacagagcagtaaaaaagcaactctacagggcaccagtatgcggccgtccaggcacatcactctccacttgtctggtttaatccagatggaaatttttgagacacagcttgaggacagactgcacaacttttaggcaattgcctaaaatgtaattcatctcagatatgcttttgctagatactgtatatcagtggatttgttagtgtattctctggcaaatgcctggagtgtggctctgctatattgatgattaaatatggcatcatattacttaattgataactgatctgggcaaagggtcagactatgtaaaacatgtaaaacatttttttgtctttcttttttgagactcactctgttgcccgggccggagtgtaatggcttgatcatagctcatcgcagcctcaaccttccaggctcaagtgatcctcccaccccagcctcccaagtagctgggactataggtgcatgccaccacacccagctaatttttaaattttttttgtagaaacgggctcttgctatattgcccaggctggtaaaaacatttttaaaaaccctaccatttactacaatattaaacagttgaccgggcacagtggctcacgcctgtaatcccagcactttgggaggcccaggcgggtggatcacctgaggtcaagcactcaagaccagcctggccaacatggtgaaaccctgtctttactaaaaatacaaaaattagcctatttgggaggctaaggtagaagaatcgcttgaacctgggaggtggaggttgcagtgagacaagattgtgccattgcattccagcctgggcaacaaaagtaaaactccgtctcaaagcataaaaaataaaaaaccaacaaaaaaaagtatatggctgggcatggtggctcacgcctgtaatcccagcactttgagaggccaaggagggtatatcgcttgagctcaggaattcgagactggcctggaaacatggtgaaaccctgtctctaccaaaaatacaaaaaattagccaggcatggtggagagtgcagctactcagcaggctgaggtgggaggattacctgagcccaagagttcaaggctgcagtaagctgtgattgtgccactgcactccagcctgggcgacagagccagaccccgtctcaaaaaaagaaaaaaaaagtataggaagaacataaactcagaatattttttgtttgtttgtttttgagacagtctcacactctgtcgcccacgctagagtgcagtggcatgatcttggctcactgcaaccttcacctcccgggttcaagcaattctcctgcctcagcctcctgagtagctgggattacagatgcacaccaccatgtatggccaatttttttttttttttttttttttttttttgagactgagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggcccaattttttttgtatttttagtagaggcggggttttaccatgttggccaggctgatctcacactcctgacttcatgatctgcccgcctcagcctcccaaagtgctgggattacaggcgggagccaccacgcctggcccagaatatttttaatggaatacatttagttttaatgataaacttattactatccttacttttctaattttggtgcacacgattaaaaactgtgacctggtctgcagtgcatttggaaacatctaaggtacatagatgtttcatctatgtacatctaaggcacataaaacatactggtacaagagtaccaacatcctctttaaaatagtgaatctactctccatagaaaagaataatcagggctgtcaaattctaatatatataaaaatgttccaataggctgagcattgtaatctcaatacgttgggaggccgaagtgggtggatcacctgaggtcaggagttcaagaccagcctgaccaatatggtgaaaccccgtctctactaagaatataaaaattagccaggcatggtggcatgcacttgtagtctcagctcctcgggaagctgagacaggagaactgcttgaacccagaatgcggaggttgtagtgagccaagatcgtgccactgtactccagcccgggcgatagaacaagactccatctcaaaaaaaaaagttccagtaatatcatgctgaaaacactttaaagtcagtttcacaaagtgcctattagggggaaaaaacaaaaagacaataaagatacccatagaactcaactttatgcctttctttttcctggagtatcctccaaaaataaaacctgtgaaaatacaccagagcatccaagtaacatttctcacttcatgggactattatctaacaactaatataagagctaaataattatggccaactattgtaaaatgtaagtttttttttttttgataaagactctcaactcttaactgataactaacccatgaagcaagcttatttaattaattaatttatttatttatttatttttagagacaggggccttaatcttttgcccaggctggaatgcagtggcacaatcagctcactgcagccttaacctcccgggctcaagctcagcctcccacgtagctgggactactggagtgcaccactgcacctgactaattctttttttttttttttttttttttttttgagacagagtctcgctctgtcacccaggctggagtgcagtggcgcgatctcggctcactgcaaactccacctcccgggttgacgccattctcctgcctcagcctcccgagtagctgggactccaggcgcctgccaccacgccaggctaattttttttgtatttttagtagagacgaggtttcaccgtattagccaggatggtctcgatctcctgacctcgtgatccacccgcctcggcctcccaaagtgctgggattacaggcgtgagccaccgcgcccagccagcacctgactaattcttattttttgtagagatggggtcctgctatgttgctcaggctggtctcaaactcccggcctcaagcgatctacccaccctggcctcccaaagtgctaagattacaggcatgagccactatgcctggccaataattcttagttaccttggtatacttttcctatgggtgataataaaagcatatcatcctgtataagacaaatattatttttcagtttcccgtatcaataaggacaaaagcttgttcaaaagcagtagtgtccctatacttctagctgagggcctaagaagcagcatcactccagctgcaatgaacacacctagcattcagaactttgtttctaaataacattctctaataaaaggagccagggcccttgaagaagtggtcaattccagggctgaactaagcaagataaacctggatcatcttatagttctagaatgtaataaagtgcttttaaaaaaaaaaagtgagatagaggtatggcaaaaggacaaaggggtcaagatgaaagcggtcccaatggccaaaactagaataatccaaacaacagaatgaatatagtatacagagtccagagtataaaatatccaaatctatactgacataaatagttaaataaatgcaaagaaatgacaactcttccttacagaagaattttaattattaaataaaaatgaatgagagaaacagaaaagtcaccattgaaacacctgagtaatgactgttacaggcaagattaacctatgaatgcaaaaattagtaggcaaaaatttaaaaacaggatatttgcagagctccaaagaatagcccctaaaatgctgattaattacaaagggaaacagtcactttatggtggagaaatctggcagacactacattaaccaagggattatggctgacatcaccagtattagggcatttcaatatgcacccctgatccaatgcactgagaggaccatatcatctcaggggtattcttccccaaaatccattacctccgtcaaaccacaagaaaacattagacaaaaccaaattgagggacattctacaaaatacctgaccagagctcttcaaagtgtcaaggtcataaaagatgaggaaatgctaaggaactatcacagataaacgactaaggagatataacaactaaacgcaatatgtggccaggcgcggtggctcatgcctgtaatcacagcattttgggaggtcgaggcaggtggatcacctgaggtcaggaattcgataccagcctggccagcatggtgaaaccccgtatccactaaaaatacaaagattagctggcatggtggcagggacctataatcccagctactcgggaggctaaggcaggagaatctcctgaatctgggaggtggaggttgcagtgagccgagatctcgccactgcactccagcctgggtgacagagcgagactccgtctcaaaaaaaaaaaaaaaaaaaaaaggggggggcgggcgtgctggctcacacccgtaatcccagcactttggaggctgaagtgggcaaatcatgaggtcaggagatcgaaaccatcctggctaacatggtgaaatcccatctctactaaaaatataagaaattagccaggcgaggtggcgggcacctgtagtcccagctactcgggaggctgaggcaggagaatggcatgaaaccggaaggcggagcttgcagtgaaccaagatcgtgtcactgcactccagcctgggtgacagagcgagactctgactcaaaaaaataaataaataaataaataaaataaaaataaaaatgcaatatggaatattagatcatagaacagaaaaaaaattagtgaaaaaatggtaaaactttttttttttttttttttttttttttttttttacacagggtcttgctctggtgccaggctacatacagtgcagtggcatgatcatagctcaatgcagcttcctcatcccaggctcaagcaatcctcccacttcagcttcccaagtagctgggaccacaggtgtgcgccaccaaaccagctaactcttttttaattttatgtagagagggagtctccctatgttgcccagactggtcataaattccagagctcaaggcatcccctcgcctcagcctcccaaagtgctgagattataggcatagccactgtgcccagcaaaaatggtaaaatcttaacaactatggtttagttaatagtattgtaccaatgctatcatcttagttttgatcactgtactatgactatgtaggatattaacattgggggaagctgggtgaagggtatacagatctctctgcaatatttttgcaagtattctgtaagtttaaaatgatttcaagtaaaaagctaaaaaacaggctggtgcagtgactcatgcctgtaatcccagcactttgggaggcagaggcaggtagatcacttgaggtcaggaattcaagaccagcctgaccaacatggtgaaaccctatctctaccaaaaatacaaaaattagctgggtgtggtggcacacacctgtaatcccagctactcaggaggctgaggcaagagaattgcttgaacccaggaggtggaggttgcagtaggccaagatcacaccactgcactccagcctgggcaacagagtgagactctggctgaaaaaaaaaaaaaaaagtaaaaaacaaaaaacagtggtatctagtctctggatccagctgcctatttgcaggaaatagagatgatagaggaacatgttaaattgtatcatgatatataatcaggaaaattcaaactatgggagatctgtctggattcttcaatagataaacactatggaagagaaagggaacctgggaccctaaaaattaagagagattgaaaacacaaacaaaaacttttttcttaggggcaagactaagcctaacggcaaatgaactagggatgttcatttgagtaataaaacttttaaaaatacaaagatgtcattacatataaaagtcaggataatagttacttatgaaaagagtgaggggattgtgacgaaggggggcttctgaagtgagtggcaaagttctgattcttgacttggatgacagttacaaaaatgttcaccttacaataattcaccatagaatacattgttatgtgtgtcttacaaattctgtttaattttgtaataacggctttttttttttttttgagacaaagtcttgctctattgcccaggctggagtgcagtggcatgatctcagctcactgcaacctccacctcctgagttcaagtgattctcctgcctcagcctcctgagtagctgggactacaggctcctgccaccacacccagctaatttttgtatttttagtagagacaaggtttcaccatgttgcctaggccggtctcgaactcaagctcaagcaatctacccacctcccaccttagcctcccaaagtgctgggattacaggtgtgagccacctcgcctggccataaaggcttttttaagtagtggtatcagaagtgctcttcctgaccctgattcttttatttttgagacaaggtcttgttctgtcgcccaggctggagtgcagtggtgcaatcttggctcactgcagcctccacctcctgggctcaagccaccctcccacctcagtctcccaggtagctgggactacaggcacacgccaccatacccacctaatttttgtatttcttttttgtagaggtggggtttcaccatgttatccaggctggtctcaaactcctaagctcaagtgatctgcccacctcagcctgccaaagtgctgggattacaggcttgagccaccatgcccagcaaccctgattctcatagctgtagtaggggtgggtttctagataagtactaatagcttgggctctaccctgaactcaaaaagctaagcctatacgaactgtcaatctttgggtgaaagcctcaggaaagactaaaacatggcagaaagtttctaacattattcctgacagatatctaaacaagatgatactggtggaacagccatacctaaagattgctagctcttcatacaaaatattattagcgaggtcaccttgggcaaatgacttaatctctccatgcctcaattttctcatttataaaatggggttgataacagtttgccattttagagatcaaattagtgcattaacacacctaaagtgcttagaacaataccaggcatgtaaaaagcatcatatcattgttaatttctttcttttcttcttcctttttttttgagacggagttttgctcgttgcccaggctggagtgcaatggcgcgatctcggctcaccgcaacctctgccccccgggttcaagtgattctcctgcctcaacctcccaagtagctgggattacagtcatgcaccaccacgtccggctaattttgtatttttttagtagagacagggtttctccatgtcggtcaggctagtcccgaactcctgacctcaggtgatccacccacctcggcctcccaagtgctgggattacaggcgttagccaccgtgcccagcctgttaatttcttattaattttttagaagctcctgcttttgtcaaacaggaaattcattccttaaaaatttatttcttggccgggcgcagtggctcacacctgtaatccaccactttgggaggccaaggcaggtggatcacctgagatcaggagtttgagaccagactgactaacatggtgaaaccccatctctactaaaaacacaaaattagccaggtgtggtggctcatgcctgtaatctcagctactcaggaggctaagacaggagaatgaatcgtttgaacctgagaggcagaggtttcagtgagctgagattgtgccattgcactccagccagggcaacaagagtgaaactccttctcaaaaaaaaaaaaattttctttttttataaggcagagtctcactctgtcacctaggatggaatgcagtggcacgatctcggctcactgcaccctccacctctgcctcccgggcccatgcaatcctcctgccttagcgtcccgagtagctgagactacaggtatgggccaaacatgtccagctaatttttgtatttttttgtagagacagagttttgccatgttgcccaggctggtctcaaactcctgggctcaagtgatcctcccgcctcggcctcccaaagtgctgggattacaggcatgagccacaaaacccggcctggaaatttatatgtattttagttacactatcaaataaaccgatggatttgtagaaataggtaacagaaaagatatttttcctgttgaaatggatatgttatttgtgcctgcccaacatcaatcttcccttcttttggtaacagcaccctaatttttcctatgggataccccccttgtgtacattttgggtgagactgcctcctttccaaagaggtagatacatgacccaggcagactacagtaattgaccgaagaattggtatatgacccaaatcagttcaatgtgacttaattccagagctttcgttgcacttattcaaaaaaaaagaggtcaggcatggtggctcatgcctataatcccagcactttgggaggccaaggcagaaggatcgcttgaggccaggagcttaagaccagcctaggcaatatattgagaccccatctctacaaaaaacaataaaaaacaattagcaaagtgtgggagcatgcaccaatcccagctgtttgggaggctgagtcaagaggatctcttgagcccagaaggatgaggctgcagagaattatgatcatgccgctgcactccagcctgggagacagagtgggaccctgtctctcaaaaaaaaaaaaaaaaaaaaaaaatcagtccatactatagccaatcaaaatctatttggatttggatccagggcccctttacccaaagaactgatcattcaaaaatttaaaatgtcagcccggcgtggtggctcacgcctgtcatcccagcactttggaaggccgaggcgggtggatcacgaggtcaggagatcgagaccatcctggctaacatggtgaaaccccgtctctactaaaaatacaaaaaattaaccgggtgtggtggcgggtgcctgtagtcccagctactcgggaggctgaggcaggagaatggcgtaaacccgggaggcggagcttgcagtgagctgagattgcaccactgcactccagcctgggtgacagagtgagactccgtctcaaaaaaaaaaaaaaaaaaaatgtaaaatgtcatgtgaaaccagaaggagtcctactttactatttttaaattcctgccttttagggtttatataatcagctgctttaaaaaatatcccatttaaggtaccctttgaagaaaagtaatgcttacagatgttgtaccttccctcccaaatgatacaaataatcatgctgatttagtcagatccagatgatgggtggttaacaaatctctctctctttctagtcctgacactggcctcaagctccagacctaaacctgtcagtattgtactatcacattatacacacatgaaacactactatgtcctttctgattcatctatttcagcccatgtcagcactatttttcctaatatctcaactcaaaaccttagaattcacctttttggctttcattattgtgttgagcttcaacatggattatctcgttgaacaggatacataatttcctattttacagatggaaacactgacgttagaattcatacagcttggccgggcgtggtggctcacgcctgtaatcccagcactttgggaggccaaggcgggcggatcacgaggtcaggagatcaagaccagcctggctaatatggtgaaacctcgtgtctactaaaaatacaaaaattagccaggcatggtggcatgtgcctgtagtcccagctacttgggaggctgaggcagaagaatcgcttgaacctgggaggcagaggttgcagtgagccaagatcatgccactacactccagcctgggcaacagactgagactccatctcaaaaacaacaacaacaaaaaaagcttggcgcagtggctcatgcctgtaatcccagcactttcacaggtcaaggcgggcggctcacctgaggtcaggagtttaagaccagactagccaacatggtgaaacttatctctactaaaaatacaaaaattagctgggcatggtggcgggcacctgtaatcccagctacccaagaggctgagacgagataacagcctgaacctgggaggcggaggttgcagtgagccgagatcgcgccattgcactccagcctgggcaacaagagcaaaattctgtctcaaaaaaaaaaagaattcatacagcttataagttgcagaactagagaaagagtcaaaccttttctgagattccagaccctgcactcttaattaccaaacaacactgtctcatctttggatccttcacctgtccatcctgtaagtaacctcctgtaagtaaccagatcctatgctttcttctcttccacatttattcaacagtaactacacacctactgtatgccagacataaaagaattcaggaatgaataaaacagaatccttcaaggagctcataatatagtggaaaaggccaggtgtggtagcttatgcctgtaatcccagcactttgagagacccagatgggcggatcacttgagcccaggagtttgagaccagcctaagcaacatggtgaaaccccatctctacaaaaaatacaaaaaaataataataataacaagtagggttggtggtacatgcctgtagtcccagctaccaactacttgggaggctgaggagggaggatgtcctgagcccgagaggtcaaggctgcagtgacccattatcactgcactccagcctgagtgtcagagtgagaccctgtctcttgaagaaaaaaaaaaaaaaaaagaggccaggcatggcggctcacacctgtaatcccagcactttgggaggccgaggaaggcagatcacctgaggtcgggagttcaagaccagcctgaccaacatggagaacccctgtctctactaaaaatacaaaattagccaggcatggtggtgcatgcctgtaatcccagctgcccaggaggctgaggcagaagaattgcttgaacccagggggcggaggttatggtgagccgagatcgcaccattgcactccagctagggcaatgagagtgaaactccatctcaaaaaaaaaaaaaaaaaaaaagagagagagagaaaatgtggaaaaaccggatataaacaggtaattatgagataagaaatgctcttagtagggtgtagaggaagaagggcctaatactgcctcaggttttcagttatccagaagaaaacaggaaccaaatggcttcgattcatttcaacagaaaaataatacgcagaggtaacaaatccaagctcttacaatctcagacatgaattattactatctttattaccattccccaactaggaaacctgggcaaattaacttctctaaatttcagttccctcatctgtaaaagggggaaaataacaccatctatcacatagaaataaatgtgaggactaaatgagaaaaggtatatgttaccatttttagaaaccttaactctattcataaaacacccattcattatgccgttccccataccaacattctatgggataacatcaaaacgttagccttggccaggtgccatggctcacgcctgaaatcccagcactttgggaggccaagtgagactgcttgagtccaggagttccagaccagcctgggcaacatagaaagaccctgtctctaaacaaaaaacaaaaacaaaaacaaaaaaactttagcatttaaaggacacaaaggggacttctggggtgctgatactgtttcttgaactaggtgctggctacatgagtgaatacagtttttaaaaattcattgaactctacacttacttaatatgcattgtatgtatactgtacttcagtaaaaaaaaaaaaaaaaaagttgtttgtttttttttaatcatcaaactctggcctaaacctagcttccaccccattactcccctgctttggacatttcacatccttgaacgtttcttcatcctatttactttctgctacctggaactctccttttctctaatctccctttcaaaaccctacatccttcaagagtcagctcaaatcccacattctggaaaactggaaaggtaggggatagtttattcagggtcagaatactaaggaaggaactgggtggacacataaagtatacttttcatgaattattataacgatttgtctccctcactagcctgtgcagctacttcaggccaacttcgctttctcgctgtaggcgttagtataaaacaatgttcggtgaagaacttagtaaggaacagtaacaaaaattgccctgcaagtcccagactgagaagagacgtctaaagcacacgcacactctcctcgcttaagcaaaattggtcccctcatcccggaccccctcacacataaccttttatcccagggagcacccctggcgatcccgccccaaatcccaaactcctctgcaagccgcgctccacaagcacctcctcctcttattccaacccttcccacagaccacactcctcggctcaggacactgaatgggacacgccccctcagatccccaccactaggtggtccggcccccagggcccaaacctcacgacactgtccccacgccccggtccccacgccccctcccctcaccagccccgccctcaggccccgccctctccaagaaccccacgagacagtcagttagttctctaggaaccgcgcgctggcggtcactgcccccgcctcccattcacagaggccgcgggagggcaggtggggcctgacagtctgctcgagccagtggcctcacctctcttccaagagctcagtggggacaccacctccacccgctcggaaatgaactcggccagactggagcggaacaaggccgcccgcactgtcacagccaccaccagcaccaggaccaagggagccgccatgataactggggcgggcgcgcgggcggggagggaaggcgaggcggaggagcctcgcgcgctgtgcgccacgctctgtagttccgcgggtgggcgcgcgctgccgctggcgccggagaggccagacgtggggactacggctcccagaaagccttgcggcgaggcgggccggagcgacggaaagcgggcgcctcaagctgcgtatgcagaaggtggggcgaaaccttctacgatcgcaggtgttttgtgaagccgcgccgctatagcggggctgaaacgctgctgaaagtagaagcggaagtagtcgccttcctgggattgtgagagacttttaaacagatgttaaattcactcttgcgtgtatgttttcaatgccaaaatgtttatttttatttttatttttattttttttgagacggagtctcgctctgtcgtccggctggagtgcagtggcgcgatcttggctcactgcaacttccgcctcctgggtagctgggatgacaggcgcccaccaccacgcgcggctattttttttttttttttttttttgtatttttagtagagatggggtttcaccatgttggccaggttggtctcgaactcctgacctcaggtgatccgcccgcctcggcttcccaaaatgctgggattacaggcgtgagccaccgcaccctgcccaaaatgtttatgttttttgtttttgagacagggtctcagtgccgtcgcccaggctggagtgcagtggcgcaatctcagctcactgcagcctggacctcccgggctccagagtagctgggaccacaggtgcgcgccaccacacccggctaagtttttgtacttttagtagagacggggtttcgccatgttgcccaggctggtaccttttatgtttttaaagagtgttaaatgtgtattttttaaaaaatttattctggcagttgtttgttaaacgccaactattttccaggcactatgttaggttctacagatgcgttttggagtagtagactgatttattagctagttcaacaagtcgcttaacccttgtgtgctgaaaaatgtgctgattataggctaactagggacagttgaggaaggcttagaaattttttttttgttttggaaacggagtttcgctcttattgcccgggttggagtgcaatggcgcgatctcagctcactgcaacctccgactcccaggttcaagcgattctcctgcctcagcctcccgagtagctgggattacatgcatgcgccatcacgcccggctaattttttgtaattttagtagagacagggtttctctatgttggtcaggctggtctcgaactccagacttcaggcgatccacctgcctgcctcggcctcccaaagtgctgggattacaggcttgtgtcatcgtgcctggccggaaggcttagaaattttgccagtcgcttttaaacacaggcatttttgaaaattaagacatataaacctacagttaaataacttatattgaaaacaacggaatacatattcaacacgtcactttctaattattttactacacttttttttatatgtgcttttgagattatttaccaccgctgtatcagtacagcaaatactatctctttctcttcccaaatggtggtgttcagtttcctcaggttgatagattgaaaatccctcccaatgcgagtgtttacaccacaggaatcagcaaacactacaaatcaggggtttggggtttggagagcccattgataagcattaagcagcacacttcattaattaatgtatagtaagtgcttaaatattagcaataataatattaaatgtgcaaggaaatttcatatttgtgaagaaaaggaaacaggctggacgcagtggctcacgcctgtaatcccagcactttggaaggccgaagcagccggatcacttgaggtcaggagtttgaaaccagcctgcccaacatggtgaaacctcgtctctattaaaattacaaaaattagccaggcatggtggcctgtgcctgcagtcccagctactcaggaggctgaggcaagagaatcacttgaacctgggaggcggaggctacagcgagccaagatagcgccattgcactccagcctgggcgacagagccagactctgtctcaaaaaaagaaagagagagaagaaagaaaacgaaacagtgtatgactgagaataactgctggtgtaataataagggtggtaacactagacaaggtgatcagggaagactctagaaagaggtgatatttgagctgagacctaaaggatgagaaattaatcagagcctccaagcagaaggaacggactgagtggggaaagagcaaggtatgtttgaggatcagaaagaaaacaagtatggctcaagtggagagaatagaagaagctgtggatggagagacggggggcaatcaggtagggacctattggccatgcttgagaatttgggctttattcaaagtgcaatccatatgccattggagaattttaaaccagaaatgatgtgaacaggtgtacatttttcaaacatctctatattcccacaagccctctattgggtgttggggaatattgcagtgacaaaatggcaccatctgcctttgcccttatgtaacttggaaagcagttgaagagataaaatagttaaagaataacataagtaaaatcacaaaccataactccagcctgggcgacagagcaagactccgtctcaaaaaaaaaaaaaaaaaatcacaaaccttaatgagagaaagaaaagggggagtgggccaggcgcagtggctcacgcctgtaatctcagcactttgagaggccatggcgggaggattgcttgagcccaggagtttgagaccagcctgggcaacatggtgaaacctgtctctacagaaaacataagaattacccaggcatggtggcgcatgcctgtagtctcagctactgggaaggctgaggtgggagaatcacttgagcctgggaggttgaagctgcagcgagccaagatcacgccgctgctctcaggcctgtacgacaaagcaagaccttgcctcaaaaaaaaaaaaaaagaaaaaagaaaaaaaatggccgggcgcagtggctcacacctgtaatctcagcactttgggaggccgaggcaggcagatcacttgaggtcaggagttcgagaccagcctggccaacatggtgaaaccccgtctctactaaaaatacaaaaaatttagctgggcaaggtggcgggcacctgtaatcccagctacttgggaggctgagacaggagagtcacttcgacccgaggatcggcggttgcagtgagccgagattgcaccactgcactccagcctgggcgacagagcaagactgtctcaaaaaaaaagaaaaaagaaaaagaaaaaaatgggagtgggattctaaaagaatgcaaaaataaaccctggggctgatagctttctggaccagtgaaaggggtagggtctcctttgggggaggggatcatgaagaaattagaggggcactcatcctttgagcccctgctgtgtgccaagtagtgtaccatatgcttaacacacatgagcttatttagtctgcacagccttccttcttaaagatgtgggtttttgtatccccttttacataaaaggagatatatgtgttgcatcatcttacagtgaagtgtattacatcataaaaagtggaagtaattgtaacactaacctcatagtgaatattgagcaaggttatacaatgtaaaatgcttagcacatacccagtgctcagtaaaggttacttagctgttatattatttacatcattctaacagatgacttaaaaatttatcttagggtgaggattgtctttgggaaaaacagtgattagccattgtagacagatgtgacccaaaccagtggttctcaaaatgagtgtgcatgaagtatgaatacaactagtggttctcaataaaaaaacacaagacccaaatacagaagctagaattataaaactcataaaagaaaacataggagtaaacttttatgacctttaattaggcaatggtttcttagataacaacaccaaaagcacaggcaacaaaaggagaaataagtaaattgagctttgtcaaaattaaaaacttctgtgttccaaaggacaccatcaagaaatgaaaactgctgggcacggtggctcatgtctgtaatcccagcactttgggaggccgaggtgggcagatcacttgaggtcaggagtttgagaccatcctggccaacacggtgaaaccccgcctctactaaaaatataaaagttagccaggaatggtggcgggcacctgcaatcccagctatcgggaggctgagacgggagaattgcttgaacccaggagctaatgttgcattgagccgagatggtgccactgcactccagtctgggcaccagagcaggactctgtctcaaaaaaaaaaaaaaaatttaaagactgggcgcggtggctcacgcctgtaatcccagcactttggaaggccgaggccggtggatcacaaggtcaggagttcaagaccagcctggccaagatggtgaaacccccatctctattaaaaatacaaaagttagccagtcgcagtggcaggcacccgtaatcccagctacttgggaggctgaggtgggagaatcgcttcaacctggggggtggaggttgcggtgagctgagatcatgccactgtactctagcctgggcaacagagtgagactccatctcaaagaaaaaaaaatttaaaaaagagaaatgaaaactggctcaggcctgtagtcccagcactttgggaggctgaggtgggaggattacttgagcccaggagttcaagtccagcctgagcaacatgataagacccccatctctacaaaaaattaaaaaaaaaaaagccaggcacagtggttcacacctgtaatcccaacactttgagagaccaaggtgggtggattgcttgagctcaggatttggagaccaacctgggcaacatggcgaaactccatctctatttaaaaaaaagaaaaaataaatacaaaaatgagccaggcatgatggcatgcacctgtagtcccagctactcgggaggctgaggtgggaggactgcttgagcctaggaggcggaggttgcagtgagccaagattgtgccactgtactccagcctgagcaacagagtgagaccccttcaaaaaagaaaaaagaaaacccacagaatgggagaaaattatctgcaaattatatatttgagtagggacttatccagaatgtttaaagaactgttacaactcagtaataaaaagacagtaataaaagacaaatacccaaatggagaaaggaattgaatagacatatcaccaaagaagatacacaaatggccaataagcatgtaaaaagatgctcgacattattagttattagggaaatgcatatcaaaaccacaatgcgataccatttcaaactcaataggatagctataataaaagactgacagtagaccaggcgcgatggctcatgcctgtaatcctagcacttttgggaggccaaggcgggcagttcatttgaggtcaggagttcaagaccagcctggccaacatgttgaaaccccgtctctacaaaaaatacaaaaattagctaggcatggtagcacacgcctgtaagcccagctactaaggaggctgaggcaggagaattgcttgaacccagggggcagaggtttcagtgagccgagatcacaccactgcactccagcctgggtgacagagcaagactccatctcaaaaaataaaataaaaataaaactgacagtaacaagtgttgacaaggaagtggagaaattagagcttttatacatggcaggtgggaacataaaatattgtatccactttggaaaacaggttggtatttcatcaagatgttaaacagaattgccttatgacccaccaactcaacacctagctatatatctgagagaaatgtaaacgtatgtccacaaaaaaaattatgcacaaatgttcatagctcattcataaaaccaagaagtggaaataacccaaatgaatggataagcaagatgtggtatacctacaatggaatataactggacaataaaaaaaaatgaagtagttatccatgctgcaacatagatgaaccttgaagacattatgctaaatgaaataagccagtcacaaaagaccacatgctatgtaattccatttatattaaatgtccatgggtgggcgtggtggcgcatgcctgtaatcccagcactttgagaaactgaggcgggaggattgcttgagccccaaagtttgataccagcctgagcaatataggggagactccgtctctataaaaaagtaaaacatggccaggtgcggtggctcacccctataatcccagcactttgggaggccaaggtgggtgcgtcacctgaggtcaggagttcgagaccagcctgaccaacatggcaaagcctcatctctactaaaaatacaaaaattagccgggtgtggtggcatgtgcctgtaatcccagctactcaggagactgaggcgggagaatcactttgaacccaggagacagaggttgcagtgagcgagactacgccactgcactccagcctgggcaacagagcaagaatccacctcaaaaaaaaaaaaaaaaaaaaaaaagtaaaacattagccaggaatggtggcaggcacctgtggtcctagctactcaggaggctgagacaggaggatcacttgagcctaggaggtagaggctgcagtgagccgtgtttgtggccactgccctctagcctgggtgacagtgagactcttcctcaaaaaatattaaaaaagagagaaatgtccagaagagtcaaatttatagaggcagaaagtagattagtgcttgcctagggctgggggtggtgactgggggagtagggaatgggaaatgactgccaataggtacggagtttcagctgggtgcggtggctcatgcctgtaatcccagcactttgggaggctgagggcgggggtggatcacctgaggtcaggagttcaagaccagcctgaccaacatggagaaacgctatctctactaaaaatacaaaattatctgggtgtggtggcgcatgcctgtaatcccagctacttgggaagctgaggcaggagaattgcttcaacccgggaggcagaagttgcggtgagctgagatcacgccatttgtactgcagcctggacaacaagagtgaaacctcatcttaaaaaaaaaaattagtaagcatcagaatcacgggggagatgtattttttattttatttatttttatttttcataaatagagatgggatcttgctatgttgcccaggctggtcttgaacgcctgggctcaagcgatcctcctgcctcagtctcccaaagtgctgggattactggcatgaccagcctagatttttgaagtgtaaattttctagttctgacctagagactaggcctggtgtggagcccaggaatctacattcttaatctctccaggtaattctaatgtttgtgattcagaagccataccttgggaaacaaaaaaataaccctgaaggcgtaggtgtccagtagcttacacaaaaaaagatgaatatagtaatgataactagcaaatattgagtgcttactaggtgctaagtactgttttaagtgctttacacatattatctcatttagtacatgtaccgttacaagtgctatctattatttctccatcaccaatgaggaaacagaggcacaaagaggtttagtaacttgcctaaggtcacatggctagtaagtggcagaaccaggatctgtctgttagctctagatactgtggtcaagctgctctgcctgagaaaatgagaagaatttgggttgtgttggattgggttgtgttgggttgggttgcgttgggttgggttgggttgtgttgggttggattggggtgctttcttgttgtagctgagaaggaagggtagggaatagaaaggaaggagataataaaggagcaatcatggtgttttgttttgtttttttcctgtgacaccagagattcctgtgatatgtgggttacctagagaggaagaaattgaggtgctaagatactaagtaaccactggaatgagtgaattgcaatcagtttttaatgaccttgcatctttccattcaagaatcagcattcttggaaaaagcgcaagattgattaagattaggtcttgtgcccaatcttaatcagccagaaaagtgtatctgtgagaagtcagatgatgaatttaccatattcgcctgaggacagcacaccctaaaggcaattggatgaagtcagttcgaggaaggcgaaagggtacagtcctgtgctgcataaagacattttggtcaacgttggactgcatataccacagtggtcccctacgattatagtggagctgaaaaattcctcttgcctactgatgttgtagccatcataacatcgtggcttaatttgttatcttttctatgtttccatatgtttagatacacaaatacttaccactgtgttacaattgcctgtagtatccagtatagtaacatgctgtacaggtttgtggcctgcaagcaataggctataccatatagcttaggtgcgtagtaggctttaccatctaggtttgtgaacctgctaataataatagtgatgacaaagacagacccaggcctccctgtactgtggtttatagtctagcagggagtcatacaaaatagaagtaagcaaacaaaataattagggactgtgaccacaccaaaataagtagggattgtgagggcaaaagaccaggaagaatgataatgaataatggaggacctactgtatattggatggtcaagaaaagcctttctgaagaggtgatatttcagctgacacccaaaggatgggaaggagccattgatgtaaagagttggcagtggtatgtattggaaggaggggatggaggttacaaacagcttgtaatgagggaggccaatgtagtcggagtgatacgagcaagatgtgagactggagaagcaggcaagggccagatggccttggtggactatggtgctaagttggatttttattctaagagaaatgggaagtgcacggaagggtttcaagttgagttggaacataatcatcatttaaagtttaaaaatatgcctctggccaggcacggtggctcacgcctgtaatcccagcactttgggaggcccaggtgggtagatcacgaggtcaggagttcaagaccagcctggccaacatggtgaaacaccatctctactaaaaatacaaaaattagccgggcatggtggcaggcgcctgcaatcccagctacttgggaggctgaggcaggagaatcgcttgaaactggaaggtggaggttgcagtgagccaaaatcacgccactgcactctagcctgggtaaacagtgtgaaactctgtctcaaaaaaaaaaaaaaaaagaaaagaaaagaaaagaaaatatgcctctaaggctgggcatggtgattcatgcctgtagtcacagcactttgggaggctgaggcaggaggattgcttcagcccaggagtttgagaccagcctggccaacatttcaaaaccacatctctaccaaaaaaaaaaaaacaaaacaaaaaaaaaaaactagccaggtgtggtggtgcacacctgtggtcccagctacttgggaggcttaagtgggaggatcacttgagcctggagggtcgaggctgcagtgagccatgatcgtgccacactgtactccagcctgggcgacagagtgagaccctgtctcaaaaaaaatttttaaaaagacacagcaaaggcctgatctgtgtgactgcggattttttaccagaagacaataaactacataaaaatttaaaaacaaacagtaacaaccacgtgggtgggtgtggaagtcagtagcatgtacgaaaaggtcattaaaggcttctttgaggtcgcaaaagtaaaaagggcctgatccagttcattgtacagattgggaaaaataaagcccagaggagcagtgccaggcccaggatcacacagcaagtcaatagtggcacttggcccagaaaccagggttctcactatcggccttttatactaacggcctcctggtcctgggctggagtctcccgtgaggcccactgggagacccatataccagctccctcctcaatctgagacccaagtattgtaagggcccaaaagaaggatttggatttacataacgccctgaggacagatttctgaaacccttccttcctgtcccctactcacaaatacccactattgtaaaagctatcctgtagcaacaagaccaaaatgtaaacttggcctaaaactggaaagctgtagataggctcttgcacctccaactttctttctctgaatccctctcactccccaggagccacactccctacaactgtgcatccaggcctctcatccccatcccccaaatatacacacatttctctgctctgagaaaggagataggtttgcttgttgcttcctggtatccattccccctttccctgacatccattagaaactcaaagatggctgggcacagtggctcatgcctgtaatcccagcactttgggaggccgaggtgggcggatcatgaggtcaagagatggagaccatcctgccaacatggtgaaaccctgtctctactaaaaatacaaaaattagctgggcgtggtggcatgcgcctgtagtcccagctactcgggaggctgaggcaggaaaatttcttgaatccgggaggtggaggttgcagtgggccgagattgtgccactgcactccagcctggcgacagagcgagactccgcctcaaacaaaaaaaaaaaggggaactcaaagatttgctgaatgaatgaatgaatgtgcaaatgaatgaatgaatgaatatctctaattcctttcttaaaactcttcattggctttccattgcacttaatttaagaaccataattctgaggccgggcacggtggctcacgcctgtaatcccagcactttgggaggctgaggcgggtggatcgcttgaggtcaggagttcaagatcaggctcagggcttagacatcccaatgataactgagactttgagctttgactcagagggaagcacaagggcgagttccagatgacaccctaaggctcatcttagggtggaagtctaaagtggtacagcactttgggagagtaacttgacagcatctgttaaatttgaaatgtacatacctatcaatcttgcagttgacttctctgaaaactattctgtatatccaaggatagtcactgtagcattcattgtggcagctaacatggtgaagccctgtctctactgaaaatacaaaaattagctgggcctggtggcatgcttgcaatcctagctactcgggaggctgaggcatgagaatcacttgaacccaggaggcacaggttgcagtgagctgagatcgtgccactgtactccagcctgggtgacagagcgagactctgtctcaaaagaaacaaaaagaaagcatatactccaagcattatctattacagttgccttagtcatttacttcacactcctacgggcctcagaatactttgcaacaatctttactatctccgacggagtgtacagctcaacattctttatagccacagggttttatagacttcacatcatcattggctcaactttcctgctgccttctacgccaactaccatttcactttattcaccgttttggatttgaagctgctgcttgatactgacattttgtagatgtagtatggctatgccggtacgtttctgcctattgaagaagatcatgttcttttagtattaaacagtacagttgacttccaatcaattagtttatatataggaatcttgtgtagcctgcagtggggttgtggggagcaaggcagaagcagccactccagagaggatttacatttatttcttccaggcatctgagagatcatttcagagtgggtcgctttttatattaatttctcagcttcgagattcccagccatgcaggtgatgcaaatgtgaacgccagactcatggagggtaggcatgtggtttcaaattctcaggagattattttccctcttacccaaagaccaggtcaagatggacacatcctttttgtctcccttcgctagtaggtgttggtttttcccctagtttgttctttcactgtgggtgtagcccttcaagggtcctagatttatcaagggtctcagttgcaacctctaatttcatataagcccaaagcttcaactccccaaatgtttctttaaaaacacaagctattgcagattcagttgtgccttttaaaggatgtttgttgtttttatttccagcatctccttgggttgtgtagcaggaagttcctgatattgtcagaaaaggaagtccaactcagtatttagtacaactgtctgtttacttgtctattttctccatgagtgtcaagctctgggaggtcaggaactaaggctgactcatctctgggacaaaacaccaggcccaagatctggcacaaagtaaatgctcagtgcgtttgttgatactgaacctccacttggtcacttctaatgatggggagctcactttctcccaaggtggcctctttcctttagagagggtgtgtgacctgagtgaccaccgggctaatgggggacagcctgcccctcatttatgtacaaccttcccaatacttagcttgtccatccagattctgcagaagggggctcaaggcctagacatcccagtaataactgagactttgagctttgactcagagggaagcacacgggccagttccagatgacaccctaaggctcatcttagggtggaagtctaaagtggtacagcattttgggagagtaatttgacagcatctgttaaatttgaaatgtacatacctatcaatcttgcagttcacttctctgaaactattctgtatatccaaggatagtcactgtagcattatttgtggcagcaaacaattgaaaaccacccaaatgtctgtcaataagaataactaaataaattctctaaagtcaagtcatacagtggaaaactgtgagccttttatttttgtttttttgagacagggtctcactctgttgcccagactagactgcagtggcgccatcacggcttactgcagcttcaaccttctgggctcaaaggatcttcccaccttagcctcccaagtagctgggactacaggtgcacactaccacacttggctaattactttttatttttgtagagatgaggtctcactatattgcccaggctggtctcaaactcctgggctcaagagatcctccaacctaggcctcccaaagtgttgggattacatgcgtgagccaccacacctggcctatgtttttttttggtttttttttttgagatggagtctcgctcttgtcacccaggctggagtgctgtggcgcgattccggctcattgcaatctctgcctcccgggttcaagtgattctcctgcctcagcctcctgagtagctgggattgcaggcgcctgccaccacgcccagctaatttttttacttttagtagagatggggtttcgctatgttggccagtcttgtctcaaactcctgacttcaggtgatccagctgcctcagcctcccaaagtgctgggattacaggtgtgagccactatgcccggcatgttttttttttttaataaggtagatctatgtatattgacataagtggaattccaagacatgttgctgtgagtctgtaagacagagtgtataatatcaagaaaacagacaaacctataagcagtgtaaattggtacatcatggaggctatttggtaatatcagtcaccttttttttttttttttttgagatggagtcttgctctgtcacccaggctggagtgcagtggcgtgatcttggctcactttaacctccactcccgggttcaagcaattctcctgcctcagcctcccgagtagctgggaatataggtgtgtgccaccacggccagctaatttttgtatttttaatagagaaggggtttcgccatgttggccaggctggtcatgaactcctgacctcaggtgatccatctgccttggcctcccaaagtgctgggattataggtgtgagtcaccgtgcccagcctaagtcaacttttaaaatgctatttaaacttttaaaataacctcaactgactaatccccactaatagatatttatattacaaataaatatgcaaaataatgggtaaaaatattaattgccacattgtaataacaaaatattggaaacaaactttttctccttatgagactggatatatagagtgcatctatttgatgggatactatgcaggtttgaaatagaatgaggctgctctccatatcgatatggaaaggtctgcaagatagagtatgaagtgatgaaaaaacaaggtgcagaatagtgtctctatgtttatgaaaaatacatgtattatatgttggattttattattttattattaattttttgagacagcatctcacatctcactctgtcacccaggctggagtgcagtggtgcaatcatggctcactgcagcctcaacctcctgggctcaagcaatcctcccacctgagcctcctgagtagctgggaccacagggctacaccaccacgcccagctaatttttgtatgttttgtaacaacagggtttcaccatgttgcccaggctggtcttgaactcctgggctcaagtgatgctctcgcttcagcctcccaaagtgctaggattacaggcatgagccaacatgctcactctgcattggatttgaaatgcatagaattcctctggaaggaatcacagggaactggaattggttacctccaggaaggagaccaataattgggaactgggaagggaaggacacctgcaaacgctgtactccctattgaagctttgtaattttgaactatttccttacaattaagtaaggaagtaaaaaatgttaaaccataattgtaaaactggaagcaaaacaagctgtacaaaacactttctatatgtacatacacatgttgtgtagaaaaagaaaagaaggatacacttcagactggtggcagtggcagaagttttctgggactggataacaaagggtggtcaagggtgaccttgactttatctttttgttgttgttggggttttttgtttgtttgtccgttttgagacggggtcttgctctgtctccaggctggagtgcagtggcagaatctcggctcactgcaacctccgcttcccaggttcaagcgattcccctacctcagcctcccaagtagctgggactacaggcgtgtgccactaagcccggctaaattttttcattttagtagagatagagtttcaccatgttggccaggatggtcttgatctcctgacctcctgatccacccgcctcagcctcccaaagtgctgggattacaggcgtgagccaccgcgcccggcctgttgttgttgttgttgttgttgttgttttttaacatacagggtcttgctttgctttttttgtttgtttgctttggggttttgtgtttgtttgttttggagttttttgtttatttgttttgagatgtcatccaggctgcagtacagtggtgcaatcatggctcactgcagcctgaaccttccaggctccagcaatcctcctacctcagcctctggaatagctgggactacaaatgcatgtcatcacatgtcgcttttatttttatttttattttttgtagagacaggggtctcatcatgttgctcaggctggtcttgaattcctgggctcaagcagtcttcctgcctcagcctcccatagagctgggatcacaggtatgaaccaccatgcctagccttgcttagatttttatataatctttctgttaattgttactttttttttttgagatggcgtctagctctgttgcccaggctggagtgcagtggcacgatctcggctcgttgcaacctctgcctcctgggttcaagtgattctcctgcctcagcctcccgagtagctgagatcacaggcacctgccactacacccagctaatatttgtatttttagtagagatggggttttgccatgttggccaggcagctggctggtttcaaactcctgacctcaagtgatttgcccacctcggcctcccaaactgctgggattacaggcgtgagccacagtgcccagcctgttacatcatttaaaatccattttaatctttaaaagtaggcttcaggtggatggaacacaaccacagcctggcaaaggaatgaggctgactctcctccttctgagggaagtattcatgttgtgctctttgtcccactgccttccccaaggacagcctggctcagtggaggcaccggggctactcctggcatcattccagagagcctctcttgtcacctcttacccacttggctccctgtcaccagtgttctgggctgggctgagaagcagcacagattaactattgggttgtatctccagaagccccatcgatgtcaggttgggcagagccagcccaggaaacatggaacatctgcctctggcctctcacctctttgttctcctacgaagcccggcttttttttctttttttgagacggagtctgctctgtcacccaggctggagtgcagtggcgcggtctcagctcactgcaagctccgcctcccaggttcaccccattctcctgcttcagcctcccgagtagctgggactacaggcgcccgccaccatgcccagctaattttttgtatttttagtagagatggggtttcactgtgttagccaggctggtctcgatctcctgacctcgtgatccacccgcctcagcctcccaaagtgctgggattacaggtgtgagccaccgtgcccggcttgccctttttttttttttttatagattttggcagttacttggaatattctttccctttgatactccactacctttttcctcataccccaatttatatttctgtctcatctcattcagtggagaggaggcatctgaaaaacccatcaactagatgtgcagggatttaatgttcctacattaattgtattttaggaggcatctaaaaaggacgatgcttaactatgaggaaacacacaataatgatggaattcctagcaccggtggagaagagatcctgaggcagaaaggccttgctatcactcttcagtcatgttgataggcaatgctacaaagggcttaagaacgtggcactgaggctgggcactgtggctcatgcctgtaatcctaacactttgggaggcccaggcaggaggattgcttgagcccaggagctcaagaccaacataggcaatatagggagaccccgtctctatacacaacaacagcaacaaaaattagacaggcatggtggtgcatgcatgtagtcccagctaatggggaggcagaggtggaaggattgcttgagcccaggaggttgaggcttcagtgagctgtgattgcaccaccgcactccagcctgggcaacagagtgagacctcatcttaaaaaaaaaaaaaaaaggccaggcccagtggctcacgcctgtaatcccagcactttgggaggccaatgtgggcagatcacaaggtcaggagattgagaccatcctggctaacatggtgaaaccccgtctctactaaaaatacaaaaaaattagctgggtgtggcggcgtgcacctgtagtcccagctgctgcagaggctgagacaggagaatggcatgaacccagggccaagaccgcaccactgcactccagcctgggtgacagagcaggactccgtctcaaaaaaaaaaaaaaaaaaaagaatgtgggcactggagccaggctgcaggctgacagattcgtatctgtcacttagcagctgttgaacctttgacaaataacctgtctgtgcctcagtttccaaatctgcaagatggagataagagtagctcctttataggactgttgtgaggctgtaatgagatattacatgaaaagcctgtagtcccagctactcaagaggctgaggctggagtaccacttgagcccaggagttcaagtccagcctgggcaacatagtgagaccctcatctctaattaaagaaaaaaaaagagatttaatctctctgtaatccccatcactttgggagtctgagacaattggatctctggagcctgggagtttgagaccagcctgggcaacatggtgaaaccccatctctactaaaaatacaaaaattagccgggcatggtggcttatgcccatagtcccatatactcagcaggctgaggaacaaagaattgctcgggcccaggaggcagaggttgcagtgagccgagattgcacttgggtaacacagcaagactctttctcaaaaaaaaaaaaaaaaaaaaaaaaaaaaatcggccgggcgcggtggctcacacctgtaatcccagcactttgggaggccgaggcaggcggatcacgaggtcaggagattgagaccatcctggctaacatggtgaaaccccgtttctactaaaaatgccaaaaaaaattagcaggtcgtggtggcggccggcgcctgcagtcccagctactccggaggctgaggcagaatggcgtgaacccgagaggcggagcttgcagtgagccgagatcgcgccactgcactccagcctgggcgacagagcgagactccgtctcaaaaaaaaaaaaaaaaaaaatcaaagggcctccgatctatgccaaccactccttaagatccctttggttctcaccaatctctcatatcccaccactgcctttcagtggccttcactcaccaaacctgttactcttcatcaaaaactgtacccctaggccctttccctcaggcctcgctttttttctttttttcctctcacctctccatcctgtccctgttaccctgttatctcagttccatatctcaaaagcctagaaaggcagacaagacagagctctccttaaaaagtgatgggcaggccagctgtggtggcttacgcctataatcctagcactttgggagatcaaggcaggaagatcacttgagaccaggaattgggcaacatagtgagacgcggtctgtacacaaaattttaaaaattagctgggcatggaggtgtgtgctgtagtcccagctactcaggaggctgaggcaggaagattgcttgagcccaggagttcgaggctgcagtgagccacgattacaccactgcactctagcctgggtgtcagagaccccatctctaaaaaataaaaaaagtgaaggccaggtgcagtggctcacacccgtaatcccagcacttcaggaggccaaagtgggaggactgcttgagcccaggaattcaagaccagcctgagcaacaaagagagagagagagagagagagagagagagagagagagagagagagagaaaggaagggagggagggggagagagagagagagagaaagaaaaataaattagccaggcatggtggcacaggcttggataattttttaaaaactatttgtatagaaggggtcccactatgttgtccaggctggtcttgaattcctggcctcaaacaatcctcctaccttgacttcccaaagttctgggattacaggcgtgaagcctgcgtgtatcgattttctattgctgtgtaacaaacaaaacctccacagacctaggggctcatgacagcacctgtttattagctcacaattctctaagtcagaagtctaggcacatctgggttctctgcttgggatcccacaagtctgaaatcaaggtgttggccaggtgtgtcctcatatggaggcttgactagagaaagatcaacttccaagctccctctggatgttggaagaattcattttcttgtgaccatattagcaaggccctgttttctcactttctgttggcaggggaccactctcaactctcagcttgtagaggtccctcttgggtcctcctcttgtggccctctccacacatagcatttggtccttcatgggagcaccagctgctggaaaaaatgattctgttaggtaaaaatactatacatttttgaaacatgcaccaattatttagctctgtgattgtgggcaatttcttcaagcagcctgagcctcaatttccttatttgtaaagctgggaaaacaacgatgcccatcttggagggttacaggcacatagaaaaacaatcaataaatataagctgctgtttacatttgttctttttttaaaaatttttaaattttatttatttatttattttgagacagagtcttgctctgtcatccaggctggagtgcagtggcgtgatctcggctcactacaacctctgcctcccaggttcaagtgattgtcctgcctcagcctcccaagtagctgggattacaggtgcacaccaccacgcccagctaatttttgtgtttttagtagagacgggttttcaccatgttggccaggctagtctcgaactcctgaccccagggcatccactgcctcccaaagtgctgggattccaggtttgagccaccacaccaagcctacattagttctaacgaatagacagggtctagacacagtgagattagatgagtgagggacagggttccctacatggagaaaactgcaagagccaaatcttggaagcaggaaagctggtggtttatttgtgaagggtgtgtgtgtgcgtgtgtacagagaacgctgaaagagtaggtgaacacagttttgcttatccctccagtcagaatttactggatgcttactgtgtacccagtaccatgaaagggtgcccggccagcagtgtgaattcagcctggaagtgggagggagccaaggaagagctctgagttggagagggaagtggtctaagcttcgggaaatttatctgctcctagtagagtggttgactcagcaggagagaacccccttctcttctgcaccctctcctccctagcctcaaagcctgctaaggacccagttcccaagcagagacccaggagggagttgcagaatctggccctgtctggacaagacagacagggtgcgactccagatgccagttcctttctttctgctcctgaatggccccaaagctatcccttctcaccacaatggtcaaggagggatacagcaatttctcttttaaatgttacacatagggctgggcacggtggcctctaatcccagcacttcaggaggccgaggtaggaggattgcttgagcccaggagttggagaccagcctgggcaacataggaagacccctgtctctaaaaaaaaaattagaaaaataaagttctaaatgtgggaaatcatgctgggcactcaactacagcagctcacttgggtacttgtccacactcacaaatatagccctgggaccccaaagtcactgtcccaccctcacaccatgggcagatggactcaaactaagccaggcttttggctttctgccacttgcctcttctctctgaagtgaatcctgtcctgatcatcacctccttgctgacagggccattaagcgcagttcacacaaacaaaccacgatgccttgaggttgagactgggaggtatgttaagggagcatggagccagccattctgcagatggggaaactgaggcaaagaaaaaggaagtgacttgcccaggctcaggcagtgagcccaggacagaccaagactgaaatctgacaatcagcccagggtttatacacacacacacacacacacacacacacacacaccccacaatttgagttacgctcaaattcagacatcgtgggttgaacaacaaagctttttttttttttttttttttttttttttgccagagtcttgctctgttgcccaggctggagtgcagtggtgcgatctcagcttactgcaacctccacctcttgggttcaagtgattcgcctgcctcagcctcccgagtagctgggattaaaagcacctgccatcactcctggctaatttttgtatttttagtttcaccatgttggccaagctggtcttgaactcctgagctcaagttgtgtgccggccttagcctcccaaagtgctggcattacaggtgtaagccaccacacctgggccacaacaaagctttttgaatagaagttcttggaatatggcctcttgttaatgtgtaggcccatctgttgggggaatttggggattatgcctgctctagctggctttaccaattaaatgttttcccctctctgtctcagttttttcaccggtaagataggaagaatttattatctatgtcagagggattcctctcagcctcactctctatctcaggtcggggggcaggggagggtggggaaggaaaggagtggtgggccagtcctccagctaagcacacagactggcccatacctgcaagtacacacaaggtcccttgagcgacacacccaggctgacacatcactttaagggggcacggaggggggcaggcagtgggagtggcaagccagtggggagcccccaggtgagggcaagcccgaggaatagaagggtggcctctttttttttatttttgtttttgagatggagtcttgctctgttgcacaggctggagttcagtggcgtgatctctgctcactggcaacctctgccgcccggattcaagcaattctcctgcctcagcctcccaagtagctgggaccacaagtgcatgccaccacgcctggctagttttttggtattttttagtagagacagggtttcactatgttggccaggctggtctcgaactcctgacctcaggtgatctgcctggctcggcctcccaaagtgctgggattataggcgtgagccactgcgcccggcctgaagggtggcctcttgacctccagtcctgcagcccatgaaattgggcaggtactcacacctgggcatgggttagatgggcgtgggtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatgattactggcctgcactgccgcgcccagctctgctgcctctttttacagcctgccggcccagaccagagtctcagaatactaagcccactttctggggccagggtcagtagatagctttgctgctgtatgattctaagcaagtatcttgacctgcatgtgtctcagtgcacctcagtttcctcacctataaaatgaggggtttggatgagttgaggtctgaagcctcctccagcccaggtaataaatctttgtagtggacaggaggaataggtcctaggggtttcaggaggggacttccatgggtacctctgactctacagagaaatggaagactgagatctgacttagcagcctagaaagacttagcagcctagaaatggggttcagctaattctgggaacagagtccggtcacttaaggtaccagagtgtagccaagagcccccttttctgggcttggggaaccagaaccatgtgttcaacagaccattgcctgtacacagggtagagagtgcaggtgtatactcctgaaccagccacccttcttttttttttttttttttttttgagatggagtctcactctgtcgcccaggctggagtgcagtggcacgatctctgctcactgcaagctccgcctccccggttcacgccattctcctgcctcagcctcccgagtagctgggactacaggcgcccgccaccacgcctggctaattttttgtatttttagtagaggcggggtttcaccgtgttagccagaatggtttcaatctcctgacctcgtgatccgcccgcctcagcctcccaaagtgctgggattacaggcgtgagccaccgtgcccagcccccagccacccttcttaagcttcaagctataactactgagcctgtgatgaaagtctactctatgccagacccccacaagctgggtgcgggcagtatagggacaaagactctgcccttgggatgccaaccatccacttgagaagacacatacacatacaatgagtcatcatcacttactgtttatggacaaataaacgtccatcaaggtagccatcaactcgtgggtagggacaaggaaggctacctagaggaagaaagggtgagtagaatctctccctctctctctcttttttaagagacagggtctggctctgtcatccaagctggaatgcagtggcttgatcatagctcattgtaacctaaacccaagtgatcttcttatttcagcctccctaagcagctgggactacaggtgcatggcatctggctaattttctcattttttgcagataagtggtctcgctatattggccaggctggtctcaaactcctggccccaagcaatcctcctgccttggcctcccaaagtgctgggattatggctgtgagccaccacacctggccaagtagaatcttgaagacaggaaagatctggatttcagaaagttctgaagaaggcattccaggcaggggaaacagcttgagcaaaagggtggaggtgggagagtgctgtagagtcaacaaggagtttgactttagcacaagatgcgtgtaggagaaggggaggtgaagctggagagaactggggccggagcatggggggcatgagttctgtgttaggagtgtggggctttaggagccacatcaggttttagaacaaacaagtggcttgacaggagagacgtgttagggattatttaattaaagtcagcaagtaggtctgaaagggtatgaggttagcaggaagtggctgtgatgggcagaggctcagagttgcatggaatgaggacactttgggtataacactccaagggccacaatgccactcccctctccacccctcagccttgggttatttttttctggcttcttcccctgtcgctagggttaaggagtcccttgggggtttcagatgaggctgggatagagttttatcactagagtgccgggcacggtggctcacgcctgtaatcccagcactttgggaggccgaggcaggcagatcacaaggtcaggagaccgagaccatcctggctaacactaaacatacaaaaatacaaaaaatacaaaaaattagccgggcgtggtagcgggcgcctgtagtcccagctactcgggaggctgaggcaggagaatggcgtgaacccggaaggcggagcttgcagtgagccgagatcgtgccactgcactgcagcctgggcaacaagagcgagactccgtctcaaaaaaaaaaaaaaagttttatcactagatcattaacctctggcctaggtcacctccggcctccttttgggctaggtgggcagttctcggaccctcccccaccagccctgctctgctgacctagaacctctggccctggagattctgatatgtgtatttgtggtctcttctcgggcatctcccaggccactgggagagctggggcctagagcgtggggtgggtggaatcctgagggcagagagtgtggaagaatcttacaatggcagctctagagggaagcctggatatgtttgtttgacaaactgagacccagagaggtaacatgacttgaggtcacacagcaagtctagggcacagtcaggactgaaagccaggactctggggaggctaaagcgccctgaggtttagaccatctggttcatgtagagaatggagagggtcagggctgggagctatgggttcaaatcctggctctgccattgactgtacttttgtgacctaagaaagtcacttgagctctctgagtctgtttcctcaactgttaaacgggacaatatctaccttttgggttgttgtgaagataaaaaaacacacccatagcacaggtcgtggcacacagtaagtgtgccaatacatgtcagctagtggtatggtggtgcaatagtaggtgcctaataaatgttgaatgcattgttgaacatgagttcacacgctaacagtgagattgtgagactcagctttcccacgtgtaaatcaggactcataatcagtccctgtcctgccacttctttacagccccggtagcaacatagattaaataaggtatgtaaacgttcaagcgcggagccgtctcaggtcaatgtttactcagcccagggcaattcctctccaagtcctactctgcgaaatttcacgtcagcttcactaacttctctacattcccagatgctccccgggaaccgggggttggggatgtccctcttttctcaagcccgccgagctgaggaaaaacggggtgggaaagcagagtgtgtaaggctgaggaggtgagccagaggggggagggagagcaggaataagggcagtggggagaatgcaggtgcacggacgtggtgtgggtcgagaacagggtccgcatcgggggacttggatataggatgcagtgaaaggatttggggagcagtgggagaggtgagggcgctgcgatccgggaagaatcaggaaaataaggagccggtaggagggagtggagatcctcctcgcggagagctcgccgcggcgcagggctcccagctccccgcagctgcctccccgaacactcaccctcccggttccgagaacgtttcccggcccgagcgcccggcccgcaaaccgggaggggaggggaggggaggggcagggggggatccgcagcccgggattggccgccgccccgccagccggtgacgcgaggcgggcgggcccctttgtgacgtcacaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtgagtcccgacccgggtgggcctgggggctcccctgccacggacacgccctgcgccccccgcgcccgggcctttgtctgtctccgccggcggccgccggggccgcgttcccggctcccgattggttgccgcacgcccggtagaccatgacgtcgttctatttgcatatgacattgagacgtcaccaaggccggtaccgcccccacaggctcgggtcgcttgtcctcccgtgacccggtagccgctgtgtcggggctgggccctgggtgagacgctgcaatccaaagggggctgcagggggatcggcgatttcctaggcttatccaggggctggggtcaggcctctgatcccctactttctctttgcaacctgagaaggagtcagacggcgctgctgggcctaggttgagggggtcgtcaggagttcagggctgcatgggactccaggtggttgggacagcaccagatggtggtgggatcccctccctccggctccagactccgcccccagggactaacagaataacatcctcctaatccctgatttgtgtgcagcgccttagctgatgtcactcctagacccaaaatgaagggtcttagaccccagtgcatggaaggggcaacaggcccagagaggaggattagctctctcgaggtcacataaccaattagagtcatgctcactgagtgacagatggattattagccaggggcaaagacataataggggctcagtacaagtggtaagatacacatcctccttccactggggacccgatcttgggctcagccttatcacggtttgataggctcctaggtgtccttactcctggacccttttccagggaatctctggagattggttcaccttttgtggtcctgaccccttctgtcctcactgtaccttgaagtcctagagtccaataaaatcgctgcctcccagctgtttggatcacagagaggtgagtcattggctgcctcggggtgtctccagggctgatgttggggtggagggtggggtgagggttccctctattggccctttaccttcccaacttcctaggtcgtcagctaggaagggcctgacctggcctagtgcagacaattgcaggtgttttgctgctccctcgtcacctctgcccacagagagtataggagaagggataggataaggagagtttctgacttaacaagtggatgggcctagaggctgaaccaggaactccattcctgctgggagtttgctcaaggatgggctgggggtaggggtggcttagggcacaaatgctattctgggcagagctgctgtagttattaaagggaatggttctccctggagcagaactgggaatgtgagaaccaggaagctggcagggctgggaaaggaaatctgggaggctccccaagtggtcaggagagggggcaggcactggctggctggtgactgctttcactcctggctgtcactgacttgctgtgtgacctcaggcagggagcttttcccctgagcctccctcccctaaacctatctgaaatttggggaggcacagtgcaggctctggtacacagtgggtcttcagtaaatgcatgctaaatcttggtgccagtaaccccagacccttttgtagctaggcgaggggtggtgtggctaggtcaaggtctttttcacctccctgtacccctgcatcattgtattcttggggattgtttgctgagtctttcctgactgtgtacactctggactggatgcacagtaacgtgggactaggtctgccctgccactatctagccatgtatttttggatagatttatgtcttctttctgatcatcagattttaaaatgggctgggtgaatatgatggtccctgaaacagctcttaacttctctttcatattccatgaattagtaggttcttggaaggaggatgtgcctcatcaaggcctcgatattcccttccttcaagaggggccaaactttctgggcttttggtaatggagtcactagctccctgtggctacatatgggttgggatacatgaattgtgctgggtggacactagttgggggtggccccaccttcttaatccctgtagatctcccacccccatcccaccagagaagccagcatcttaagcctactgtgagtctgcagatgtggaaatattctcagggtatggaagtgaggtgattctgcagcaagtgtgaaaacatttctagggaatgggggaggtagcaataagcatggcaatactgcaggtggattagcagaaagaggagaaatgccttcagggaagtctggacatgcccccaggaagttctacaggaagtgtggaaacacccttagagaatggtgacaagtgtctcagcagcaaaaccgttgagcatctttagggaacaggtgtggagagtcagtcaggcttcaggtactgggggagtatggccagcagcccccagccaagctctagtcctgaggtaggctggcatggggagggggtagatctagagctaccaccttggtgtttccatttctgcagtagggggcctccctcttcatcttcacccagggaaggattggttaagggcttacctcggtctgggtccaaccctcagtgctcatccttaagggctcctgggaactgacagctccctcccttcatcatcacctcccactgacctgctgtctcactgagcccaagcaacctgatcttcctcctacccctggatgctgcccttgaacaggagcctgggaaaagggggtcagaggggggagggcctgccggcatgccatctttacacttcatatgacagacacaaccgaggtgtgccaaatcacatggtaagatggtagcagttctatgggatttctgctggccagtgcttttcaaaccacacaggctccaggagtggttcttaatctctggggtcaaagattgctgtttaggaaatcatgatgaaaaccaaggtcctttttcccagaaaaatacacatggaccatgacccctggccaccaaattgaaaatatcaaattcagacagacacccagaaaaggcaatagaatatagtgattctgggtgctgcctctggaatctgattgtgtggattcaatcccacctttgtctcctactagctctgagactttgggacagttaacttctctgagcctcaatttcttaactgtaaagtaaggacagtaattatccacttcctgtagttgttgtgaggattacatgaggtaatataggtaaagctgcttagcatagtgcctggaacataaatgttagctatatcattattattattttgagaccaagtttcgctctgtcacccaggctggagtgcagtggcacctcgcaggttccagtgattctcctgcctcagcctgggattacaggcacctgccaccacgcccagctaatttttgtattattagtagagatggggttcaccacgttggccaggctggtcttgaactcctggcctcaagtgattcacccacttctgcctcccaaagtgctgggattacaggcgtgagccactgtgcccggcctagctatattataatgataacaagcagacaatatgggcaatttcctccctgcctggagaactcctatttactcctcagagtgcagcttggatgtccaattctctggagaccttccctggcagagctgtgtcatgtgtcactctatgttcctaaagcaccctgtaataataactaatttattagtttgttgagtgcttaccatatgcccagacagttctaagcactttataagtgtttagctcatttaattcttcctcctccatctttttttctcattcaataactttggtatagctcatttaattcttattagagcctggaggaggatactattattagcttatttaattcttataagagcccggaggaaggtactattatcattgtcttttgacagatgagaaaactaaggcacagataagttaaataactttctaaaatcatacagaagataaaaaaaaaaccctggatttgaatgcagaaagcacatcttcccaaagcgtccgcacacatccccgttgtgtgtacccttctccctgctctgggggtgatatcttctggcctcttccccaggccaggagtggggtgaacctcaatcagtggtggctctcacgtccttctgattcccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccgggtgaggcctgggtctgtctcctgggcctgtgaagtcattctaagggcagatggcctagcagcggaggggaagggcgctgctgggggacgggggagtcccccaagcctactggaggtggggtcacggggccccttcccatgaaagccggggctctctcctggcggcccaggagaggcccgcacgtcaggtcccctagggcagcagggcgagacgcctggcccgtgggtgccccggggcgctgcggacgggctgcgggtctgactaacgatgccctttctctccccgcccccttgtccggtgtgtgtgtgtgtgtgtgtgtgtgcctcctcgctgctcccctcctctgcacggctcccatcccgcgccccgtagacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaagggtgagcgggccgggggcggagcctggaggcccagggagacggatcttggaggccagggtccaggctaggaggctggggtagtggggccaggagcccgccccgcgctcgagggggtagcggccttgggagggttgcctttgagacaaagtggggggccggtgggcctccgggcgaggctagaagcgggcctgaggacggaggggcggggcttgagagggaggggcgtggccaagaggctggggccggggttggaggcttgaggagcgtggctggagcgcctagggagtgggacttaaacagaaaggcaagggtggaatagggggtgggggtccagtctcccccgaggtccagtttacctgttaagggctagaaccgaggaggcacctccgggttggtacccacaagaagggcgtcgggcaccccaatctgaacagacacagaactgagccgaagcaagggtgggagatggcagcgccctctagaccccccgcccagcttacccggcttgaccgagcctggctctgtcctcacagggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggccttggttctggtgtgtgtgtcatatgggagaggaagaggggagataagcttactgggaacagagccagacaatggggtctgactcataaatgactactgttagaggatccttacaatgcaagacacatacatgaagacagctgaaatagagatgagaataacagcatgacagaatgaccaaactcatccttgtggtctcaggcactgggttagagcaagggcaagtagccactggaggggaaaggatgaagtctaatcctgggggagatgcagcagaaggctgaagcccaggctgagacaaggccagggccccaagcatcagagtctcctcaagttgcaggtagggtggggcagaagcagctggctttggagactacacacattttgaagaaggacagccagagtgaaatgtagtggacatctctgaaatatacagcacaaaatgacccctttaatttgggagctgctctgtctaaccacagaactaaaggtggaaacctgacctaaactggactagatttttttttttttgagacggagtttcactcattgcccaggctggagtgcaatagcgcaatctcggctcaccgcaacctccgcctactgggttctagcgattctcctgcctcagcctccccagtagctgggattacacgtgccaccatgcccagctaattttgtatttttagtagagacagggtttctccatgttggtcaggctggtctcggactcccaacctcaggtgatccacccgcctaggccctccaaagtgctgggattacaggtgtaagccaccatgcccggccctggactagattcttgatgctggcacaatcttacaggccagtttgggcttacctcctgcaaggaggagatgtcagcacaattgttttggagcaatccaccatgcaaatggaggagcagatatgtgacatggtgaaaaagtgccatctcagctgctgacagcttcctgtccctagaaaatcctgggtggccattgatctctaagttggttttgttatttgcatcaaaagaaatctgagcaatatatatcaaaatacctggcacagtgctgaacagggctagtttcttcaaagccaagaatgaggtgagggagcaagtatgtacattttcctcaacttgccaggcgggcatctcaggttcaatgaggactagataggaattccatccacaaggctgtgtctgcttagttaaggtccaaagaaagagctgatcacccaaaaatcccttaccaataacataactttatgttctatgacaatgacatttatttaacacgttatttcacattgtacaaatccttagattctctttattcactggtccatttctacaacaaatacatccaaaacactatataataaaattatttacaacatttccaaatgagaagattgcttttgcccccactactgctattcacacacagtacttccacggcacaatacatcattaggagatctaaaaatgctcaccctgtactctaggctgcttaggaaatgtgaaaactagtaacatttataatggcattagctcctttcaatacaagacaacattttagaaaccttgaacttcaactcgcaacaccaaaagggctcaacagtcctgctttccccattgcactttatgaaacaggttgcagggactaggaaaagggccacattattaaaattactaactgtacagaaattgatttaaaaaagtcacagctcaaaattgctctttgtaaaagtcacacacatttccaagtatcaagtcgcagtcctgcttgtttacttggattttcttcgcttggattgcaccgcactggttatgtctgtgggggaaagaaaggacatgttcagtggaagtaactctttacagcagtgccctttagacagtccacaacaagcagggcagacctaaggggagccctactcaactcagaatctgtctaaggggtgctctgaatggagagagtcacaggctttgcttgatgacttacgtgggaagagggtgtggtcctgcattgggcagaattggaatgtgacagaggtggtggcgatgaagcacactgactagagaaagtgcagggtggagagagcctttgtagctgggcaattcacccactgtttccctcaccagttctcatcataaaacgaagtgtaatagacagactgacaatgcttttggtgagaaatcaacgagtaatgccataagcaaatgagtaaattctgttagaatgcaaaaaaaaacctgccttgggatcccttttggagccaagctattgtttcacagtaaggaaccatttttgtcatgctatagtcaaggtctaaacaacatgaccatgggccttggtcagtgagggtctactatggcccagccagttatatcaagattgtggaaggctgggcgtggtggctcacgcctgtaatcccagcattttgggaggccgaggtgggcggattgcctgaggtgaggagtttgagactagtttggccaacatggcgaaaccccatctctactaaaaatacacgaaaaactagccgggcgtggtggcgtgtgccttaatcccagctactcaggaggctgaggcaggggaattgcttgaactacggaggtgaaggttccagtaagccgatatcccaccactgtactgtagcctggagacagcgagactccgtctcaaaaaaaaaaaaaaaaaaaaagactgtggatacatacagtcatgaatgcaattcagaataagcaacggcctgctctgagcccaagtgagcctgaaggcttcatggaggaggtgggaactgagtgatttacacacagaatgacagtgacatacagggaaatgactatgttttgattcctttagtttctcttgtactatcagtgttttaacttaatcttatgccagacttaaactgtgtttcttaaaaacgttttggccaggtgtgatggctcacccctgtaatcccaacactttggaagactgacgcaggaagctcacttgagcccagaagttttgaggccagcctgggcaagatggtgagaacccatctctacaaaaagaaaagaattagctgggtgtggtggcacatgcctgtagtcccagctactcaggagaccaagtgggaggatcacttgagcccaggagttcatggctgaaggagttcaaggctgaagtgagctatgttcatgccactgtactccagcctgggtgacagagaccccatctctatttaaaaaaaaaaaaaaaattctacacaaagttatggcagagtacagtgaatagcctgaagctctccaaaggtaaacacttctttagaatctcatattgacttcaaaaggtcacctttatttcatattctggttttaatatgaaaataatgttctaaaattacttctcatcaaggagaaaaaaaatgcttctaatatatcaatacaaaagatgaatcagatttacccatttctggtaactaggctgaattttctgatactgcatgttaggttgtattcaaggcaaattttcctttgtcttttgtatcataatattttgtgaacccagactctaataaatatgtagattgtaaggaaaaatttcactactctgttagctaaggtgactgctaagaagtgaggcctaggccaggcgtggtggctcatgcttgtaatcccagcactttgggagtctgaggcgggtggatcacctgaggtcaagagttcaagagcagcctgaccaacgtggagaaaccccatctctactaaataaagaaaattagccaggtgtggtggtgcatgcctgtaatcccagttactcgggaggctaaggcaggagaattgcttgagcctgggaggtggaggttgtggtgagccgagattgcgccattgcactccagcttgggcaacaagattgagactccgtctcaaaaaaaataaaaaaataaaaagaagtgcggtctagatgaatttccaagaggtgcccagtacagtaatttcattcaagcctctgttggtggaaatttcagtatgtttgtcttctcaaaggtcatgtttttttttgtgccatgtggtagaatcagtctttctgatttactcattagtcttttactaatcagaagacagttaatctgccaggatgttaataatggtgttctttattttaattcatgtaaattaaagagtctcacacagcccacataactccctaaaatcaactcttcaggtccaaatctcaagcgttattttcactgcagcaaatttgtcatttgcagtaaaaataggcagggtttttgtcttgacagtgttcatcctcagcaaaacattcattaactaggtcaactttggaagcttttcccttgttgtgatatgaaggatcaagtggtatgtctgagaaacatatgtggctgggaaaagaagtgggtagtggggtgtgggggagaagcaacctcaggctccccctccttccttgcttgttcccatttgtcactgctccgaagcacccaatgaactggtaggttgcctctgagcgtgaatcaatgagtggggtcaggaataaacaaatgacttgtgctagaaactgcaaaaaaacccacaaacacaccattaaaaaccctcatcttttggatactgtggttggtggggagaaggatgtaaactttcatacttccatgaggaaaaaaataaattttaaactgagtttgaagtctctatcaccttccctggataaatccagtcaatctgagacatagagcaaacctcagactcaacatgtctaaaaccaaacttgggattttcacctccaacagtgaggtcctttgccactgttccccatcatgtctgaaaaaaatctgtctgaaaaaaacatcttttgatgagtttttttgttttggtagttgattttctactccctccaaaatgttaccacttttactactctaatgaataggcaaatcacctttttttttttttgagatggagtcttgcaaattacttttttttttgagacagtctcggattgtcgcccaggctggagtgcagtggtgcgatctgaactcactgcaacctccaccccctgggttcaagcaattctcctgcctcagcctccctagtagctgggattacaggcatgcaccaccacgcccagctaatggttgtatttttagtagagatggggtttggccatgttggccaggctgatctcaaattcctcacctcaactgatctgcccgcctcagcctcccagaacgttaggattacagaagtgagccactgagcctggccacaaattactttaaggtaagaaattctaggtaagtgatgtagaggctaatgatccagtcagggtgtacctcagactgtgattggcacgctgttcctaaaggctgcctggcctgactgtgaacctaccttcagttttttaactatcagggattttacaaaattagtgtctcttaacagatagacaaatagttcaaactctagcagtgtagtcaaatcatttatatccatgtcttagaaccaactgggtggtaaagaactgggtcaataatagtcttttaagtgactgtccaactatgtcactgggggaacatttaaatttataacctaataaagggatttgtttttcagcctggttgcctcattttgaccttaagcaaatttgaccaaatctacagtacaaggctctacttaatcctctagtatgtgacctctaccatccaaggagctttagaaatggactttgaccttgctcacatcattgtgcctttcactgtactatttctatccgagacgtctaagtaattgtaaaaaattctggaaatcggcgagatgcggtggctcacacctgtaatcccagaactttgattagcagaggtcggcagatcacttgaggtcaggagttcaagaccagcctggccaacaaggcgaaaccccatctcttctaaaaatacaaaaattagccgggagtggtggtgcatgcctgtagtcccagctattcgggaggctgagccaggagaatcacttgaacccaggaggcagaggttgcagtgagttcagatcgcaccactgcactccagcctgggcgacaatccgagactgtctcaaaaaaaaaagtaatttgcaagactccatctcaaaaaaaaaaaaaggtgatttgcctattcattagagtagtaaaagtggtaacattttggagggagctctccagcctgggtgacagagcaagactctgtctcaaaacaaacaaaaacattctggaaattttccttcacaatttgcatggttggtttcaaaatgaagctactacagtttcaggtggttactcttcagggttttctcccacgacattataaatgtatgttcacttgcatatctacagtaatacttctgttttaattcagtatatctttataccctgtgtttttttagacagtttcttcactggctgtgggtagggtggggctatcacctactttgttgtcagagggacacccagggctgctgataattacagattgctctgaactttccttaaattaacatattttcctggttccaaacttaaagctttgaacttcatatttttaactaccttttaaaaaaataattacctttttcccagttgaaaatataacaacaactattctaaatggaggagtaaataatgataaagcaagctagaaaaatcatttgtgtttttgtggcaaattcatcatgtcaggaaggaaaactactcatttgcatgtttgtaaacaacacatctgatcaggtgcaattttaaaaagtgatttgtggtagctaatttttgtgtaattataagtgacccaaccaacaaaaacaatggaccaaagaatgaccaaaaaccatgtgggccttcctggacttgcccagaaatcatccatcccacctgctctgatctggcagtctggcaggccttggccagcatgatgtaagcaaactcggctctcgcagcaggagcatgattaatgtcactggttctccaacaatacaaacagcaacacttttaattacaaactgctcatagtgtttctcagcttcagagattttcatgaaaaacacagaatgtctctgattttgtttgcatatgatatatatgaccaaactcttattaaatgcaaaaagaagccctctttccccctcaaaactttacacagtgctgattctgcaggaagatacttcactcatatttcaggtacccagcactgcatatgtccccacatttgaggtgcatccattttagaaaccagcttgatatttggtgatcacattctgggtatgggtttaaatacaatcacagtaaattattttataacttggttcacatttttggatacaatatacaggccaaaaatatgcataattattctttaatttggctccaagagctttaatactgaaaaaccaaaagagctacagtactcatttctgatttaaaaggtaactgtgatactacaatatatattttttggtttttgtcccacgttcctggctcacagctcctataactcttgtaatttcctaagtgagccatcttttgttaaaatatttggccttttgcccatggttcctgaaacagctctgaggttgagttgatcacaaatggccaactcttttatcaatcatgcctatgtaatgaagccccactaaaaacccaaaagggacctatctccccttccccttcttcctctatacaaaaaaaaaaaaaaaaaaaaaaaaaaaaacaacccgcaaaacccacaaaaggactgaattcaggggcttcccagaaggtgaacgagaacacatctacctgctaagagggtggtgcaccaactccacagggatggaagcttctacacttgggatccatccagaccttgccctatgtatctcttcatctggctgttcatttctatcctttaaaagtggtccccaacctttttggcatggactgggggttgcgggggagacagtttcaggatgaaactgttccacctcagattatcaggcattagttagattcttataaggactacacaacctagatctctcgcatgcacagtttacagtagggttcacactcctatgagaatctaatgtcacctctgatttgacaggagatggagctcaggcagtaatgctcgcttgcccaccactcacctcctgctgtgcggcccagttcctaacaggccacagaccactaccaaccagtccatggcccggggattggggaccactgctttaaaatatcagggcatagtggctcacgcctgtaatcccagcactttgggaggcgaaggtgggaggatcacttgagcccaggagttctagaccagcctgggcaacatggtgagtcctgtttctacaaaaaataaagaatttagctagccatggtcatatgtgcctgcagtctcaattactcaggaggctaaggcaggaggcttgcttgagcccaagagtttgaggctgcagtgagtgatgatagtgccattgcactctagcctgggtgacacagtgagaccctgtctcaaaaaaaaaaaaaaaaaaaaaaaaaaaaagcaaaagaaaaagccggctgggcatggtggctcatgcctgtaatcccagcactttgggaggccgaggcaggtggatcatttgaggttaggagttcgagaccagcctggccaacatggtgaaaccctatctctactaaaaatataaaaattagctgggtgtggtggtacgcgcctgtaatcccagctacttgggaggctgaggcacaagaattgcttgaacctgggaggcggaggttgcaacgagccaagatcacaccattgcactccagcctgggcgatggagtgagactccgtctaaaaataaataaataaataaataaaataaaagtaaaaattaaaaaaaaactttcatatgggaggccaatgtgggaggatcacttgaggctaggagctcaagatcagcctgggcacacagggagaccccatctctacaaaaaaattaaaaaattagccaggcatggtgatgcacacctgtagttccagctacttgggaagctgaggcagaaggatcatttaaactcaggagttcaaggttacagtgagccatgatcatgccactgtactctagcctgggtgacacagtaagaacctgtctcaaatgaaaaaaaaaaaaaaaaaaatgccaagcacagtggctcacaccagtaattccagcactttgggaggccgaggcaagtgaatcacttgaggtcaggacttcgagaccagcctggccaacatggtgaaaccccatctctactaaaaaaaatacacacacacccacacacacaaattagccaggaatggtggtgcaagcctctgtaatgccagcaacctgggatgttgaggcataagaattgcttgaacctgggaggtggaggttgcagtgagccgagattgtgccactgcactctggcctgggcgacagagtgagactttgtcacaaaacaaaacaaagcaagaaaaaacgaaagaaaaagctgtataataaactggtaaacatgtttccctgagttctatgagccactctagcaaattaactggacctggttacgaggggttcatggaaactccaatttttagccagctagtcagaagcacaggtaaaacaacctggggcttgcacctggcattggaagtgggcagcagtcttgtgggactgagccctcaaacctgtggatctgatactatctccaggcagatagtgtcagaattgaattggaggacacccagctggtgtctgaggcagaactgatgacttgcttgatgtgtggggaaaaaaacaccttacatcttgtgtcagaagcgtgttgtgagagtatagcaggagaaactgagtctgtttttctactcatacacagtaacttaaccagagacagttagagaatgatggcctgaggtcttgcgactgatgcggatatctatacatgactgtgattccagggacaggccagagctatgccattctttagggagacacttagcacccctccatgcaagatcacaaagcctgagagtcattatggcctcttctaagccaactgctaagcctcagagcaaggatgtgccaggctttccaacatcaccactgccacggtgggacaatgttcagtttaagtgtacaggcttattccccatccccaacaccccttaaaaacaggttctagctttccatctcttcttggctggtagttctctacagagcggttctagtttgagcatctcttcttaactgtcccagttgcttcttagattctttctggtgccctgtaaataaccctttagtaccttgaggctctgggctgaggtcaaggttccaaaaatctggtgtgtgacatctctaaaggccaataccttttccccgctttaaaggtaattacataccatattctatagcctagaagatcttactcttttgggaaagtgaaaggctacaagaacatgcagaactgaggggaagcagattttcccatagaactctaggcatgttcccttttatgctttaagtgtagtacttcaatatactgaaaagtgtactcccttccaaactagtttctgcctagagatgattcccagagaggaggaatgaagttattggcttcatatctccacctaaaatgaggatacctaagagaccctgactgtggtgtatacactattcctggaaaagaaagaaggcctctctcacctttgccccttaactctccagcaggctgagtatggtgatggtactttgtacacctcaattttaactgtatatgacctctggcctattcccagaggctcttgtgaggcatcgtgacattcttgcctagagacataacctgccaacagcagctgagtcctcagatccgtgtctagtgtctagtgtgggtgcaccagaatctgcctggtctttaggctggcatcccaatgatacttgaccgtttctcagcagtcctgctgataatcaggaactcagccaggatcccagctcttaccttacccaaactgaactactcaagctcagcacatttcctaagagaatgatctggtcactgcctcctcattcttcaggtctcagcttaaatgtcatgtcatttttttctagaaagccttctctgacctggcagaagagcaaggtatctcagctatatgctcttatagtgccatgtaattttgctatcatagcatttaacatttaacacagagtattagaattcgtctttcaatgtggtaaagacagagactttttttttttttttgagatggagtctcactctgttgcccaggctggaacacaatgacgcgatcttggctcactgcaacctccgcctcctggattcaagcaattctcctgcctcagtctcctgaatagctgggattacaggcgcccaccaccacacccagctaatttttgtattttaagtagagagggggtttcaccatgttggtcaggctggtctcgaactcctgacctcaggtgatttacctgcctcggcctcccaaagtgctgggattacaggcgtgagccactgcacgtggctgaggctctgtcttttcactattataacctcagggcctgacatgtagtaaatatttaatacatatttgatagatggttattcatttgataattactgattggtacatctctgtatttggcaccatactaggcaccagagatacagtagttcgcaaaatcagacataatctcctgccctaaccaagtatacatactaattacctatgtcacaaactggcatagttatagctgtggtattatgaagaagaacctggtgctgtgattccccatagcagtgacaactgagctaagataagtaggaagggtgggacgttaaggagaagagaggtgggcagagagaagagcactccctgcagtagctgcaacatatgcacaggcttgtgatcagaggaatgaggacggcatgtccgacttgctaagggaagtgggatgaggctgggagatgacagggccgagaccacacagaagcttgtggggtaggttgaagcttttggactttaatcctaattacaatggtaaatcattgaagggttttaagctagtgggtagtagtgaagatggaaaagggccacctgagataaaatgggcagttttttgtgacgagtttgatataagggtgagggagagaggtatcaaggaggacttgtctaatggatagatggtggtgccatttattgagatggggtacaatggcagaggacctcactgttggaggtgaaaaatcacaagtttggttttagatatgttgagtctgaggttccagtaaggatgtgcatgcagttgtctaagatctctaggggtctgtactagaaatagaaatacaaatttacaagtcatctgtgaaaggctgttactaaagaagaggggcatgactgagatccattagggagaaaatacgaatttgaagagaaaaggtgactcaggatcaaagtctgaggaaggtcaccatctaatggctgggaagggagactgaggaggagcagctggagaggtggtagcagaagacaacagagagttcttggtcacagaacccaagggaaaagttaatttaaaaaggagatagtagtcaacagagaacactcacagggtaaggttcttaagaaggtcagaggagatgggatcaaaggcatagatggagaaactggccttagacttgaggaaggacagctgctctattatagaaagcacaaaggaggatactggtagatttatttcttggtagtgggaagctgagggaattctattttctctgtgaagaggtcagggtctctaccaagagagagggggagaaagtgtggaccagaggtttaaaaagaatagagtgggaaagatagttgaccatggaaacatggaaagatagctgggccatattcaggacctatctgaagtgggtgatcatgaatttaaagtggaatcagctgggcgtggtggctcagcctgtaatcccagcactttaggaagctgagatgggcagatcacttgaggttaggagttcgagaccagcctggccaacatgatgaatccctgtctctactaaaaatagaaacattagccaggtgaggtggcacgcacctgtaatcccagctactcaggacgctgaggcaggagaatcacttgaacctgggaggcggaggttacagtaagctgagatcacgccactgcactccagcctgggcaacagaatgagactccatctcaaaaaaaaaaaaaaagtggactcaaggccaggtgtggtggctcatgcctgcaattccagctttggaaggctgaggcaggagaattacttgagcccaggaattcaaggctgcagtgagctgtgattgtgccactgcactccagcccaggcaataaagtgagaccctgtttcaaaaaaacaaacaaacaaaaaccaacaacaacaacaaaaaaacccaaaacccaaaaaccagtggaataaatctgccctgttatgttcttttttccagcagtgcttgttgctcttgagtacacacacagaaaacatacagttaaatgaacaaataaaggaaggaccaaacaggtagtagaagacaaagacacttgacagacttcaggaacagaagcaatgatgaaggacaaagtcttctactgctgtggtaagaactctattcctctatttgacccacaaatagcacccacatcccactgctaacctttagtagagctggaggctgaagcaggtcgagaagatcgtttacgatgtccattttccacactttcagaggccacagttggctcttcagttcgggagtttcttcggcctgggattttggacttttcaactatctctttgggctcactgctgacagagggaagcaaaaagtttccaagcaggtgagggaaccaggccacacaaaaaacgggctcttcagatagtttcattcgtaaagtaggagactaagaactatatagttattctggagagaaagcagttcaacctggggtaataagcactattgccttctatgttactgggggtttaaaagtgagtctagcttattacattagtaaaaataaaatagtaaagcataatgttggtgaaattgtagaaaaactggtaaaagacataaaaaaattggaacaaaactcccctaattcctcacccattttcttttcttttcttttttttttttttccagacagagtgtcactctgtcgcccaggctggagtgcagtggcgctgtctcagctcactgcgacccctgcctcctgggttcaggcaattcacctgcctcagcctcccgagtagctgggactacagccatgtgacaccacgccctgctaatttttgtctttttagtagagatgggggtttcaccacactggccaggatggtcttaaactcctgacctcaagtgatccacccacctcggcctcccaaagtgctgggattacaggcgtgagccattgcaccaggcccctcacccattttcctaaggtaatagttcccttcaaaaattaaaacattttggattttgtaattttttagaatcatgaaaatggtctttaagatgtctgaaaattgctattaactcaaaatagtatataaacctaggaaattattaacatatattggcatttactaatgatcccggtagagtcagataacagcatattagaagccacagtatggggataattcacaatacactgctaggtatattgattgtccacaccccaacccccttttcttagtatatgaagatttaaaattggtaatattcactgttattgaggatacaggaacaaaaacatttacatacactcctaactggagtgtaaattgtataacccagtggttcttaaaaggaggcaattttgcttcttaggggacatttagcaacatctggagacatttttgattgtcacaacttggggagaggggtgctaccggaatcttttgggtacaggccagggatgccactaaacgtaagccccacacaacaaacagttatctggccccaaaggtcaataatgttgaggctgagaaactctggtgtaacccttgactcagcaatcccacttctaggtgcctaaggaaacaaatctttttacagagctccacacataaggaagttaaaacattttatttgtactagtgaaaacagaagacctaaatacctaacgatagtagattagttagctaaatcatggcacatccatatggagtcatgaaaaatcatgttgtagattatttaatgacaaaacgatttatgacacattaccaagtgggaaaaacttaccaacacaatgaacagtataattccattttcattgttgtatgtgttgagtatatatgtaactacatatgaataaatatgagctatatacacataaatcttttgttgttgttgtttgtttttgagatggagtcttgctctgtgccccaggctggagtgcagtggcaggatctcagcaaagtgcaaactctgcctcctgtgttcaagcaattctcctgtctcagcctcctgagtagctgggattacaggcatgcgccaccacgcctggctaatttttgtatttttagtaaagatggggtttcaccatgttggccaggctggtctcgaactcctgacctcaaatgatccacctgccttggcctcccaaagtgctgggattacaggtgtgagccacaacgcccagccctatacacataaatctgacacaatatatttgggtgcacactgtgtgaaaaagactagaagcagatgaactaaaatatatgtacagtgaatattgttgagttgtaggaatactagtttactggtgagttattttcttctttgtaattctctgatctgaatttctggttttctttaataattttttacactttcatggttcaaaaacgcatgttaaaatgatcagaaaaaaaattctttagaaaattaaatttgcttgcaagacatgtaacaaataaaaataatgcaacaaaacaaaacaaaacaaaacaaaacaaaacaaaacaatactggtcaaaaggctgcctcttctgggaagtcttccatgatctcatttcccaagtagagctgtctcttttgtctcttgggttcacagtctttatctggcattctagagcacccatcagattgtacatcgtgttctattttaatgttttgtgtcttcaactagactgtgaacctcttaaggacacagaccataacctgactgtcaactatccctacccttccactgttcactcctgccagaggaccctttgctagtagcaccgtggttgggaactgggacacaccattcactcccatagctttatgtataacagccgcccgacacccaaccataagccaaggtaagtcaaggagaggtgaggctggagctggggtggaattacaagtcagggggatttatacctcctttgagaggtggtgaagatggctttctggctaggagctcagaaaatggtcaaagcttctgaggaaagaaagttctttttttaaaaaaaatttttgttttttttttgagacaggatgtcactctgtcccccaggctggggtgtgggtagtgcaatcatggctcattgcagccctgacctcccaggctcaagtgatcctcccaccttagcctcctgagtagctgggactacaggcaagtgccaccatgaccagctaattttttattaattttttattttttatttttttttcatagagacagggtctccctatgttgcccaggctgggcaactcctaagctcaagcaatcctccctccttggtctcccaaaatgctggggttacaggcatgagccactgtacctggctagatgattcctaatgaaagtgcctctttctcctggcaaaacaaaagccacagcaagactatcctgttttttatggtcaatgctcaggtatctctggaaacaaacaccccaaatgtatttttggtctgattagcttctttctctagacaaatagctggtgcatgcttgagaaatgcagatgaattcaaacattagcccaatccaaataaaatcagacaggcagagtggtatagtaggagtagcaatgaatttggaatgagatgaacaggggtgaagtcttagctatgcatttattgactatgctatttaatgctctatgttctagacttttttttttttttttttaagatagagtcttactctgttgctcatgttggagtgcagtgagcacgaccatggctcactgcaacctcgacctccctgggctcaggtgatcctcccacctcagcctcctaagtagctgggactacaggcacataccactatgcccagctaattttttgtatagacagggtttcactatgttacccaggctggtctcaaacacctgggctcaagccatctgcctacctcggcctcccagagtgttgggagtacaggtgtgagccactgagcccggccgttctagactcttttttcttttcttttcttttagacagaatttcactctgtcgcccaggctggggtgcagtggcatgatctcggctcactgcaacctccgcctcccaggtttaagtgactctcctgcctcagcctcccaagtagctgggattataggcatgcgccaccatgcctggctaatttttgtagttttagtagagacggggtcttaccattttggccagggtggtatcgaactcctgacctcaaatgatctgcctgcctcggcctcccaaagtgctgggattacaggcgtgagccactgcacccagcctcattctagattcttgatctataaatcccatcttgtctgttgcaatacataggttaaatatcagggctctgaagtcagaaggcttgggtttgaatctaaccttcaccatttactaattctgtgaccttgggcaatttagttaacctttctgaactttagatttctcatctataagacagaatttactttcctaatagatactgtgaaaattagatgagataacacatctagggcacttgtagctcaatctattaaggatgcatggcatggaacaacattcaaataaatggtggctattaacctcctcacagggatgatatgaagattaaatgaaaaaaatattgtgaaagtgtcttatgaagttgctgtacaattatgagaagttctttaaaatattatccagtgcattcctacactaaaagagacaagactgtgtgtggtggctcacacctgtaatcccagaggctgagacgggtggatcacttgaggtcaggagttcaagaccagcctggccaatgtggtgaaaccccgtctctactaaaaatacaaaaattagctaggtgtggtggtacatacctgtaatcccagctacttgtgaggctgaggcaggagaattgcatcaaccccagaggtggaggttgcagtgtgccgagatcgtgcaactgcacaccagcctgggtgatagagcaagactctgtctccaaaaaaaggcatgacttttggaaaatggtaatattcctctccacagagctaatgaagttgaagccatagatgtatgtcattttgtagggttatgtggagcagcacagtgtaacagaaaaaagcataggttttgggtcagatcctgcctggctttctccttcttttgctttcagggtcaaacaactgttctttagaagacagctgcaaggactattattaatattaatatcaatggtaacaacagctcccatatattgaacatttactatttcctcattatgcagaacatgttatctcactcagctttgaaaacaaccataaaaggtagaaacttggcctccagcttttattaagagaaatgttacctctgagggattaggactcatgacagctctctacgttagcagtaaaaacagactggtgcaagagtgaaggaaaaggacaaggtgaagagaggtttaaagactgagacagctgatacctttcaaagaggcttatgctgtgttcatgctacgtctgcagaaatgatcatcttacctttgtccagagactatggcagcatttacctccagctctgcaaaaaaatataaaggatagaaatgaaatgtgggagctgccacagagagaagctaggagtctacaagaattctctatgccctatttaggctaaagtgtccctgtgcccagcaggattctcaccctacatggtatggagacaaagctggcacagatacaacttggtttgtttgggacataagacacttggtctatttttatttctactccacatggtgaaataatctgtttggattaatagaactaagttcacccttccttgttcatatttcatccagttacaaccaggttagcaaaataagtctcttcctctcatgtggaagagaccgttttcattttaaaacatctccatccaccttgttgccacttttttaaaaaaagcaatcttcaaatatgtcttgaacatctattaaggatgcattcttctccaaaggacttcctcactgagttttagagggcacagtgctttgctttcagatattgcctttacaccccattctattcctttctttctcaacctcccagcaatgccctccaagcaaggaaaatcttagtaatctgtctagcagggttttccatcaatgagcacactctgggtttaccatgcacttcttcctcagcaccagcagaaaaacatttgctttctctattatgtgcctttaggtagttccatcttttccaaaagccttccctgatgtaccagatagcagtgatctatcctgcctctggcctcccacagccctattcctgttcccccattgagggaagtcagcacctcattactcagtgtacatgtctaacctactctactaatcacatggtaaccttaaaggcaatgaagtcagagtgcctggttcaaaattttgacttcaatgcttattagccatgtgaccttgggtaaattatctgacatctctgtgctcaatcccttacctaaaaaatgggaataatcacattacccacttcaaagttaaggagatgaaataatgcatgtagaaattttagtatggcacctgacacttagtcataactcaatgttattagctattattattgctatgaagatcagattgatgcagcctttcatgtaaggaggttggactactctgcctttaatgcaaggtgctagtagaagggaatctttgatgggaggctgaggcagaggaatcccttgaacccaggaggcagagacttcagtgaaccgagatcatgccactgcactccagcctggtgacagagcaagactctgtcccaaaaaaaaaaaaaaaaaaaaaaaaaaaaggaagggaatctttgcttctcattgctgtttagcctcctgtatttgtacccacaaagcctgaaaacccatccacaaaaaatagataccaattcactgagtctctgctactttgctggcttggctggaacgtataaactcaggtaatgtgtgctcaaaaatgaaaatgactcaagtcaaaagaagtgctcaccctcattgttttttatttttttgagacagggtctcactctgtcccccaggctggggtgcagtggcactcactgcaacccccacctccagggttcaagcgattctcctgccacagcctcccgagtagctgggagtataggcacgcggtaccaggccagctaatttttgtatttttagtagaaacagggtttcgccatgttggccaggcttgtcttgaactcctggcctcaagtgatctgcccgccttggcctcccaaagtcctgagattacaggcatgagccaccgcacctggcctatttttattttttgggggatggtctcactctgtctcccaggctggagtgcaatgggatcacagctcactgcagcctcaacctccttggggtcaggtgatcctcctacctcagcctcccaagtagtatgcatgccaagcccaactaatttttaaaaattttttgtagagatggggttttactatgttgcccaaggtagtcttgaacccctcggctcaatcaatcctcccatctcagcctcctaaagtgctggggttagaggcatgaaccattacacccggcctagtttgctcttcttttttttttgagacagagttttgctcttgttgcccagggtggagttcaatggcgcaatctccggctcaccgcaacctctgcgtcccaggttcaagcgattctcctgcctcagcctcccaagtagctgggattacaggcatgtgccacgacagccagctaattttgtatttgtagtttggggtttctccatgttggtctgggtggtctcaaactcccaacctcaggtgatctgaccgcctcggcctcccaaagtgctgggattacaggtgtgagccaccgcgcctggcctagtttgctcttttaaaacaagaaaaagtttgatgcttttgagaatcttaacactatcactgctgattcacaagtagagatcaagaaggtttgatgaaggtaatcagtggctctgagggatgttaaggataaggagattcatttacgccagacttccaaatggaagaggattcttcagccaattactgtgagaagggggaaaaatgatatggtaaatcctattttctagagtagggttggggcaggaaatggaattccctttccctttagagttactccttttcttaccaaaaatgagttttgctgtatgacccctcctttaaataacgtgctccattcctacccttctcaaatatccaacacaatgtcaggtatcatgtgggcaattggcagcaaagaaagaatctgggtggctgggccggaagtagtggctcatgcctgtaatcccagcactttgggaggacgaggcaggtggatcatgaggtcaggagatcgagaccatcctggctaacatggtgaaaccctgtctctacaaaatatacaaaaaattagccaggctggtggcgggcacctatagtcccagctacttgggaggctgaggcaggagaatggtgtgaacccaggaggcagagcttgcagtgagccgagattgcgccactgcactccagcctgcgtgacaaagcaaactccatctcaaaaaaaaaaaaagaaaaacaaaaagaaaaaaagactctaggtggctgaaatgttttttgctcgcacactattttcagaggcctgattttattcagagtgtgcagtagaaagtcctatcagtcacacaggatgtagcattctgaagtaggttttaaaataatcacaaactataccttacttttactggctcagattcacaaaattaagcatggctactattgctttttcttactaactttgtcaagtgtgtgaattgtagtttcaatgagattcttacctctgtggggaccagtcatacttttttttttttaactcctcaatgatctacagtgacaaagaatcaggcgaaactaaactgtaccatatctgcgatatttatctgcctccatagtctataaaggcaaaacaagggctgtggctgccatcatcctcatgtattctgagctgaccctgatcccacagcagttatttgtcagattaccatgggatcctacttccagaaatatcatcccttgtgctatttacaatatattggtcatggggagaaacttaatgccacccagagacgactgaaatgactctgcctccctggaggaatggctatcacattgtggcagagactcaatgaacaagactccactactgtcataataaaattacaaagtgcgttaatgcttgccagcccagtaagtcaccatatgccagctattcagctgccaaccatgggtgccagggtcacagaacagggaaaactctgcaacagaaacccatggctgggtggcagacagacaatgggcacggaattgcccttcttgagttccctagctgacactatgaatgcatgagagagcaagctggtcggggggaaaataatctcaagtagaactgcacaagctttgtcactcaaccaaagtctgctctgaagcaaacagataaaatagttcctgtcacttcctggcataagaacacacgacattgaggacagcagtagttccttcacatgtaacccatcccactccaagaagtttttccaaagtacgccttacctggtctggcaacagaggcctgcagtgctgtggttgaagtttcctttgagactaaattctgcgacggggctaaggcaaggaaaaaaaaattacagaccttttactttcttttctaaacaaaaagaaagcattaacctaatcaagggctaagtaactgctgaaacaatgtactcttagagggcagtactcaaaattggcctcgaaattacaagtacattttaaaacttactacaaaaattaattaccataacacccagtaccaatgactaccatttaggggtataggctcttcctttttgtatgtataataataaggggaagagatggctataagaacatagcactcacattttctgcttcttggggtcaggtcctgaccactacttgaaaaagccccaaagcatatcttagtaggcaacccaaaccatagaggtacaattataccattcccctcagcatttaaaaaatctagcctcactccctaaagactatactctatgagagtggaaatggtcacataattttgtacttttctatagcacttagcaaaagtgatgggcataaagcaggcattcaattcatacataataaataaataaatttgatatgttatttacttatctaacaaatagttgcaaagaacttactaggggcaaggcactgtgccaggtaccctgagagaccaaactatatcctcttgcacatcaggaactcagtctagtattaaagataagatatatacatgtagtgcacttgagtgcactctgatgtcatatgaaggagtcacaaagtataaaatactacaaaagtccaaagcaagagttagcaattctaggttgagaaatctgaaggtacattaaagggagaaacatcagaatcaggcttcaaaggacacagagaacttaggcccttaaggaatggaataaaatatgtaatgccctctagaagggaaccatcctggaagataaagattatggcatggatatgccacagtcacatcttgacatctcagtctaaaatcctagataaactctgcaacaacatgttttactctcttgtggaaactgaattttgtatatttccctccctgcttagcaaagcagtaaattatgcatttgtgtttaagaatttattttggatgcttatctgataaagcttaaaactatatcttaacttctacttttaactttagtgttcatttctcaaatttccttttctttttctcctgagacagagccttgctctgttgcccaggctgtagtgcaatggcaggatctcggttcaccacaacctccgcctcctgggctcaagcaatcctcccacctcagccttctgagtagctgggaccacaggtgcatgccaccatgcccagctaatttttacatattttttttgtagagacagggtttcgcctcattgcccggcatggtctcaaactcctgggctcaagtgatccaccagcctcggcctctcaacatgctgagattacaggcatgagccaccgtgcctggccaatttctcatattttcaaagtaaaagcacagaagccccttgaaaaagaacagaaacaatcacttataagcaaagtgagtgttcttaactaaaattgagaacttttcccaagtgctggttcatctcctcaaggcccacatatttctctagtataatatatgatccagataaaaataatttctaattacttcatcatttttctcttgataccagagggaaaagtctcctgaaagaaggagaaatggaaatacttaatagtgaaggatatacttaatttacaccaggttcccttttaattcttagggttcatctacaccaacagaactagaacaatatacaataagcacccagtcttgtgaagactgtctcttgtaagagcagcagacttcttgaaggcctttatcctgcccccatctctctaacactgaggtgaagaggcagagagaaggggaattaacctttccagagctctgcgtgaggcagtgtgttggccacttgacaaatcttctcattgagtcctctctcagaatcctaaattctgggaggtagaatgtacgatctccattttacaagtgaaatacatggcttaggagaggttaaggaacgtatcaactgtaactggtaaccagtgggctagaatttgaactctgatcttaccctgaagtttgtgttctttctgcctctcctcctgggtgcttaccactcagtggtaggcactcgaagcattttagctgcataaataagataggcacttaattagctggcctaggatatcgtaaaggtctttcccagctctagcagtgtgtgactgactccactctggggaaatagagcttcttcacttaagcctcacaggaggaggaacatgtcagggaagggaagaagggaaggaggggcggttgtaaggacacctatgcttccatcattagcccatcttaacagtacataggaaatagcctgaactagatacacaaatggaatgtaccaatcaacaaagagattacatcaaaaagaaactgggaataacaatttttaccatttattgaataataattatatgctaggttctgtgctaagaatgttatatgtactaccttattgaattcttacaactattattgttccatattacaaaggaggaaaccaaagtctggagtggtcaagtaacttgcccaagcccatatagctggtaaatgctggtgttataataccaacccaagcctactggctcttgaccactttgtttctactgtgtccattatcatgaaacccagttttcttccagctctcctctagagtagcccagacaaaaaaagaatggttcctgagatagagtacagtgagaatggggctatgaggacccattgttctgaaatagtcatgagcaaatcttcaccctggtaaagagaatctgcagaagctgctgttcacacttaaggcacagtgttaaatgggaggttcacagtatagactctgaacaaacactgaacgtctttgagcttcaatcttctcacccatacaatggggttaagaatatctgacatagttggtataaagatgatgcaagacaacatatgtaaaaatgcttccttataaattgaaaaacttatataaatgaaaggtatcattatttcaggaactctttgttttgagagccttagctctctgttttgtttttttcagacagagtctcgctctgttgcccaggctggagtgcagtggcatgatctcagctcactgcaacctctgctcccaggttcaagctattctcatgcctcagcctcctgagtagctgggattacaggtgtgtgccatcatgcctggctaatttttgaatttttagtacagatgcagtttcaccatgttggccaggctggtctcgaattcctgacctcaactgatccactcacctcggcctcccaaagtgctgggattacaggcgtgagccaccgcacctggcccttagctctctttaatgaatgcaaacttaacatgggatttaaaagcatattttccaacgtactttcaataaataaaactactgctattgccatttagcccattctctttcctccaagtaaaaaaggagtcatgctttctcttgtgggattaggtcatcaaaaaactgacacaaagagatgatgaagccccaagtacatacctatgctgggtagaagttctggatgggatcccaccttctcctccactaggccacccgcaagtgactcagatgctatgccaccatgattgctttttgtggtcggtacggcggagatgagctcggagggtaccagagtggttactatcgagcgtacactggtggggagagcaccgccaggtaagctgggtcctgctgaggcagtgcccgggcccacagggctagaggtcatttttagcagagtgggtgctgggggcgttggggttttactgtccagctctgtggataactgctctgttcccatgagccccggagctgtggtgtctagcccttggccttcagtctctccatctgcaccatattgttcttcccctttctcaagagagcctgtaactttcttacatgccttggtcaacaaaatttggccaattttgtccacttttcctttgcccttactagacgagactgggcttcgccggttgccagaggaccctggactattggtcaaaaggggagaaaccattgtggttgactgtgaagagggaagagtgttctgatctgctgaggtgttcacctgagggctagcctcatctggattcaattctttcacttgctgcacagggggatgagaagggacaactggagaagacgtacaaggaggggaaggaagctgaacaggggtggctcgtgagctaaggaccaaaggtcgacctgtctggatgtttggagcaggactactggagagggcattaggcggtacaggagcagaagaaaattttatgttctgaggtatgtgtaaagggccaacaactgcaacagagggaggcatcaggccagagttggttgtcagtggggctgcaggaattgtgcttggctgtgatcctttcataacctgaattattgaggatgaattgataaagacaggtgtaatgaactgaggccgggcattagactgagcagctgactgtccctcagaaaccataaccttgctacccgcattgggcattgtgacaactgttgacatcaatgcagactgcaagtgagttggcaaagctgctgatgtgttagctgaagttgtgatgggattggaagtgacaaatacagttatttgatttgggggcaagggagtggaaatggaggaagagctaacaggtcttgacattactggagggatgcttggtgcaacgttagaactgacctcactcaattcgggatgcacaagggatgaacacagctcattactgtgaggtaagtttagggaattagaaggttctttagaagaagacagatcctgcagtgtgggaatgacagatgcttttttgaggtcctccccagaaactactggaggtgttacttccagatctgtaagcccagggggtttaattgtcacattgggagctccagagttgtcaagaagttgacttaacgatgttggtgcttccctcatagcaggagacaccaaatttttgttctcttcgacactgggaagtttgttaggatccgaaggctgcccatcctttttggactgatcttcagggacaaccattttaacttcttgggcagggactgcttttagttcaatgtttacctgttccttcctactctgggaattctggcaatcactgtcctgaggcacattcaagctctccttgttatcctcaacaacacccccaactgcagccacagacacagtagaattctgaggattcagcccactgttgttaggaaagctcccaggtacagggggattggccagaggagtgggactgaccaatacatttctcggcaactccacattctgcaatagggctgcatttgtctgagaggccagagtaagtttaggggcttttgaattttgcctcccagggcttggagtggttttcctactggacccaggactagacctgcgactgttgcttggacttgcccgttttgttgctccagaattagactgctttccagaattcactaccacagaatctaatttgtgagtttgtggggtagcaaaattggaaggattcatggtaagatttgaaggtgcttgcccgatggccttcaaagttgttggatttaggccttgttgatcaaagcccctgtttaaatttggcctaggaggtaaaggaatattaatctgtggagggaagagtcctgctatggaggcattgagtctttctggtgacagactgatttctgaaggttctgtgctgggagggcggttgttgggtgtctgaggataatagggtctggggctggctctgtttggtgttttgggcctagatgtctgggttggcgcagccacatttgggaagtggtggccgtgagagctgggcagggaatttacagggggttgctggggagttgcaccttgagttgctgaaaggggcgatggtccaggttttggccctgtcatcattaactgattctggggaagtactacatgtgaaggcatgttgtttgggcctcctgggacagatggtgcttcactgccacttgcttcagggagtgaggccatctccgccagtggcgagctggaaggattctgcgggctctcctgatagaccattttccttgaattgcttcccaagggagtattcacaggcattggcattctttgtttatcaggtgatggtggcacggaggcaggtccttgcagactgaccatgacaggcacactgccactctgttgcatgggcattctctgggagtcggggttcagggggccccttggaggatggacattttgagagactggaagcctaactgatttgggatcctgctgcatcatgagcatcatcatcatttgttgctgctgctgctgctgctgctgagactgtggctgactgggaggtggtggctgctgctgctgaggcagttgtggctgtggctgctgctgtggtggctgtggtgggggtgccacatgctgcatgagttgaggaggcatctgctgaagtggcctctgttcaactggttgagaaggataacctaaaacaagccccccaaattagggaagttagatttttcagcaagaaaatgttgctacctttagagtatagccaagcaatactcatctaggtggcacagactatgcacaaacagctcaggcatgcccactcctggggcagggggcagcccctcattacttgacataagcaaaaggggcacagtgcttaaggaagcaaaaagcaaagcatcaaaaaacctggagctcctcggtgtgtaggatctgaatgagccatgactgtactaagagcctgattttctgtgctatgcactgaaaatggctgtgtctataccagccaaacattcagatgaaatgagaaaaactccatcaacatcaagtgcctggccacccaagattcaggtctcatgtagtcataatcaatatttcaatgtacttgtgaatgaagtaaagcatttaggattcacttcttctgttagcacaggaataatttttttaagatgtggttttgttgaaaataacagcactgaagacagcctttttattctttcaacagaagtaaaatataaaattctaggattcagttccttaagaaagaggaatttaaaattattccaattcattggctccatacactacgccgcatccttcaggcttaatcctttgggggaaaccgactgaattaaaattgcccttcaggtgtaaatcagtttaataaacagtaggagctaatggaagctgatatacacattgaaaataaaattagggcattgaagtttttatggatattaatttgcacttactttcttacatgcaaatctctatttggagaaatattttccatgaatccacagctggagaataagtaaggcagaagcatagccctcaggaataaaaaataattttgggaaaagaactctgaaggacaatgtcttctagatatgcagagggcaacatctcaaattattctctttttttgtgaagattttacttggcattttagaaccaaaaccttacaatcagaaaagataaaaagatacgcaaaccaagaataacggtggttctgtgggaaaaagtgggcatacagctgggcatatatgggatacaattccagttccacaaactagatttattccattgttgcatgaagagtacattagggaggttttaagaaggtgtaggaataagaacaactggctctggcagtcaaaagaaatgctgactcaacattttcatagagcagctaccaaattttgtgggtcagactcagcactcaattaatgtcttctggccaaagatttccatggtatcaatgaatacaatgtgtagaatccagttttgaagatttttaaaaaaatccttttttattttaggcccgagtaacttcttcacctttataaagccaataacatggcatttctatggttcaactgtcctttcgactacatagtcaaatacagtgggttcctatttttcacattcagtctggggttcccacattaagaaatttgtaattgctacaaaagcctgttgatgtcagggttatgacatggatgccttttatctttaaaatcagcccaccagacagtaaataccaaagaggacagcatagacaatatagcagcctctcaaaagtaacagttaagggcatggctgctacagagtccagaagctggaggcagcagtccaaaaggcactaatgataagacagattggggctgacgtgacagaatggtgaagagggaaagccaggacacacatagtgcccataacacaatcacaaactgaatttattactcagggaatgcaaactcctatgcctttaggggccaggcaggtagtagagaatagaagtggactggtataagacagcaggagtcctgtcaacagtgccaaactgcagagcagatgccctatttaaaggcatttaaactcggacttttgtttaagacactgcatagcaactcaaaaccattataggccaaattcagcctgcaggcccccagtttgcagaaagaaggcaataaatgtatacaaagacccctgggattcttataagaagagttcagatgtgtctgaggcaagcaggcatgttcctgctctcaatgccttctggacatactccccaaagactgatgacctcccagtctcagctatgctgctgcatctcactgacgggaagtgtgatatgcccaaataatttgtaataaataacacaaagtattgatatcatgatggatttagctttttgtttggattcaattttaaaatacataaattaggggtagattaaaggttactcctaaaataatgtcgctctcattttcatgccaaaaagaagttgaaataactagtgaggaagaaacaaaacataccctctgtacacacaggggagagtggcctaagtgtgaagggttgtgtatcttcaaccgtgtcataggggaataaagttacaagtcattgctcaggccaagataaccaggtatagagatattgtggcagctggccttggttctataatatctaggtttgaatgaattaattttaggagcttttccatctttgacataatttttcaacatttaaaggatagtattattttataatcagagaggatacaacaaagggggcttccaatattggtcctatttattataaattattaacctatgtggtagatacatgggtgtctcttttattctttatatcttctttatattttaaagactcattaatgaaacttctataaaaaagatcatcttgttttaaaccctggtagttccctgctttgagaagccccaggaagaaacgctgcaggaaaggcaggcaagcaggattagagtgaaatcatctctccatttaatcttatcctgttctgatgccaactagaatcttgacattgacaagaataaagaggcacttcacatttcatggtttttttttttttttttgagacagggtcccaggctggagtgcagtggcatgatcatggctcactgcaacttcgacttcctgggctcaggtgatgctcccacctcagcctcctgagtagctgggactataggtgcgtgtcaccacacctggctaatttttaaaaaatttttagtagagacaaggtttcaccatgttgcccaggctggtcttgaacacttgcgctcaagcgatctgctcatcttggcctcccaaagtgctgtgattacaggtggatgagccatcatgcccaaccacatttcagtccgattttatgaggacttaaaataacaaagacaaatttgaatagaatgtgtgtgtgtatgtgccttcaaaagttatatttgaaatttttacttaatatcaaggcaaagcttccaaataccagacacattaaatcactgaagtagactagttagcagataaaataaaatactattgtttccttgaagacatggaagccttgtaatgccacatgcacatgtaataagtatataatctagctaacattttatcacctggtggccggtttgaaaattctggcagtttagggcctgagttatccaagttaattccttgttctccaggcaacggtggctgatcagcctcttccagaccagctgggcgagtatctggggtgctaaaaaaaaaaaaaaaaaaaaaagtgacatattttagaataagttgtatagaaaatacacaaaactagcttaacccttcccctatttctgaagaactaaaatgtttgcattaccattattcatctctctctagtctagataaaatattaaatattggcataaaaataatctggcaatttcattaaatgttaaaatccatttaatctaacagcactgtatttactcagaatgctttccacaaattcctggtgcaataattttcatgtaatcacccattccttagctgttttaagacctgatcataggactatcaatgttacaaggtactgttcctgtgaaaccacactatcttcaatgtagcgatcaaattcaactagggggtctgattgtttcttttttgtggatataacagtgggggctcaattcataacaccttgcaaaaggttgtataggttggctgatggtattcagagaacaaagaaagattgagaccaccaccacaaagattttgctgcagaatgagaatttgcagacatctctatttgctttgagatgcctttgcttttacctgggtgtagcttaaaatttttagtaaggaagaaaaaaatgaagaaattgtagctactaacacccacattctcaaagaacaagactggtcacgggcctcattttgtttgtaatctcagtactaattgtacttttcttttctatctttagtttccctttgccctgattttgttcacccacttttaggtagtgttttgtctcattatactctgtacagtttcataagccacaaaaatccactttaaaagcctcccagcaaatggaaatttagaacctgaagcagatcgtcagcacatccagacctataacaatttgctccttgtaagacttctctctcactttaaattacaggcaagaattcgtggtaacctttactttcagaaaattgtagagataagaaatctcagatatctggtccagccccatcatgttatgaatgagaaaactaaggcccaaaaaggtgtatgaaacaggcccaagattccacagtgaagtagtggtagagctggaagcaggtacttttcctgtaaatccactgtctccctttcctgggagtcctgatgctgtgtaaggtccctttcacaatttgtagacctaagtaaccaatttccctaagggctggtgaagatggcaaaaaatacacactagaggcaactgaataaccttgcaattttactcccagactaccgagagaataaaatatttattaaataattattcccataggttgatgctagtaaagaatttaactgagaaagagctatcagaaaaattagataattaactttgaattcaggaaaatataggttatcattaataatacaccatgattagcttttaaagcataagattcaagaagaggcaagtgagcatgatataatacagtacaaagaatgttgtgggaaggctgggataaaggtagttggtttaattttgaatatttaagctggttgaaataaagtttcttgattctttttctataattctaacaatttatttcaattaacctgttttacattcattagccattatttcctcatttattatttttttatgattaaaggcacaaaatatagctcagtgaatattccttctggaaacattttatcaaacccagaaacacaaattaatacttagcttcaggaaatgaaatataaattgttaattgcctttcctgctatgatcttgcaaaataactcacctggagaacgtttactgaaagggtaactgatttaaaaggtccaatcatcttagcgtggggttttaagcttctagggatgataaagagcctttaaaggaaaggcacctgtgcaaaaaaaccatttctatttgagagacagcagtagttttaatttccaaaacacatttggcctctctggttccccaatagccatcataagcctaaagtcagtgctttgtggagttgccatatggtagcactggttacttttcaggctctgattgccaaaaccccccgacactgtaaaattaagagatataccagccaattgcaacatatgaatcttgtttggatccttatttgaacaaattgtaagaaaaaaatttgagataatcagggaagtttgaacactggatatgagagtactaaggaagtattagttttctaggtgtgctaacaatattgtgcgggcatattaaaaagtgtccttatcttttagagacacacactgaaatatttacccagcgaatttgctttgaaatactcaaaagggtaatggaagagagtacagatgaaggcaagacagactatgagttgataattattgaagcagggggatttcattatactattctagttttatattctgtaaaattttccatcaaaaaagttatccacacagaaaacaaatgaataaaatttgaggcaaaaccatcacaacctactttagatcttgctgactatttttcttcttccgagggggtttcttcttcttcggtttatttgcgttggtattattttgcttattgtttaccccaaaatggcctgcagatatgtcactctgcaataagttgaccaacaatgggctcgttagcgtgacatccttattgactgggaagcctggattttgaccacaggacatctgatttccattgggagctccactgaaaggtgcattgaaagacatcccatggcctgagaagtggtttcccgaggcactgtttccctgcatggcctgcacatgaggggggaccatgttggtttgttgaatgctaacatcaggcatcatctgagataaactgacatcgttatttgctgtagtagcaggatcaccatgctgctgggccatgtgtgggctgggccctggtggccgcaggacctgtccctgaatgcccataacctgagatggactgttgttcacaggcccttgctggggcagcatctgtcctgacatctgtcccgtaaactgcaccatatttccttgcatgtttggagttggtcccctcattatctgggctggtcccggcatgacattggactggttctgagtgttaaactgctgcttattcccctgcatttgattggtcataatctgctctatcattgggttctgttggagcaaaacctgcccctgaggccccatcatctggttatgtggcgccatcatttgtgggccctgctgggaaagcatctgcttgggtggggtcatcctttggggcgagggcccaagattttggctcggggggttcaccatcatctggccctgtggcataagctgggcccttgaaaggatcatagggttctgagggttcaaggttccttgttgctggaccatctggccctgggagggcacgatttgctggtgcatgcccatcagctgagatggtgggccctgctggggctggccttgcatgttgctgaggttcacttgaggaaccccagaagtaccagcctgctgattgttcatgttgccatgaattcccatgaggctgggctgcatcatatttggcggcccgtgggacacctgcatctggttttgaggaggaccagctccttgaccaccttaaaaaaaaaaaaagtcacagtttcagaaataaatatttttatcttattggtattaagatactcaagttacattactcagaaagacatccatcacccttatatccactgaccaacataaatatgctgttgacatacttcctgtgagttttctaaactacaaagatgtggctgtgggataactgcttacattcccaatgaccatataatagagaaggagaaacagtttctacattcccatatggtatcttaaagatttaacgtttcaaagatcaagaaagtttactttctttcagattaaataatgagaaaggcagcatctcactgttttaaaatgacttgtagtggccaggctcgggtggttcatgcctgtaatcccagcactttgggaggctgaggcaggcggattgcttgagcctgggaggtggaggttgaagtgagccaagatcatgccattgcactccagcctggtgacagagtgaaaccccgtctcaaaaaattaaattaaattaaattcaaaaagcactatgggctactgaaataactctgctataagaatgtgaagtgtcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaaaaaaaaaaaaaaaagaatgtgaagtgtcctcttaggaaaacctcaacaatcatgagaagacatttaaaaatgcttcttggaaaactgtaataataatgactctcaaaagctatgtgtgtgatatgtggatgctgcacttcaaagaaaataacaccaaggacaggtgtcctctgccctgatgtggtaaaaagcagttaatcttgatctggaagctgagcctctggtgggagccaactgactagatgacccatctggaagctgcaaatagaggaataataaaacctcagtgaccctctcctgcgcagtccctggtgaatcatgtggcacatgttttagtcttctcagctatttctaacttagacaaaagttgctacccgccttgctgtagtgcttatttatttactgggtctttgggattttcctatagctacttgcattatctccccgtttaactgaataactttgtagttaattttgtcccttttatttttcactttttttgttgttttgtttttgagacagaatctggctctggtgcaacctcggctcattgcaacctccacctcctgggttcaagtgattttcatgcctcagcctccccagtagctgaaactagaagcgcacaacaacacacccggctaatttttgtattttcagtagagacagggtttcagcatgttggtcaggctggtctcgaactgctgacctcaggtgatccacccgccttggcctcccaaagtgctgggattacaggctgagccaccgcacttggccttatttttcacttttaaatggggactagaaaatcccctacaatgaagttatgaagccagtccatgctccaactatgaaggcagggggcaaactaccttgttcacactatccagacttctcctgaactctaaggaagattttctaaaccagccttataaactcaaagtggaactccatgaccattgtatatgcttgtatacaataaatatactgtgtatattcattcaactgacaattattcattaagtacctgatacatagaaggcactttggtgctgaggtaacatcaataaacaagacagaccaaatccctgcatccttggagcctacagtctaactggcaagagacacaactaacaaacagacaagtattttttcaggaagcagtaaaagctaacaagagaaagtagggtgagagaagagaaagtaagagataagagtagagctactttagataggataaatggggaaaccaaaacatgtacacgtgggccgggcacagtggctcaggcctgtaatcccaccactttagaaggccaaggtgggtggatcacctgaggtcaggagttcgagaccagcctggccaacatggtgacaccccatctctactaaaaattaaaaaaatagcagggcatgtaatcccagctacttgggaagctgaaacagaaaaacgcttgaacctgggaggcagaggccgcagtgagccgagactgcgccactgcactccagcttgggcacaagagcaaaaactccatctcaaaaaaaaaaaaaaacacacacaaagaaaacaaacaaaaaacatgtacatgtggaaggtaccatataaaaacacaaaatagctgtgatagggtacaagaatgagaaatgactttgtcattgttttaaaacatacttttttttttttgagatgaagtctctctctgtcgcccaggctggagtgcagtggcgtgatctcagctcactgcaacaacctctgcctcccaggttcaagtgatcctcccgcctcagcctcttaagtagctgggattacaagcgtccgccaccacacccggctagttttttgtatttttagtagagacagggttttaccacgttggtcaggatggtctcaaactcatgatctcaagtgatccacctgcctcggcctctcaaagtgctgggattacaggcgtgagccaccgcacctggcctgttttaaaacttcctataaaaaaacatgaatttgctgggtacagtggctcatgcctgtaatcccagcactttgggaggccaaggcaggtggatcatgaggtcaggagttcaaagaccagcctggccaacatggtcaaatcccgtctctactaaaaatacaaaaattagccaggcatggtggcgggcacctgtaatcccagctactcaggaggctgaggcagagaattgcttgaacctgggaggtggaggctgcagtgagccgatattgagccactgcactccagcttgagcgacggagcaagactccgtctcaaaaaacaaaacaaaataaaaaaaaaacaaacatgaattcatataactcaggaatgcagttttgcattagcagatagagaaattcaagcagtttgcactacccttctgttaccctgccagaaatagtgtgaactttttttgtaaaagtcagatttttgtctcattccttagtgatttacaattaaagttggagtcacattactaaattaactccaggagggatgggaattcagaaactagttgcactatctcagtccaaactgcttcaatgagaaagggtaagaggattagtcatgtggtccttaagcaaccagaaacatgaagtttgagcttatacattactgctttgcaaatactttttagccattcccctgtatcttatttcctctccaaaatttcttctttttgcagtacactgttggtagtaaacgtgaactgatgaagtttgaaaaatatcacactgtaaaccagaattcagacactcagcataaacaaagcttaacatgtaccacgtagagatttaaaaagttgcagttgtccaaacatgcctccatgcctttgtgtctgtggttttcatttgccagaaatgcctttttgccttttactacctgagcaagctctaactcaggggtcagcaaactatggccctctgctggtctgtaaataaacaagtgtttggaatgctaccatgcttgtttgtttatgtattgtctatggctactttctgtgctatcataacaaagttgagtagctccaacaagagactatataacctgaaaagccaagaatatttactatctgccccttcagagaaaaaaaatactgctgattcctgctctaactcaagttccatctcctcttagatgtttctgagttcctgtgacattttacctacttttgatatattgacaaaagttactgccctgaaagaataattatttatgggcttgaaattaaggggagagaccaagacttattacttatctgtatactcctgttgtctatcaagtctacgacacaatgctcaataaatgctggctaaacaaatcacagaaaacaaacctgcatgctggacattttgatttgcttgcagctgaggggctcctgaattcccaggggtggttgctgtggtcgaaggcacctgaccttgcataaagttcggattggcctgtcctgctgagaagccaggtgggaggcgtttaggcattccttaatagaaaacaatgagtaaggcagttacctagcaaatttatactcttgcttagatatggaatgaataaggaaggatgagctgcatgaagtctccactggcttagctctctctgtcacactggtaggatctttaataataaggttgggaaagatggttaaaaaaatcaacacaatctcttatatgaggcattgtcaaaatgaaaaataaatactaaaaaacttacacttagaacatgccaaggaaaagatggcaatctgctccctaaatgtgatctgaggccacgccacagcaaggtttgagggctcacttttctctgtaattaacaatggaccccaaaactttagttattttaacacaggcaccaaaggaatatgctaaattctctcatttcaaacaaattgatgtgaaatagtataaaacaaagagatgggtcctgatattaaggatagattgattatttttcctttgagggaaactgatggcaatctcctttgcagaaaatttccccccattattgcgcttgtctctttggaagagacaggagattagaaacagttcatgggagcttcaaagtgatgctgtattaaatcattatgctttcccctcataaggtttgctgtgattctgacaggtttggtaccaaaaaccatactctaatggaatctttctcaagtatcagttcctttttggaagggctaattttagaaaacttgtaataaggagaatctcagaacccacttatcatttacaacacaggccttgatgtggccagatcacctaggtgagcatatcatctgctctatgaaagcatcaagacctaaactcacttaaaaatttattacattcattcatttatttatttacttttatttttattttttgagatggagtctcgctctgttgcccaggctggagtgtggtggagcaatctcagcgcactgcaacctcctcctcccaggttcaagcaatcctccctgcctcagcctcccaagtagctgggattacaggtgtgcaccaccacacccagctaatttttgtatttttagtagagacggggtttcaccatgttggccaggctggtctcgaactcctgacctcaggttatctgcccgccttggcctcccaaagtgctgggattacaggcgtgagccactgcgcctggccatttatttttttaagggccaaattttcaatgtcctgaaaaactcttagtagacaaatatgcatttgtcctttctttaacagtgacaagtcccatttgcatgctcccactgtaattaaatcagtaatcacatttgcaggagggactacccagcttccactgatctggggtagatacccagaacagtgaaatttggagctgaaacatccttgcattttctaagaacttcttacaattcaaatattagagcctgcatgtcagcaaaattaattacaagagagtaaaaggctgatgagcaacttaacttcatcagaaaccatgggaacatgcctttgctatgttgcactaaagatgcaaggggttttttctgggtaggcaatgggtgtcttttggtggggagtatgtttatcagatgacagtattactgatactctataccttactgaaaagctccaagcacattcatgtgcactagatcaatgattaataagaataaataataaacatggagatggataagttttactgtaatcgttttacctctcacacattaagctccattgctttttcttcatacaagaggcaccttacaaaataaataaataaatctcctttaggtataactggtggaattccctctctaaggagcaggcattggcattataaaactataaaagtcaatgatttctgaacttattcccctttaatactttaaccaaacttaacaagtaccatgcttactattttattaactaggattatcaaaattgataactaaaagggccttttcttcaatgagaccctgttctttttattttgctctattgcataatcttaatttttcagcaactgagaagtttaaattgttaacaaaatgcatttttcttctggacattttaatttactagtacaagatcaagcaaaaataatttgaaaaacaaaatgaacatctctacattgaattttacctgaattttagtccagagagctagcttaaatttaaccagtaagatgctgcataacgtatcaagttaactttaagttatatcaagtgtcaccaccatatccacaaaaccaaataattatatccttactccactccctccattaactctaaaaactgaagttctactaagatctagctccagcaaatttaccaacacaaatagctacagtgttcctcacctcctaggcctggatgtaaactctgtggcccctggtttggtggttgctgctgcatcaccatgaagttaggtggcacatttccctgttgaaccataggattccgacccggagagctgacaggctgctgaaatccctggggaagtgggttattttgaggtggccttggtcccatctgctgctgagtttggttaaccgttggggaggatgcaggggatccctgctggaaggaggagggtgaggaggcaggagacttgttggtgaggtggggctgctgcaagggagttgggaccctagagggccctccctgcaaactcttcatctgaggagctgtgaactggcctgggttgctcatctgaggaaagtttgtgtgggcttgtgaggcttgctggctgccaaagggatatggagggggagggtgggaaggcgtctgtaccgtggctaaggatggtcttgcctggagttgctgttgcattgggccgggcaagggagccttcttccacccttggtttgcagtcattgtgcccagagaaccctgggctggaggaggttgaagggctccagaaggcagctggttccagcctggaggaacaggcacctgagttggggcagtaaactggggtcgaattccctgtggctgttgctgctgatgttgctgtgggggtcttgcctgcaactgttgttgctgctgttgctgttgttgctgctgctgctgctgctgctgctgttgttgttgttgctgctgctgctgcagctggggaaaattagctgggttcatttgtctgttcacagagacaggctgcattgggtgatgtgggggagctaaagatcctgagggatgactttgctgctgtatatggagcccagagaggagtggatccattgcatctgtttaaagatagtcaacaaagcaataattaacctactgcaatctagatcttagagaagtggcctttgtaattctggatatacagagcaaaatctgctggtactattcgataaaataaatgcttgtgaataccttctatgtatgaagcaacataccaagatgatgaattctgtcttaaaaagagcttggtcagtagtggacattaagagcgaagtgtaaaacatggagaccagtatttaccaaatcatattctggagaactatgttaattagcattataagaaaacaaaacaattaggtttgggaaacactgaacctaacaaacttagatgcgtttcttcactgtaggactttcagtgcctccaatatgttacttttgaatctccaggagggagggtaaagaatgatgcatttaccaaatttacttgactacagaattctatgtaatgagcatcttgcaggactacgcaggccaaggcacacttttagaaatgttggggtataattgataagaaaacaatgagaaattctgaaaagaaaataatgacatttagtttgaagaaatcaggtcagattttgtaaagaaggttgacattgtgagtttggaaattagaaattcagcatcagagataactgaattttataatgatctgtgcagaaagtttcagactcttcatcctcaaagattggaagtcattacctgactgagaagcagggcgaggagtcctgggctgcagctctggattggggcctggtgccatcatggaagatgacacatttccacccgggggtatcataacagtggcagggttgttcatccttattattcctagaaaaaagatccctaaaatagagtactggaattggcacaatttttgttttttaatgagttatttcaagaatatgaaaagatatggaaaatttgtttttttttttttgacagggtctcgctctgttgcccagtctgccaagtggcacaatcacagctcactgccatctcgacttcccgggcccaagtgatccttctgagtcagcctcccaaatagctgggaccatgggcacatgccactgggaccacaggcacacaccactgtgcccagctaatcgttctatattttatagagatggggtcgctatgttgcctaggctggtctcaaattcctgggctcaagcgatcctccagcccagccctcccaaagtgctgggactacaggcgtgagctactgcacccggcctggaagtttctacacccaccatctacctttttaaaatttaaaaaatttgctcttatgtccttcagatatatatgtagatacagcagaagccccctactccttccattccacttcctccctcttattgcaattgtggttaacagttctgttcttgtttattgaccttttctgtatctgtaggtaaactgcactttttctgtagataaacattttttgtatgcttttaatctttgtataaatggcaccttactatatgcattctttgtcagcttcctttttcacttaatgtattttttgagattcatctctcttgactgttataagggttccattgtatagaagcatatatccacccttctgctgatgaatactaaggttttatttttcctttattcttataattttgcaatgttgtgtatttgtcatgaattcttgtggatacatgagagtgtctttagactatatatttagaattgctaggttttaaagtctaagcatctttaattttactagatattggtaaactgctctcaaaagtggttataccaatttatactcaaactagcagtttgagaactcctctttctccatatctgaaaatttctgatactgctaaacttttcagaatttatcatctatgctcctaagtgagaataggtcaggcatggtagctcatgcctgtaatcccagagcttttggaggccaaggtgggaggactgcttgaggccaggagtttgagaccagcctgggcaacatagaaagaccccatctctacaaaaaataaaaaaatcagccagtgtggtggcaagcgcctggattcctagctatttaggaagctaaggcaggaggatcacttgagcccaagagtttgaggctgcagtgagctatgatcatgccactgctctccagcctaggcaacagggcaagagcctgtcttcaagaaaaaaaagtgacaacgcctatacttattctcttttcctttccttggctacagaattctctgtcatggagcatcttgcaggactaagttggccaaagcacacttttaggaatgttgaggtatgaataagagaacaatgaaaaattctaaaaagaaaatgatgacatttagcttgaagggcagattttgtgacattttgatttttggcatcgaggtgaaaataacctcaaaatgagttggaaagcatctttcttctttttctatgctctggaagaatgtgtgtatctgttctttaaatgtctgagaaaactttcctgtaaaaccatctgggcctataggtcatactaattgatttacagggaaacagatttttatttcaatttcttaaatggctatagacttttcaagttttcaatgtcttactgtcaatttttattaaattataattttgccaacactaaaatttattagcatagttaattgtggaatatattttttctattctttttaaaaaatgatatataattcatatactataatattcaccttttaaaatttgtacttttttcattctttacattgtttgtgccctctttttttccttggtggtcttagcacattcatcagttttagctgtcctttcaaagaaacatcttttgggccaggcacggtggctgacacctgtaatcccagcactttgggaggctgaggcaggtagatcacttgagatcaggggttcgagatcagcctggccaacatggtaaaacccctgtctctagtaaaaatacaaaaattagctgggcgtggtggtgggcgcctgtaatcccagctactcaggaggctgaggcaggagaatcttttggttttgctgttctgttgtttttttgattcatattttacttatctctattcttatctgtattatttccctcataacttacagctctgctcaattcttaagtcagacacttagcttgttaattttcagttggtgttctttcttaatataaatttctgaaggcttaacatttctttgaagtgttgtattggctacatctcacacatttcagtatatattattctcataattccattctaaatattgtctaatttccatcaggattgcttttttaaatcactaagtatttataatgcatttttacgtttccaaaaatatgagatattttggttatgcttttttttttttgccactgacttaacctaacagcactatggtcagagaacagaatctatgtgatattaatatttggtatttactgaaacgtgctcttggaataatccttggtcagtttgtataaattttccatttatgcttggaaatattaagaattcttgaattatgactgcatggttttgttttgttttttttctccgagatggagtctcactctgttgccgaggctggagtgcagtggcgcaatcttgactcaccacaacctctgcctcctgggttcaagtgattctcctgcctcagcctcccgagtagataggactacaggcacacgccaccatgcctggctaatttttgtatttttagtagagacggggtttcactatgttggccaggctggtcttgaactcctgaccttgtgatctgcctgtctcggcctcccaaagtgctgggattacaggcgtgagctatcgtgcccggctgactgcatggtttctatatatgtccattatataaaaagtattttgttattcaagctctcctttatccttactaattttttacaaacttggccatcaattactcacagaggtgtattaaatctcccctaaggtttgctgtttacatgcaattcttaaatgtcttgaggctaggttgttaaatacgtaagagtttagcaacttcctggtgaatttttccttttacattatatagtggccctatataccttcagtgatgctgtttattttaatgtctgctttatctggtaaaaatattattatgcttttcttggttaataatcaccttgttaatctttctatctttctaactttgaaccttctgagtccttatattttatgtgtttcctgtaacagcacataggtaaacctgagaatactattctgattaatcatttcctttttatcagtgttcataatccatttacctttattgtttactagtatattttgatttttttgtcattttatgatttctatttaccctttttttctattctgttttcctattttcctgaattttactggattaattttttttcatcatggtcatcctctttaatcctccactactagtttagaagttatatattccattcatattattttactggtatctttaaaatgtcagcagacatacctgacttaaagtttaaagacatatatgatcatcattattactaaataagtcaatgcttatttagatttaccccatgcttatcaattatttagctcaccattccttcttagatcttatttcttccatcttaggttcaattttcttcttcctgaagtacatccttgagcagttcaattagcaagggtctgttaatggtaaattctcttagtctctttgaaaagctctttatttcatactactcttgatagtatagctatgtttaaaattctaggctgtcaattatatcctcagcactttgaaaaaattattccaatgcttcctggcctccaatgctgctgttgagaaatcaagaaaagctgatagtctttcctttgtaaataatacgtcttttcttttgggttgcttttaacattctgtttttcaatgttctgtagctttacaatattgtgtctagatgtagttttatttttattttgtagtgctcaggaatactgggcttctgaatctgaggacttacgtctttcatccattctggaaaaaattttagccattctttctttgactgtcatccctcctcaatttctttatcttcttcaggaactcttttcaaacatatgttaaaccttctcattttattcttcttgtctcttgacctctttcatatttccatctctttttctctgcgcatcctgagtgatttattcaaattcaccttccaatccacctatttctaatttgctgaataagttatccactttgatgatttttaaatttctgtaagttctgttccccccatctctccttatgtttgatagtgtcttgttttcttatgattctcataattgttaatactctgacattcctattacctaaaattttagagggagggaatctaatcctaaattgtataaattcagaatataagctcatttatatcaggctttaactaggagaagtatgcaatgacttgggttgagaaaatacgcccctccacagcttcaacagttatcaccagtctagacctacctaatgttaatgacttagcctggctattaatgggtattcactaacatatcaaatgtccaaaatgcaagagggtagagaagacaattccacaacacccattctcccacctaacgtctagagccccagcgaacacagacaaatttcccattaatttccctatgccagagagtgacattttcctaatctatctttcactgaaaattctggcttcatgaagaattctgaattctaacttgcttcttcctgttgacccaaggctttatcttctatcccttcccggccattaaaacccaaatgctttggaccctgcagaatctcatttgtttactgccgtttaaatattcacctttgacatttttttttttttttttttgccctagggagttcctctactttctttccccatccctctgcttccaagcccagctacattttttttttttgttttttgagagggagtcttgctatgtcacccaggctggagtgcagtggcgcgatctcggctcactgcaagctccgcctcccaggttcatgccattctcctgcctcagcctcctgagcagctgggactacaggcgtccgccaccacacccggctaattttttgtatttttagtagagacagggtttcaccatgttagccaggatggtctccatctcctgaccttgtgatctgctcaccttggcctcccaaagtgctgggattacgggtgtcagccacagcgcccggctgcccagctacgtattaaatgttataggccggacgcggtggctcacgcctgtaattccagcactttgggaggctgagacgcgtggatcacttgaggtcaggagttcgagaccagcctggccaagatggtgaaactactaaaaatacaaaaattagccagacatggtggtgggcacctgtaatcccagctactagggagggtgaggcagagaactgcttgaacttgggaggcagagctcgcagtgagccaagatcgcgcaactgcactccagcttgggtgacagagcgagactctgtctcaaaaaaaaaaaaaagttatattttaagttttgtagttggagaggacagttaggctaatgtttatctgttgaaactggatctgtttctgaggaatcgcacctggttttttaaagatggtagttagacagttaagaaagctctcatgagggcttggtgcggtggctcacacctgtaatctcagcactttgtgaggcccaggtgggtggatcacctcagagcaggagttcaagaccagcctggccaacatggtgaaaccccatctctactaaaaatacaaaaattagccaattagctgggcatagtggcacctgcctgtaatcctagtcactcgtgaggctgaggtgagacatcgcttgaatccaggaggtacaggttgcagtgagctgagatcatgccacagtactccagcctgggtgatggagtgagactgcttcacaagaaaaaaaaaaaaagagaaagctctcatgagataagaaacaggtttttggctgggcgcgatggctcacacctgtaatcccagcactttgggaggccgagacaggtggatcacaaggtcaggagatcgagaccatcctggctaacacagtgaaccctcgtctctactaaaaatacaaaaaaaaaaattagccaggcatggtggcatgggaggctgaggcaggagaatggcgtgaacctgggaggcagagcttgcagtgagccgagccgagatcgtgccactgcattccagcctaggcgacagagcgagagtccgtctcaaaaaaaaaaaaaaaaaagaaacaggtcttcttggtccataatgagcttcctaatcccagaaaatttcaagtatatgctgactacatgttcaatagtgacactataacatgcattccagtactagatgggaatctgcacaagatccaaggttctcacctaggggaaattttgtcccctgggggacatttggtaatgtctggagacattttaagtggcacaaatgcagggaagtagtggtgctactggcatctggtgggtagaagccagggatgctactaaacatcccacaacacacaggacagcctcccacagcaaaaaattattggccccaaacatcaatagtgttgaagttgagaaacttgaattaaatgactactatagtatccccacaaatcttggaattctataaggctatgaaaaaaaacaggctatggatttagttttagttgcaaaagactcttgcttattagctaactttctgttgcccatgctaagagaagaaagcagtactaagaataattgaaaaaccaactgttgtagatacacagttctaaagttacttattattgttttagaggggatttaaggtctctttccctagaaaaatttagctgttcagtttaacctaatattaaactttgtttgcatccttcaagtctcaatagacaacagagaaaagcaatcctaaaatatgcttggcagtaaagagagatatcttgggggttaagatgttactgttactacaggtcattactaattgattattcctgaaactttatactatatacattatcacaatctgagtccttcattaaataccaatctaatctgatttcaacctaaagcttctcagtttcctaggttgataatcaactatagcactataattggctgggtacggtggctcagttcatgcctgtaatcccagcactttgggaggctgaggtgggcagatcacttgagcccaggagttcaaccagcctggtcaacatggcaaaaccctgtctctacaaaaaacaatacaaaacaaaacaaaaataagccgggtgtggtagtgcacgcctgtagtcccagctactgcagggctgagacaggaggaacacttgaccctgtctcaaaaaaaaagcactataatttacatgcacttcttagagatacttagtaaacatgcttgctatttgccagatactagcccaagagagcttttaattagggtactaataacagttaagtggcgtcttaacattttaagcctagaagggatctctagcattgtttccagaacataaagatgtttataggcaactagagtcagtacatattaagtcctttggccaggagttgagattagaacccagatttcctgatgctcatcccaggtttattcattctttcattaactatatctaacttggctaggcttttcccactctgcttctggcccatgtccttccagtagtggcaacagtgtcatctatcatttctcataaagctaccttaacaccaaatgctcagacttctgtggggaactacatctatgtacacaataccaggctggatattttacatctattttatggtattccacaacagcccaacagcacaggtcctgacatatatattttcctaagtcctaacaagaacttaggaaatgtttgctacactgctcagggctcttctaccttcaagcatgagctcaaaagatggtaggtattattatttcattttatatgtgaagaaagtattgcttggggaagtacagtaactagcttgaggtaacctgtaaatggtagtaccagaatgaaaacctagttccaattctatgatcagttcattagctacagttcagaatagcattttttttgttttgttttgagatagagtctcactctgttgcccaggctggagtgcagggtgcgatctcggctcactgcaacctccacctcccaggttcaactggttctcctgcctcagcttctcaagtagctgggattacaggcgcctgccaccacacctagctaatttttgtatttttagtagagatggggtttcaccatcttggccaggctggtctcgaacccctgacctcaggtgatccacctgcctcggcctcccaaagtgctgagactacaggcatgaccaatcgtgcccggccaagactagcatcttataaattgagctcctctatactgctgcatttctccaacagctactctggtagagtgggaggggaatgactgggtaagcaggttcttactctgcttcaaccacagcagctgtgcttttctgttttatttgaataaagggtcctgaagctgaaaaaattggaaagccactagtgcagtgaaaaaagcactgaactgggagttagaagatctgtgatactagtttatcgctccttgaccctgggcaaatcacttcctttatgtgagttccacagcttcctctgctttaaatgacagccaactcaattctaatattctgagattcaatctcagaatattgagttcaatctctgaagaagaaatttcaggattactagaaaaggaagcaatttataactctcaaattctaaatacataaaaacacatattctctcagatacatcttcagattccacataagcacacaagaactcaattcacagatattctctgcctcagagaaagtgggagttggaaagctacattctccattgtactattaaaataatgagggtagaaaatgtctcacttatttctatttccaacagcacaggtcatgtcacacaacaggaagtcaataaatgtttgctgcatggctcagtgttcatcaacctttaagcacgagaccaaaagattgcaaagatgcttcatgctgtgacctctagcctccgggaaggactcatgtctagctttcctgattcagcaaatagagatgttaagtatgccatgaacccccacctatcttgcagggctcaaatgatcaaataagccaaaaaaggaaactagtaaaatgtcatacaattgagtgggaggtcttacctggaccacttgccataggaaatcccgcctccatcctaactgaatttccagctcccatgggtccattcattctcacatcttggcttcggttctgagccaaagccaggttaatagcaccttcccctgaaaatgagtcaagtgataaaaaggaaatcattagaataaaatgcaaattttgtttatagacagctatataagtgctttagttttctgtgcttttgaagaattatggttagtttaccaccagaaaaatggtgggttcaatgtagatgggtctttcttcaacccatctaagcaggtttcatgaagcacaaggagatataaccaattcttacttgtaatagggaagcagggtgaccatgaatgatgcttagtatcaacagagatcctggaactctgaatatttattttcaaccatcttaccaattgtgtgtgtgtgtggggtgtgtgtgtgtgtaatggaagaaaatgttctcaaaaactctcaaaatcctagacttccttttggtaatttatgatcagaaggtagacactaaatataagtaggtttaaagaagaaagaacctatactggtgtggggacactaacacttgtgaacaaaataccaattccattcaataactgcaatataaacatatttccagcaggaaaaaaatcatgcaatgaagaggagataggttgctacaaatctactttctgagacacctaatgacaggaccaatacttttataggtttttgttttctgagatggggtctcactttgtcacccaggctgcagtgcagtggcacagtcatatagctcaccactaccttaaattcctgggcccaaggggtcctgctgcctcagcctcctgagttgctgggaccacaggcgcacatcactatgtccggctacgtataggattttttttttttttgagatggagtcttgctctgtcactcaggctagagtgcagtggtgtgatcttggctcactgcaaccttcatctcctgggttcaagggattctcctacctcagccttccgagtagctgggattacaggcgcccaccaccacgcccagctaatttttgcatttttagtagagacggggtttcaccacgttggccaggctggtctcgaactcctgacctcacgtgatccacccacctcggcctcccaaagtgctaggattacaggcgtgagccacggtgcccagcctgcataggatttttaattttaccttatttgagcttcacagtaccctcataggtaatgttactagaagtgttccaattaagtagactctaaacttagaggcaacttaaatcttacttggtccaatgataaaaacgtctctgaaacaagcaacagaatgtttcttgcacttaatccaaaattttgactattgttattgtaagagagcaccaccttgtggagagttaaaatatagctagtctgtggctgctgagctgaaaggctgcactcacccaagtccttctaaactgtagggttctgattcacagggtctgatggtaaaacagaaagttaatgaggtatggcagtttcctctgttctgtcactgatctaggtcagccttccttttttttttttttgagatggagtctcgctctgtcgccaggctgaagcgcagtggtgcaatctcggctcactgccatctccacctcccaggttcaagcgattctcctgcctcagcctcccgagtagctgggattacaggcacgtgccaatacaagcagctaatttttgtatttttagtagagacggggtttcaccatgtttaccaggatggtctcgatcttttgaccttgtgatccgcccaaagtgctgggattacaggcgtgagccaccatgcctggctaggtcagctttctatgtctattttaaccagggaggttcactggtcacagggaacaaacagcctaccaaaaaggaagcaatcactgggagctaccagatgctatagcttgcctctagaagtcaggcgtaaaaagagaaacagaatacaggtcatgagggtttccattaaaggaagggaactattaatatacaaaatttgttaagacattctaagtagaaagaatattgttctggaaaaggacatcagttcgtatcattccttaaaaacagttccattgcttcccactagtttagaaataaaggccaaacttctttttttttttttgaatcggagtgtctcactgttgcctgggctgcagtgcaatggcgcgatctcggatcactgtaacgtctgcctccgggttcaagcgattctcctacctcagcctcccgagtagctgggattacaggtgcttgccaccacgcccggctaatttttgtatttttagtagaaacggggtttcaccatgttggccagactggtctcgaattcctgacctcagacaatccgcctgtcttggcctcccaaagtgctgggattacaggcatgagccaccgtgccaggccaggccaaacttcttagcctatacaaggccttaaattatctacctagccaagtgttgttcaacagaaatataatatgagccacatatgcaatttaaaattttctagaagccacagtaagaaacagatgaaattatcatttattttacttaatacattcaatgtattatttcaacatgtaattaatgtaaaaattattattattttttgaaacagggtctcactctgttgctcaggctggagtgcagtggtgagatcacagttcactgcagcattgacctaactgggcttaagtgatccttcccacatcagcttcccaagtaggtgggactacaggagtatgccaacatgcctggctaatttttttattttaaattttaaattttttgtagagacagggtatcactatattgctcaggctggtctcaaactcctgtgctcaagcaatcctcctggcctcagccttccaaagtgctgggattacaggtgtgagccactcagcccagccaatgtaagaattattgagatattttacattcctttggggaataccaaatcttcaaaatgtaatatgtattttatacttacagcgcacgtcagttttaactagccacattttcagtgcctaaaagcaacatacagtctgtggctaccaatattggactgcccatatttagccctgtctacctctttaaactcatctcatgctatttttctccttcaatagcaaggattcagccccagtgtttccttttagtttcttaggcacacaaggctgcttctcaccccaaggcctttgctcatgcggtttcctctgcctagaacagttctctgcactcttcgcatagctagcttctcaattttcatgtaatcttaagtgtcacatgcccaaaaaggcctctaccaaccatcttatccaaggttaggtaacttttatcagaacatcttgttatttctgcagagcacattccatgtaatcattcactcactcgttttcttgcttgcctcccccatcactatacagggttaattacaagtctgtccttgttccttcacatctgttgttccagcataattaatagcattctctttcactttcagaaatgtcctaatttaggctaggcatggtgactcacatttgttaatcccagcactttgggaggccaaggtgggaggattgcttcagaccaggagttcaagactagcgacatggtgagaccccgtctctataaaaaattagtcaggtccgtggtggcacgcacctgtggtcctagctactcaggaggctgagatgggaggattgcttaagcccaggaggccggggctacagtgagttgtgtttgtaccactgccctccaacctaggcaacacagtgagactttgtctcaaaaaaaaaaaaaaagtgtcctaatttagatgataaattatatgactatctataatacatcatttatacataaaatagtgcctggtacgtggcagatgctcattagctatttattaaatataatggtcatcttataaccttataaagaattataagcatttttctatatgacaaattacttcctggaaaacctcacatttatcaaatctcatactgacaataacagggttagggcaaactgaaaacctgtgagactttgtaaccagagctctaataaaaacaataactggtggaggcaaaatgccagaaaaaaatgcagcagaaatgcctggttaaaggtgctgagataatgcacatgtagtggagttctgagccagcggggctgccattatggtgggcacaggaagaaatgcaacctgtcatgaactgagagccacacaaggctgggggatgcacgtcaggaaggcatacgaatatacactctcattcttaattttaatagagctgaaaagactcccacacatgcaacagctgagtgaaaagctttttcttgttgataattataattctatttctactattccagctcctcttacctaagaaaaaaaatcacatattaataaacagaatttccacactatactgctatcattcccctatttaccaactgcatatatgctaatttgtgtcaaagagaacactaccggctcccaaacttgccaattaggggtccacaaactacgtcctgtgggccaaatgcagcccactgcatgtttatttaaataaagtgttactgaaatcctgccatgtttacttgtttacatatcgcctatggctgtttttgccctacaagatggaactgagtacttgttgagttgagatcttatggcctgcaaagccaaaaatatttattcttggccctttacagaaaaagttagcagactactctttagatcaccatgaatttacagagggggcacaaaatgtcctcaaaaaagatgtttccccaattccctggccaaaacttaaaaaaggaagggtacaggaagtatttgtcaatggagaacggactgttgggagaacctgtccctcaagccttgcagcagacacgatagtggcaacattgcttcattccttcttttttgttgttgttgttttgagacaaaattttgctcttgtcgcccaggctggagtgcagtggcgtgatctcggctcaccgcaacctccacccaggaaaattttgctcgacacccaggctggagtgcagtggcatgatctcggctcaccgcaacctccacctcctgggttcaagcaattctcctgccttagcctcccgagtagctgggactataggcacgccccaccatgctcggctaatttttatatttttagtagagacggggtttcaccatgttggccaggctggtctcaaactcctcccctcaagtgatccacccaccttggcctcccaaagtgttgggattacaggtgtgacccaccgtggctggccaacattcttcttacaacttacaaaatcaacagcccagttccacaaaagcaatagctgctgccatcactttcactcctgctgaattcccaggagcatgggaacagagatcatctgggacacacatgtagcctaaaagttaaagaactctttctgtattgtgataatcattgtcatatgtgaatttcataatttcttaaaatatgttatctatttgcttccttgctagtactcatgtttaaatttatggctataatgttaagggagaaccagcattatattgttttaggaagtaggtctgcttaagaaataaaactggtacttctttctccagtgaaaaacactatcaattaaggttttgaagcctttaaataggtaacagagaccaaaaaacatgtggggttttaaagaaaccacttatgtattccttaaagtataaacagcccacatattgttattttatccaatagttgttcgacttccacttttcctaatagttcatcctacagattgctgtgaattaattgtacttttctggatccttttagatagttccacatttttcaaattaaagtggtattgcttaagccactattctctcatttatcaaatggtgaaaattatcccatttctcaatctacatataaccctttctaaataatttgtttgttggtattgcccctttgagggcacagcaacctacaatgctagactgcataaaatgtgtctcactcctataaacaaaatgacctcgactgctcaggtttcatggagcaattaggttctacgtaagcacagggccaggaggacctggactaaagtggaagggaaagctggaattgctggttgtcacctggctgtatcaacacaggaggggaagagagggttctagttcactgagcttccaaagagctcccccacacatggtaggtacttacatctctcacaggtttgtcttccttactaaagtcataagctcttccgagtttataacaataaggacaatatttatcattgtattccaaatgctaaagcttatagtctatggggataaaacaataatcaaataattgctctatgaaagtgtgagataaatgatctgagggagagaaacaaacttttgtgagagcacatagcaaaggactctgacttgccaaaggagttcagaaaatacatcctcaagatttaagctgatacttgaaggctgagcaggcatgaactaggggaagggggttggtagggaatagtatttcatttagagaagacatcaatgcaaaggacctgtggcaggaggaagagaaagctgagaagctggaacacagggggcaagggaggaaagttacacaagataaggctggatgaggaaggtagaggtgagaccatgcaaagcctgaggtcatggtaaggagtttggtcttcattctttgaataataccaagagatagcaggattttaatctaggggtgtagggttataggggtgtaggtgtgtgtgtgtgtgtgtgtgtgtctgtgcgtgcgtgcacgtgctcatcaaattctcattttgaaaaagatcattctggtaaaaatactgaaaatgaacactgcgggccggcgtgatggcctgtaatcccagcactttgggaggccgagagggtggatcacctgaggtcagaagtttgagaccagcctggccaagacggtgaaaccccatctctactaaaaatacaaaaattagctgggcatggtagtacatgcctgtaataccagctactcaggaggctgaggcaggagaatcacttgaacctgggaggtggaggttgcagtgagctgagatcatgccactacactccatcctgggactctgtctcaaaaaaaaaaaaaaaaaaaagaaaaaaaaaagaaaagaaaatgaatgctgctacaaaaggaaaggactgttgaaggcttcataatctgttagacgaataaagaaaatactaaagtttatttggtggaaggaaggaagcaaattaaattatatgttaagctgggtacagtggtataggtgtagtcccagctactcaggaggctgagatgggaggatcatctgaggccaagagtttgagtccagcctgggcaacacagaaagacactgtctctaaaaataacaacaataacaaagaaaaccacacaactaaataaataaataagacaaatcaattcctggtcaggatgccaataaaatcaaagtctgaaagactgatggtcaaaattagccaaaggaatggagtccaaggctacagatgctaaagaccatcaggacccagcaataacctcagtcagtccctcttcatcctaaggtgctgcaaagcaaagtacaagttacatgagttgcttggcattctgaaacacaagagcagaggaacagacaaagcagcacagaaaatcatgctatattctactgttgtaatgattctggtctagatgggcacatggcaaagtaaaagaccttcaatctgaacggagagaatccctaaatcccgaagctgctggttgttgctctgagcaaggatccgtagccgctccgctgcttcccgggggatgttgaatgtcacacgcacgctgttccagggctccaccttctgtacttttagcttgctggactcttgattgtgaaagaaaaagaattatattaataatcttttagccaccagaggagatggaattaaaaaacaaaccaaaagagcaaaagaataaggtggagcaccagcttggaatagctaacagagcatatgctttggagctacagactcaaatctaatcctagctttgccacttagcacctgggtgaccatgaacgagctatttaacctttctgaaacttatctttttcttttctaaaactatgaaaaaactacttcatatgatttttgggtacaaattagataatatatgcaaaaaatctagcatagtacctggcacaccacaggcaatgaacggaaagccgtaagatggagaaaggaccataagaaagaagagagaggttaagtttaaattaatagaataggctcatgcctataatcccagcacttcgggaggccgaggcaggtggatcacgaggtcaggagttcaagaatagcccagccaacataatgaaaccccgtctctactaaaaatataaaaatttgctgggcatggtggcatgcacctgtagtcccagctactcgggaggctgaggcaggagaattgcttgaacccgggaggcagaggttgtggtgagccaagactgcgccactgcactccagcctgggcaacaaagtgagactccgtctcaaaaaaaaaaaaaaaaaaaaaaggtaaaggacagttctccagaaaagatacacaaatggccaataagcacatgaaaaaatgcttgacataactaatcattagagaaatgcaaatcataatgataagataccacctcaccaccattaccatggctactatcaaaaccacagaaaataaacaatggtgaagatacggagaaatagaacctgcggggcacggtggctcacacctataatcccaataatcccagcactttgggaggctgaggctggtggatcacttgaggacaggagttcgagatcagcctggccaacatggcaaaaccccgtctctactaaaaatacaaaaattagccaggcatggtggtgcacacctgtagtcccagctactcaggaggctgaggccagagaatcgcttgaacccaggaggcggaggttgctgtgagcccagaatgcactactgcactccagcctgggtgacagaacaagactccgtctcaaaaaaaaaaaagaaactggaacccttgcgcactgtcagtgggaatgtaaaaggatacaagctgctgcggaaaacgacagtttctcaaaaaaaattaaaaatagaattaccacatgatgcagcaattctacctcggagtacacactcaaatgaactgaaagcagagtctcaaagagatatttgtacaccatattcatagcagcattacccacaatagctaagatatggaagcaacccaatgtctactgacagatgaatgaatcagtaaaatatggtatatacatacaatggaatattattatattattatttgagacggaatcttgctctgtcaccaggctggagtgcaatggcatgatcttggctcactgcaacctccgcctcccaggttcgagcaattctcctgcctcagcatcctgagctgggactacaggtgcatgccaccacgcccagctaatttttgtatttttagtagacacagggtttcaccatgttggccaggatggtcttgatctcctgacctcatgatcgcccgcctcggcctcccgaagtgctgggattacaggcgtgagccactgcgcccagccacaatggaatattattaagccttaaaaaggaaggatatcctgccacatgaatgggctttgagcatcttacgctaagcgaaataagccagtcacaaaaaggcaaaattccacttatatcaaggaagtagagtagtccaaaatcatagaaacagatagtagaatggtggtttccagggactagcagcaaggaggaaatggtgagttgttattcaatggttagagacgttcaatttttttttttttttgagacggagtctcaatctgtcgccaggctggagtgcagtggcgcaatcttggctcgctgcaacctctgcctcccggcttcaagcaattctcctgcctcagcctcccgagtagctgggactatagacacctgccaccatgcccggctaatttttgtatttttagtagagacggggtttcaccatgttggccaggatggtcttgatctcttgaccttgtgatccacctgcctcggcctcccaaagtgctgggattgcaggcatgagccaccacacccagccagagatgtttaattttacaagatgaaaagagttacatcctggctaacacggtgaaaccccatctctactaaaaaatacaaaaaattagcctggtgtggtggcgggcgcctgtagtcccagctacttgggaggctgaagcaggagaatggcgtgaacccgggagacggagcttgcagagagccgagatcgcaccactgcactccagcctgggtgacagagcaagactccgtttcaaaaaaaaaaaaaaaaaaaaaaaaaagacaagacaagacttagggcgacacatggtggtgattgttgcacaacattatgagtacatttaatttccactaaactgtatacttaataatggttaacatggtaaattttatgttacatgtattatacaataaaaaatactttttaaaaaagttaagtaattgaggaggtattattaattgtagttacattttacagattggaaagcaaatcccaggcacagttagctgataaaaaagttatttggctgcgtgcagtggcgcatgtccgtaatcccagcactttgggaggccgaggcgggcagatcacttgagctcaggagtttgagatcaccctgggcaacatagtgagacctcatctctacaaaaaataaacagaaaattagctgggtgcagtggcgtgcgcctgtagtcccagctacttgggaagctgaggtgggagaattgcttgagcctgggagatcaaggctgcagtgagctgagatcatgccactgcattccagcctgggtgatggggtgagacactgcctcaaaaaataaataaaaaataaaaaaagttattcaacaacctcaggcaaaacaattttctcttttgttattaactcagctaaacttaaacttctgtatccttcattcagttatacattctaatattaagataatggtcattcaacacctgtgaaaagaaggaaaaaagagataatggtcatagaggaatatgctttctcaaaatgagaaatatctaaggatagaggaaagtgcctacatgttgcctaaagccccttccagctcttaaaccattgtacattgaatgttaacttttccagacatggagttcacttgttctaatgtggaaaaaaaaacagggaaaacttgctaaaaggaatgagataacacaatcataggaatttagaaaagattagacaatatttagtccaagaccattttacaggagaggaaaccaaggcccagaaaggctaagtgatttgctcagaagcctgtggctaaccagtagcatcagagatgacattaaaacccagctctgattctcagggcaatttcctttccattacatgtaggcctccaaacagcaaaaggcaggaagtttggggatcctggttccaccaatcatagacactgcaggacttcttcccactctgaagtatgttggaatcttgtacatattctacacaaacatcaaatttgcttatggtattaacacttgtaatatgcttgcagaaaaatccatattcataacagttatatcttatcaaaatctttttaaacttccatatttgagagatttgacttaaaatattttttggaccaagaatataatctgatagcaccataaatctagagttggttattttttatttatttttatttttttgagacagagtctcgctctgtcactcaggctggagtgcagtggcatgatctcggctcactgcaacctctacctcccaggttcaagcaatgcctcagccacccgagtagctgggattacaggcacctgccagcacgcctgactaatttttgtatttttagtagacaaggtttcaccatgttggccgggcttgtctcaaactcctggcctcaagtgatccgcccacctcgacctcccaaagtgctgggattacaggcatgagccactgcgcccacctttatttattatttattttttttagacagggtctcactctgtcacacaggctggagtgcaggggcactattagagctcactgcagctttgacctccctgggctcaagtgatcctcccacctcagcctctcgagtagctgggactacaggtgcatgccaacatacccaactaatttttgtattttctgtagagatgaggtctctctatattgtccaggttggtcttgaactcctgggttcaagtgatccacccaactcaatctcccaaagtgctgggattacaggcatgaactactgtgcctggcctaggtttggtaatttatttgaaagccataaataaattgaattagcaatatgtaaacaacagaaaaatgtggtaattaatgaagagcaatgaacaatttcaggcccagcaagacctttataatatataactatgattatggttacaatgatgttgataactacatgaaaaattcttaattgtatgctaaataacgcataactatggagaaccttgtacaacacagtgaaaagcagttgaaaaaacaacagcttccgtccagataacaaatctcaaaagataaaacccccaagccttaaaagaaagctaattagctcttgatcaatttaggatttgtgataaaaggaataaatctaggcttttcactatgtccgaagggattagataattgtgctaactagaatagagaacatctaaatcaaggttcaaaaccacaaatgcccgtaagatatggacaggtaatctaaatgtgtgaagaagccagatgggaactgtggtgaagtggggctgctctcagaagcagctgctacttcgtaccatctgggagagagggagaactcaatgttatcagatcttcctatttttaaagacaaatgtaaaaatccggattttcatgcaatataactcaatttttaaagcactggcaatgaaactcaaacactgaaaacaaactaaatctcaaacactaacgtgggccaaataacaaatgcctgcagactggatccagcaagctgttagctagtgacttctgacataaaagttaaaggaataaatttaaagtatattataagcagattcatggaataataagttttctaagctttaagggtccttaaagattcagtttaaccttttcaatttacaggtaaggaaaatgaaaaccagagagttaaaaacaaataaatttgggtcttgagaattacttttatccactagagaagattattcaacaattaccataataagcaacactttatgttcagttcttctatgtacttaaaaagaaagaaaacatgtatatttttaaaatcctaaaattccacctctgtgcttaaattcagccttttgacccaatttaacaagcttgttttgtaaaactcaagataaccatggaagggcaaacatttcaaaaacagtaacaggaagaaaaaataattaaagcaaattacccatgtgtaacaaattgggcacgtttttcaatattgcatctaatttccatttgaagtctttatcatctatatttcctttgaaggccacaaaaattgtggaatcctccaaaatactatcactttttgtgtcatcatcttctagtccagagtcaaaatccatctctgagtcttccattgttgatgaacacaaggaagtatagatgtcttctaagtttggaaggtcatccaaaaccatggtgaatattattccagaagcatatgccaagaggacaataagaaaacttctgaaaagagaagatgcaaaagagcattacaatgcatagttatgcattcaacaatgtataattcatagttctatgaaaattataatttatttaataagaaaatactataaaaattaagaaattacagagaagataagctattttaattatgacattctaaaacaattagttcttacagttaccaaaaataaaaatacactagtcttaaatttaacattctttttattatgttatatgctacttttttataagctagaatgtcaggagaagggaagaaaggatcacaagaaaataaaacaagtacatactttttgagaattataggcctttggttgaccccacagagcaaggggctccccaagactccccctacttctgtcttgacaaaagcttaaaaggagccaaggtttctaaagccttcttctttctccaaactacaaagcacaaccagacctgactaatagcaactggatgattacctaaaattctgaagtctttcatgaaccattttaaacaactattaaagggttattaacagtggaatggctgaaaataatgattctgaaataaacacttaaaaattcttatatgaaagggctgggcgcagtggctcacacctgtaatcccagcactttgggaggtcaaggtgggcagatcacttgaggtcaggagtttgagaccagcctggccaacataatgaaaccctgccactactaaaacacaaaaataagctggacatggtggtgtatgcctgtaatcccagctactagggaggctgaggcaggagaattgcttgaatccaggagggtggaggttgaagggagccgaggttgcgtcactgcactccagcctgggcaacagagcaagactccgtctcaaaaaaaaaagggggttgatatggacaggtaatctttatggaggtaaagaactgtgttccggacagaattaaattgcttcctaaattttagatataaagaagttacattttctgctatcttcaggtatgctgcttaccaaagagtacatgtattaaagatcacacagtgtggccatttcctctgttagtttggggattgaagatcacatacttaacccaaaagtaaatgaatgaacattaattttcagcatttgcggtaagcaaaaatggcatggaaacctaagaacctcccacaaatgttctaataaaataattccttataattttaactataatacaacattgattgattgattgattgagacagagtctcacttttttgcccaggctgcactgcggtggcacaattcggctcactgcaacctccacctcccaggttcaagcaattctcctgcctcagcctcccgagtagctgggactacaggcaagcaccatcatgcctggctaatcttttgtagttttagtagagatggggttttgccatgttgcccaggctggtcttgaacttctgagctcaagcaagccattcaccttggcctcccaaagtgctagaattacaggcgtgagccaccttttatttatttatggcacttatttatttatggcacatgtccagcctttatttatggcacttatttatattattaaagtattacgaattattactttatacttataactataattacaagtttcttaaaaaaaagatggataagaaaattaatcccctaaaaagcaactatattaggttggtaggatcattgataaattttattttcctattttccaaatatgctgcaaatcattaggaaatacaaaactgctgtaatatggttatattccttgcataaatgaaaaaaagtaactcaaacaccgtttaacttttttttttttaatttatttttttgagacacggtctttctctgttgctggaatgtagtggcaaaaacatggctcactgcagcctcaacctcctgggctcaagtgatcctctcgcctcagcttcccaagcagctggggttacaggcgtgtaccaccgtgcccagctaatttttaaaattttttgcagagattggatcttgccatattgcccaggctggtctcaaactcttaggctcaggtgatcctcccaccttggcctcccaaagtgctgggattacaggcatgagctaccatgtccaaccaatttttcttttttaaatagtgaggctggtggatggcttgagggcagcgatttaagaccagcctgggcaacactgtgagaccttgtctctacaaaaaataaaaaaattaactgggtgtggtggtgcatgcctatagccccagctactcaggaggctgaggcgggaggatccctcaaacccaggagttcgaggcagcagtgagctacgatagtgccactgcattccagtatgggtgatagcaacatttttgtctctaaaaataaaaataaaataggctgggcgcggtggctcatgtctgtaatcccagcactttaggcggctgaggtgggcagatcacctgaggtcaggatttcgagaccagcctggtcaacatggtgaaaccccgtctttactgaaaatagaaaaattagctgggcatggtagcaggcgcctataatcccagctacttgggaggctgaggcaggagaatcacttgaaccctggaggcggaggctgcagtgagctgagatcgcaccactgcactccagcctaggggacaagagcaagacttcatctcaaaaataaataaataaaataaaataaaaaaattactactgactaaacttcaacagcaaaggctttccaaaaaccaacctaagcaatccttgggggaaaaattcttctgttataagtaaatatggcaaaaatacttccaaatttgagcagagcaccttgtgttctggcaattatatccttttctagtgctatgactgttacaatgaaactgatttgggtggttaagaaacaacagcagggtcagtggctcatacctgtattcctagcactttgggaggcagaggcaggagtgctgtttgagcccaggagttccagaccaggctaggtaacagcgagaccatgtctcaatttttttaaaaattaaaaaaaaaaaaaaaaagatacaacagcagtcagaaaatctcaaattaataccactgcccttatttgattgccatctgcattttacagatttttaataaactttagaggtaattaaacaaaactaatgaagatttttagggcttaaaagttgctgcttagcaggaaaaatgatgactgcctaaaaaactatgactatttagcagctattccaaagttggaacaactgcaagaaaacatcttaaaatctaagaaacattttccaaaagaatctttaaccagaaaggagactaactaaaaagcctggactttgatagtctccctaaacaggtcgttggtcatgacatgaggactatgtatctagatctggaaaatcttctactggcagatacaggaattgtcagtttaacaatactatgggcattacacagtacttaaaaaaaaaaaaaaaaacagagagaaattgaaagtcagtctatgaaaaattgctggctttccctccagaaaaaataatttttaaagaaacttctttggttggtaggctatttattactgcctcaatttcagaacttgttaattggtatactcagagatttaattttttcctggttcagtcttcctggttcagctgagagtgtatgtgtccaggaatttatccatttcttctagattttctagtttatgtacatagaggtgtttatagtattctctgatggttgtttgtatttctgtggggtcagtggtgatagcccccttatcatttctgattgtgcttatttaattcttttttcttctttattagacctgctagcgatctattatagctagtgatctatcaatttttttcaaaaaaccagcttctggattcactgattttttgaagggtttttcacatctctatctccttcagttcagctctattcttggttatttcttgatcttttgctagctttggggtttatttgctcttcattttccagttcttttagttgagatgttaggttgttaacttgagatctctctagctttttgatgtgggcatttagtgctataaatttcccacttaacactgtttaacactgtcccagagattctggtatgttgtctctgttctcattagtttcaaagaacttcttcatttctgccttaatttcattatttacccaaaagtcattcacgagcaggttgttcaatttccatatagttgtgtggttatgagtgaacttcttaatcttgagttctaatttgattgtgctatgatctgagagactgttatgactaaataggattccctatttaataaatggtgctgaaagaactggctagccatatgcagaaaattgaaactggaccccttccttacgccatccttacaaaaattaactcaaaatggattaaagacttaaatgtaaaacccaaaactaaaaaacttcagaagaaaatctaggcaataccattcaggacatgggcatgggcaaagatttcatgataaaaacgccaaaagcaactgcaacaaaaaaattgaaagtgggatctaattaaaataaagagcttctgcacagcaaaagaaactatcatcggagtgaacagacaacctacagaatgggacaaaatttttgcaatctacccatctgacaaaggtctaatatccagggcccacaagaaacttaaacaaatttatgaaaaaaaaaaaacaaccccattaaaaagtgcgctttcaggtctcccctgcctccaatcttattgtcctccaatctgtctccagacagcagccacagggatctttctaaaacacaaaataggccaggtgtggtggttcaggcctgtaatcccagcactttgggaggctgaggttggaggatcatttgagcccaggattttgagaccactcctgccaacacagtaagaccccgactctacaaaaaaaatttaaaaattaaccaggtgtggtgatgcacacctgtagtcccagctacatgggaggctagggtggcagaactgcttgagcctgggaagtcaaggctacagtgagctatgattgtgccactacactccagcctgggtaagagagcaagttcccgctcttaaaaaaaaaaaaaaaattaaaagagatcaattttggagatggcttaataggcctaggaaacaagttattgaggaaaaacctcaaaacaaactttgccatttacaaattaacctgtatttgatgcaggaccggcaagcctccaaagtggggcttagccttcaagcgttcttggcttcgcccaggagaacttaagggtgagccagggtagggtagaagaaaacagctctattgaagctgcagtgttacaactctgtgactgctcctgcagagcaggactaccccataggcagtgtgctgagactggcagctcagagcagttttgcaattatatttatacctaattttttttttttttttggagatgaagtcttgctctgtcacctaggctggagtgcagtggtgtgatctcagctcacagcaaccgccgccttccaggttcaagcaattttcctgcctcagcttcccagttagctgagactacaggcagatgccaccacgcttgactaattttttgtattttagtagagatggagtttcaccgtgttgcccaggctggtctcgaactcctgagctcaagcaatccgcccaccttggcctcctactgtacctggccagcagttatatttatatctacttttatgtatttcatttattttaatttttttgagatggagtctagctctgtctcgcccaggctggagtgcagtgacacattttagtagagatggggtttcaccgtgttgcccaggctggtcttgaactcctgacctcaggtgatccacccgcctcggcctcccaaagtgttgggattacaggcgtgagccatcgtgcctggcctatacctacttttaagcatgtagattaacaggtggtttatgcagaaattgctagcagaagtatggtaacttttgggtagtcaggtcattgccacggagaggggtggtaagtcttgggtgttgtcatggtaatggtaaactgacatggcacactggtggatgtgtcttatggaaagctgctcctgccccatccctgttttagcagtcctcaatttggtctggtgttcaagccctgcctctggagtcaatttccacctcctacctcatatttaggcttaactgaaggacatataggttttaaagttgaagattaagtaaacagcctgtaattccagcactttgagaggccgaagcaggcggatcacctgaggtcaggagttcaagaccagcctgaccaacatggagaaaccccgtctctactaaaaatacaaaattagccgggcatggtggcacatgcctgtaatcccagctactgggaggctaaggcaggagaatcacttgaacctgggaggccgaggttgcggtgaacatagcgccattgcattccagcctgggtaacaagagtgaaactccgtctcaaaaataaataaataaataaataaatctctttagcaggttgatgttttgccttggtgtgccaatgaattgctagattatgtgtcaagttcaaagcatctgaaaatttcaagttacaacttacaaaaaagtatatactataggttacgtggaagcctgatattaggaaatcaacaattcatctaagtgctgtatgaagcagcatctagaaagctttattcaacaaactttgagggaactatggtagtagtaatgagaaaagttaagtaaatagcagtgatcaaatgcaatttcttcaagtttcaatctatggaagtcaaccaatgacaacaatggtatctttcttactcatctaacaaataatttacctttagaaaaatataaggataaaaaggttattgtaaagccctacaaggaggaaatccaacagtttttctgattactgaggcatcaaatgcctgacattgtatttacaggtatcttgatattgtgtcacaggtttatcagcagttccccaagttcctactccaactttgcataaaggcttactatggctaggtgtgctggttcacacctgtaatcccagcactttgggaagccgaggtgggcagacggcttgagctcaggcttttgagaccagcctggggaacatggtgaaaccccatttctacagaaaatacaaatattagctgggcctggtggtgtgtgcctgtagtcccagcaactcatgaggctgaggtgaaacaatcccttgagcctgaggggagtgaggggaagggtggaggttgtggtgagctgaaattgtgctactgcactattgctgctctgagcaacagagtgagactctgtctcaaaaaaattaaaaatgactataaatactcggtaaatgtcaaagtgttatagtcacacacagcataacaataaaataatattcttcacggcaattattcctgccttaaatggaagaatattcactgaaaaacattaatgtaaaaacaaaatttaagaaaggccgggcgggcacagtggctcacacctgtaatcccagtactttcggaggccaaggcgggtggatcacttgaggtcaggagttcgagaccagcctggccaacgtggcaaatcccatttctactattaaaaaaaaaaaaaaaaattaagaataactctaaattacacatatattcacagcaacattattcacaatagccaaaaactcaaatgtccattaacaggtgaatggataaacaaactgtggtagatacatatagatagaatattatttagatataataaggaatgaagtgctgatacatgctacaacggagataaacctcaaaaactatatgctaagtaacagaagccagacataaaaggtcatatattgcataactccatttatttattttattatttatttatttatttaattattttgagatggagtctcgctgtgttgcccaggctggaatgcagtggtgtgacctcggctcactgtaagctccgcctcccaggttcatgccattctcctgcctcaacctcccgagcagctgagaccacaggcacccaccactacgcccagctaatttttttgcatttttagtaaagacagggtttcaccgtgttagccaggatggtctcgatctcctgacctcgtgatgtacccgcctcggcctcccaaagtgctgggaccacaggcgtgagccaccacgcctggcctattattatttttgagacggagtctggctctgtcacccaggcaggagtgcagtggcgtgatcttggctcactgcaacctctgcctcccaggttcaagtgattctcctgcctcagccttccaagtagctgggattacaggcacgcaccaccatgcctggctaattttgtttgtttttaggagagatgaggtttcaccatattggccaggctagtctcaaactcctgacctcaagtgatacacccgcctcagcctcccaaagtgttgggatatcagccgtgagccaccgcacccggtctaatttgtatgaaatatctagaataagtaaattcacagagacagacagacggattagtggttgtgagcgggaggtataggggatggggaatgggacatcttaatggttatgaagtttcattttggagtgacagacatgttttggaactagatagaagtggtggttgtagtacaatgtgaatctactaaatgccactgaactgttcactttaaaatggctaatttatgttacgtgcatttcaacctgatgcatttttaacaactcagaactcagcccactccatacagaaagtagcacatttaatttcttctcgaaacatgcttttagaaaagtattttccctaggtaatttttcttgtatctttttactgctttaaaatgtcaattgtgcacccatcatgagtattctctaagtagggagcagcagtctttgtcagtcagataaagatttacatagaagagtagctgcttgtggcaacagctctacagtgcttgcttccttctttgttcctaatagcactccttctttcctcctaggatctgggagtgaaggactggtcgtacctcaatgcactgctcaccctggcagaaatgacggccttctgctcctggcacaaagctcttaagtctcagaatgaaagaaaaaaaaactttctagatacaaaaactacttctcagtaacttgcaaatgtcagtgtctttaaggaaaaccagcaataaactcttaaattacatttaatgtaaacaatgactgcttgccagagtagtcacttcaacaaactgagataaaaatctaaggatgttagggcaccaaggcacatacccaaacccctgtcataatactgtacatgaaggaaattctcaaaagaagaaggagagagggcagggagatgatgcaaaaatgttctaatattagcaacttctcatgggcttatgaagcacttctgaagagtcccctgtgccaatttaaacccattatgacatacctcccagtgggggactgccaggatctgttattggagtgctatacaaaagctaggagggagggaaatagaaatttcaagataaaaacagtctaattttttctgggctttagctcacctcagatctaaatacagcatcaaactagagttatgttgagtttgcaactttcaacatatatttctatttttaatcaaaggtatttatttgaagtacaatatcctattatcattttaatcaacataaattctaaaaataagtattgtttactggtctttcattgtcttctacagtgaaacctaagattatcatttataaaaaagatgagaaactacatagtttgtagtaaaaaccccatttaaaaacagaagaatagcatctgtattttattaaatgtctccaagaataataaatgcattctacacagtttttccaaaagagagacagtatcagaaaaaaaaaaaaaagaataagcattaagttggctttattaactctctcgcataaggtttcactcaccaaaatctctttcttaatttttatcatttatccaggtcatcttctaagtccaaagaagctggcatttttagggcttggatttcaaggtagcagcccagcagccaaatcaaaattctaaaaacaaacaacaacaacaacaacaaaaagagagagagagataaaataaaaccacagtattatatagaaattaaagatttctttaatttcataacctatcttttcaacaaaagtcaatgtaaatatcacaagttatcaagtcagcattggcatctttagagaatgttaaaacagggttttcattaagtctacaaagattatcttttctgatttttttttttttttttttttgagacagggtctcactctgtcacccaggctggagtgcagtaacagatcatagctcactgcagctcaacctcctaggctcaagcaatcctcccacctcaggctcccaagtagctgggaccacaggcgcatgccaccacatctggataatttttttgtattttttttggtagagatggggtttcaccatgttgcccaggctagtcttgaacttctgggctcaagcgatccacccgcctgagcctcccaaagtgctgagattacaagcatgagccactgcccccagccttttttgagattttaggccactcatcagcaagcattcaaagattgtagaagcaaaactcacagacttatacaagcatcacttaagaatcataaaactgtcactttaagccttagagccctctctataccttcattcttaattctgtccagattaattaacatcaggtcacactatctgcatatgcttagagcccaaaacaaaatattttgtacacatacaaaatacaagacccgcttttctaacaggatttcaaatttagctttttaaacttgacaaagttttaggtgtaagtttttttcctattttatccataatatctatacattatatttttcattaaattttcagtttaagtcttgaaatatttactgtagatataaaacttatgcatggaacttgcatggtggtgcatgccggtggtcccagctattcaggtgactaaagcaggaggatcacttgaggtcaagagtttgaggttacagtgagctatgatcatgccactgcaatccagtctgggcaagaaagctagatcctgtctctaaaaaaaataataataaagccataagagaaaagattgataagttcaaatgcaaaaaaaaatcaattctgcaaagcaaaaaacattgtaagtcaaaaaaacaacaaactaagaaaaaaatacttgcaatcatatcagtgataaaagaacaaatctccctatatagaatgatatagaaaaaaatatgcataggtatgtgtatgtatatgtgcttatacaggcacataaaataaaaagatcaatttggacaaatgtataaaaatggacacagaatatgatcagaaaattcacagaaaaagaaatacaaacgaacattcaacatatgaaaagatgtttaccctcacacaaaagaagcaaaaaacaatttttcactcatcagattagcaaaactccaaaaatttgataatttactgttcccagcaaggttatggtgaaacaggcactcttattcattgctggcggtagtgcaaattggtacaccagcaattaagtaatgtctttcaaaatcacaattacaagctgggtgtgctggcacacacctgtaatcctgggtacttgagaggctaagacaggaggactacttgaggccaggagttcaaggctgtggtgagctataatagcatctgtaaatagccactgcactcaagtctgggcaacacagtgaaacttcatctcttaaaaaaaattacaattgcataaactattaacctagcaattccacttctggatagcaatcctacagatacacttatcatcatataagatgacgtatgtatagtgttatgcactacagcactgcttgtaatagaaaagttaggaaattacccagatgtccatcaatgggactgatttaaattatagaacatccttaaaaatgaaatgcaaaaaaaaagaaacacagcaagaaggaaaatgctgtctgtgtactgacacaaaaagatctccaagatatatttttgagagaaaaaaaacagagtaaaccattgagtaccttgtgctactttttttggggaaaggggagaaaaaatattttatacatgctagtgctaaaatactctagaaagaaatataagaccaataaaaatggttatcttacaaggtgaatttaaaaaatgatgttataccagagggaaggaagcactcacactaatgaggagtgtgttacaagaacacaggagccagttttaagggttttccactgggcaaatttgagacaatttgagtaccaaaagagaataattactaaaattgatatcatgaataagaatccatgaatctccagcaataactcagagagtgaaaaactttaaaaaaaaacacttcttcccatcattggaggtaactatgacattaatgacttattctgaagattgataattaaagagaaagaaataagcaatttacagcctttttagaagggttcatcctcggtagagcggcaaagctctcttacagaagactaccagttaataaatgtagaagcaaagaaagaatttcaaaatcaccattttgcaaccccaaatgaaataaatgattcaggcaaggacgatcacaggttgctaaaaatcatttttgcatgatcgaaaattgttggaaaacaggttaccacagtgccaaaggatcattccagagattacttccgaattgcaaaggggaaaaactgagtaccattataatgggaagatgtgacagtcaccagcttaacctagtgatcaaactcagcaacaatcagagtgagactcttcatttatgcctcttgatgtgatgtaactttaaatacacagactaagttatgatgtattattaccaaaagtgcctaacctaggtctaaacaagtcttcaacgtaatttctccttcacaggaattcaagagatagagcaacaagaaaaatcacaagaaaacgtaatctgacagaactagaatatggaacttgctacaataaaactggtctggtctcttcaaaaagccaaaatcttgggggaaaaaataggggaaggatagagttctagattaaaagagactgaaagtcacaacaaccaactgcaatgcagaaatgttactcagatctggtttgaagaaaacagtttgaaataattttttaggcagctgggggaaactgaatgtgaactgagtagaaggtattagggcattatttttaattttcttgggtgtggtaatgttatttgtaattaggtagagaatgttctttattcttagaagatgcatgctaaagcacagggttataaagtgtcattatgtctgcagcttgttttcaaattattcaacaaaggtagatattacaaatatggcaaaatgttaacacttgtttaaactacatggtcttcatggtattattgtttcaacttttctatatgtttgaatttttttttttttttttttttttttgagacagagtcttgctctgtcacctaggctagagtgcggtggcatgatcacagctcacagcagcttcaaactcctgggctcaagtaacctcccacctcagccccagagtagctgggactacaggtgcacaaccaccatgcccagctaattttttgattatttgtagagatagggtctccctatgttgcccaggcttatctcaaactcctaggctcaagcaatcctcctgcctcggcctcccaaagtgctgggattataggtgtgagccaccgcacccgacctgaaatatttcatattaaaaaagttagaaccaggtatagcggctcatgcttgtaatcccatcactctgggggtgctgaggagggcagattgcttgagcccaggagtttgagatcagcctgggcaacatggtgaaatcctgcctctacaaaaaaatacaaaaaattagctaggtgtggtagtgtgtgcctgtagtcccagctactcagaaggctgaggtgagagaatcacttgagcccgggaggcagagattacagcgagctgtgattgtgccactgagctccagcctgagcctataagttcgagaccagcccaggcaacacagtgagatattgtttcaactaaaaaaaataaataaaaaattgactgggttttgtagctactcaggagactgaattgggaggatcacttgagctgaggagactgaggctgcagtgtgccatgatcagcattccagcatgccggaattccactgctttccagcctgggcaaaaaagctagcatcccgtctcaaattaaaaaaaaaaaaggttggaagaaaaagaccataaaggtccatgggagctgagggtgagatcgagacttctcactatgtatctttttgaataatgtttttcttttgaaccatgtgaatatattacctattgaaaacaaaagttagctataaataaaacctcttaaacgcttagtatcaatatttctactcttaccccatctcagatatgcaacaacaaaaatgtctcctgctttttatctccttttttgaagggggctcctctggctacatttccccacgagtcatttgactcatgataagaacctggaccatcagccagcatggccaaggagtaattgtgccacctcttcccaaagcccaggcagcacagctcacagctccgggaaagactccttccctctgcttgaggagaggagagggaagagtaaaagaggattttgtcttgcaacttggataccagctcagccacagtaggagagggcagagtcctgaagtccccattctagaccctagctcctggatgacatttctagacataccctgggccagaagggaacccactgccttgaaaggaaggactcagccctggcagcattcatcacctgctgattaaagacccatgaggccccaaataatcagcactgatagccaggtggtatttgctgtggggccatgagtgagactgagacatgctgtcttcaagcatgacccagcacattcccagctgtggtggctacagggagagactccttctgcttgagaaaagaaagaggagtaaaggggccgggtatggtggttcatgcctataatcccagcactttgggaggccgaggtgggtagatcacctaaggtcaggagtcccagaccagcctggccaacatggtaaaaccccatctctactaaaaatgcaaaaattagctgggcgtggtggtgcatgcctgtagtcccagccactcgggaggctgagacagaagaactgcttgaacctgaacctgggaggcggcagctgcagtgagccaagatcacaccattgtactccagcctgggagacagagcttccagcttaggtaccagagacactaagctacaagacaaagttccctttactatttgggctatgtagagcactaagcaggctctcggggtccccaattccaggccttggttcttggatggcattttcattcttttttcttttgtttcctctgactgcatattttcaaagaggctctgggcctgccctgggccagacaagagcccactgtcctgaagggagagtcctaggcctggcagcattcatcacaacctaactcaagagccttcgggccttgagtgaacactggcagtagccaggtggtgcttgccacaggtctggggtggtggcggccgtagggaaagatgcctctgtttgcagaaagaggacgaaaaaacgggaaggactttgtcttgttacttgggtgccagctcagctgcagcagaacaaagcactagatagattcctaaggtttctgacttcaggccctggcttccgaacatctctggacccacccagggctggagagaacttgctgccctgaagggaaggacacagcatggctggctttgccacttgctgactgtaaagccctagggccttgagtgaagaacacaggtgatagccaggtggtagttactacaggccttgggcgagagacccagtgctgtgctggctttaggtctgacccagtgtagtttcagtggtggggtggccacaggggtgcttgtgtaacctctcccctagctccaggtagctcagcatagacggacaaattccagttgtttgggagagagtaagaggagagaacaagagtctctccctggtaatccagagaattattctggattttacctaaaaccaccaaggtggtacctctatgagtctgcaagagccacagttttactacacttggggtgccacctaatgtagatacaaatgcagtgacaagagacctggatcacaacactcaagtccctttgaatactcggaaagccttcgcaagaaagatgggtaaaaacaagcccagactgtaaagactataataaatacctaactctccaatgcctagacaccaacaaacatccacaaacatcaaggtaatccaagaaaacatgacctcaccaaatgaactaaatatggtaccagagactaattccagagagacagagatatgtgacctttcagacagagaattcaaaacagctgttttgaggaaactcaatgaaattcaagatagctcacagaaggaattcagaatcctatcagataaatttaacaaagggactgaaataattaaaaaaatcaagcagaaattctggattgaaaatgcaactgacatactaaagaatgcatcagtctcttaccagcagaattgatcaagaagaagaaaaaaatggtgagcttgaagacagcctctttgaaaatacaaagtcagaggagacaaaagaatgaagcacatctacaagatctattaacagaaaatagcctcaaaagggcaaatctaagagttactggccttaaagaggaggtagagtgaaagagaggggcagaaagtttattcaaatgaataataacagagaatttcccaaacctagagaaagatatcaatattcaagtataagaaagttatagaacacaagccagtttaacccaaagagtactacttcaagacatttaataaccaaactcccaaaggtcaacgataaagaaaggatcctaaaagcagcaagacaatagaaacaaataacaattttaaaaaatacaatggaactccaatacatctggcagcagacgttttagtggaaaccctataggccaggagagagtggtatgacatattccaagtgcgaaaggaaaaaaaatttaccctagaatagtatatccagtgaaaatatcctacaaacatgaaggagaaataaagactttcccaaacaaaagctgagggatttcatcaacatcagacctgtcctacaagaaacgctaaagggaattcttcaatctgaaagcaaaggacgttaatgagcaataaaaatcatctgaagatacaaaactcactggtaatagtaagtacacagacaaacacagaatattataacactgtaattgtagtgtataaactactcatatctcaagtagaaagactaagagaccaattaaaaataataactacatcaacttttccagacagtacaataagataaaaatacaaacaaaaagtttaaaagtggggggaacaaagttagtatgtagagtttttattagttttctctttgtttatgcaatcagtgttgttatcagtttaaaataatggttatgagatattatttgcaaccctcatgataaactcaaataaaaaaatacaacagataagaaataaaaagtaaattaaaacataccactagagaaaatcaccttcactaaaagaaagacaggaaggaagggaagaaggaaaagaagaccacaaaacaaccagaaaaccaataacaaaacggcaggaataagtccttacttattaatactaacattgaatgttaatggactaaattctccaatgaaaagacacagaaagtggctgaatgaacaacaacaacagaaaacaagacccaatgatctgttgactacaagaaacacacttcacctacaaagacgcatacagactgaaaacaaagggatggaaaccaaaaaagagcaggagtagctatacttagatcagacaaaatggatttcaagacaaaactataaaaaagagacaaagaaggttattatataatgataaaggggtcaattcagcaagaagatgtaacaattataaatataaatgaacacaatcctggagcacccagatatataaagtaaatattattagagccaaagagaaagacagaccccaatacagtaagagctggagattttaacatcccattttcagcactggacagatgatctagacagaaaatcaaccaagaaaaatcagatgtaatctgcactacagactacatgaacttaataagatatttacagaacatttaatccaatggctgcagaatccacattcttctcctcagcacatggatcattctcaaggacagaccatatgttaggctacaaaacaagtattaaaattttttttaattgaaataacatcaagtatcttctatgaccacaataaaactaaaaatcaataacaagtgaaattttggaaactatacaaacacatggaaattaaacactatgctcctcaatgaccagtgggtccatgaggaaattaaggaggaaattggaaaatttcttgaaataaattataatgaaaacacaacataccaaaacctgtgagatacagtgaaagcaggactaagagggaagtttatggctataggcatttacattaaaaaagtagaaaaatttcaaataaacaacctaacaatgtatcttaaagaattagaaaagcaagagcaaaccaaactcaaaattagtagaagaaaagaaataaagatgagagcagaaataaatgaaattgaaagaatacacaagatcagtgaaatgaaaagctgcctttttgaaaagataaacaaaattgacaacctttaaccagactaacaaaaaaagagagaagacccaaataaataaaatcagagatgaaaaaggagacattacaactgatacttcagaaattcaaaggatcgttagaggctactataagcaactatatgccaataaattggaaaacctagaagaaacaaattcttagacacatacaatctaccaagattaaccatgaaaaaatccaaaacctgaacagaccagtaacaagtaacaagatcaggtgaaaccctgtctctactaaaaatacaaaaattagccaggcatggtggcacgtgcctacagtcctatctactcgggaggctgaggcaggagaatcacttgaacccaggaggtggaggttgcaatgagccgagattgcatcaatgcactccagcctcggcgacagagactccatctcaaaaacaaaacaaaacaaaacaaaaaacaagatcaaagccataagtaaaagccacaataaaaaagaagcctgggatccaatggcttcactgctgaattctaccaaacatttaaggaagaactaattccaatcctactcgacctattccaaaaaatagtgaagagaatagttccaaactcattctacaaggccaatattaccctgataccaaaagcaaagaaacatcaaaaaaagatgatagacacagtgataaacactaatgcaaaaatcctcaacaaaatactgacaaatcaaattaaacaacacattaaaaaatcattcataggctgggtgcggtggctcacgcctataatcccagtactttgggaggccaaggcaggcagatcacctgagttcaggagttcaagaccagcctggccaacatggagaaacctcatctccactaaaaatacaaaattagcccaggcacagtagctcacacctgtaatcccagcactttgggaggccgaggcagtcggatcacgaggttaggagatcgagaccatcctggtcaacatgggtgaaagcccgtctctactaaaaatacaaaaattagctgggcgtggtggcgcatgcctgtaatcccagctacctggcaggctgaggcagaagaatcacttcaaccagggagtcggaagttgcagtgagccgagattgcaccactgcactccagcctggcaacagagcaagactccgtctcaaaaaaaagaaaaaaaaaattggtgaaaatataaaaacgaaataatactatgatcatatattggttacatattaaaatatatcagttcatgaactgttcgaaacaactaagcaaaatataggtttaattatataattacattattttaaaatttttgcaagtcaaaatgcacatgaactgaaaggcaaaatgcaagttgagagttacacatttttgtttgttttagttttttgagtcagggtctcaccctgctgcccaggctaaaggacagtggcacaattcccagctcaatgcagccaagtgatcctcccacttcagcctcccgagtagatggacccaagtgatcctcccacctcagcctccaccatgcccggctaattttcgtattttttgtagagacagggttttatcatgttgcccaggctggtttccaactcctgggctcaagtgatccacccacctcagcctccaaaagtgctgggattacaagcatgagccaccatgcccagcgatttataaaattagaaatgaaaataatcaatgatcaaaaagcttgctacacttcgtaagtaatcaaagaaaaacaggtcaggcatgatggctcacacctgtaatctcagaactttggaatgccaaggcgactgcatcacttgaggtcaggagttcaagaccagcctggacaacatggtaaaacctcgtctttactaaaaatacaaaaattagcagggtgtggtggcctgcacctgtaatcccagctgctcgggagactgaggcaggagaatcacatgaactcagaggcagaggttgcagtgagccaatacggcaccactgtactccagcctgggtgacagagcaagacttggtctaaaaaaaaaaagaaaaaaaaaacaaaaaaacaaagtgaaatgtgtcttttttcatcaaactggaagatttaaaaataaaataattgtggcaatgtacaatgaaatagattaacatttacattttgcttaaatataagcaaatagaattatccttaacatcttaaccataagcttaacaatctaggaatctaacctaatgaaataactgattttgtggtcaaagatttatattcaaagaagttcatcactgacgggtgcagaggctcacacttgtaaccccagcactttaggaggctgaggcaggcggatcacttgaggtcaggagttcgagagaccaacctggccaacatcatgaaaccccgtctctacccaaaatacaaaaaattagctgggtgtggtggcacacacctgtaatcccacctactaggaggctgaggcaggagaaatgcctgaacccgggaggtggaggttgcgccactgcactccagcctgggtgacagggagaaacaccgtttaaaaaaaaaaacaaaaaaccgtcatcacagcttagacaacacagtgagattccatctctacaaaaataaaatttaggccaagcgtggtggctcatgccttaatcccagcactttgggaggctgaggcaggcagatcacctgaggtcgggagttggagaccagtctgaccaatatggtgaaacgccatcactactaaaaatacaaaaattagccgggcgtggtgacaggtgcctgtagtcccagctattcaggaggctaaggcaggagaatcatttgaatccaggaggtggaggttgcagtaagccgagatcacgccactgcactccagcctgggtgacagagggagaccttgtcataaataaataaataaataaataagcaagctgggtgtggtggcacacctgtggtctcagctactcaataggctgaggtgggaggattgcttggacctgggaggttgaggctgcagtgagccatgactgcatcactgtactccagcatgggtaacagagtgagaccctgtctcaaaaaaaaaaaaaaaaagttcatcaaaatattctgttgatggttcaacaacagaagtggttaaacaatttaaatatactcaaatattgcttcccattgagactaatgtttttgagaatatttaacatcatgagcaatatttatattttaaatataaaatatataaaacatgttacttccgctttctttttcaaaaaaattattttaatcacacataactgtatatatacatggggtacagtataatattttgatacatgtatacaatgtgtaataatcaaatcagagtaattaattagcacatccatcacctcatttattatttgtgttgggaacattcaaaatcctctcttctagctatttgaaaatatacaataaattatttttatctatagtcatcctacagtgctagagaacactagaacgtattcgtcctatccagctataattttgtatccattaaccagtctctttttatccttcccctgctcttcccagactctagtaacctctgttctactctctatttcttataccctttttttttttttttaagacagtctcattctgtcacccaggctagaatgcagtggtacaatctcaccttactgcaacctctgcctcctggtttcaagcaattcttgtgcctcagtctccctagcagctggattttcaggcgcgcactaccacgcccagctaattttcttgtatatttttagtagagatgaggttttgccatattgcccaggctgatctcaaactcctgggctcaagcaatccacccacctgggcctctcaaagtgctaggattacaggtgtgatccaccacacctggcctattctacgatctacttctattgtgatcaacttttttaccttccacatataagaacatatggcatttatctttctgtgcctggcttatttcacttaacataatgtcctccaggctgatgcatgttgctacaaatgacaagatttcattcttttatggtatatataccacattttctttatctagtcatgtactgatggacacaagttgattatcttggctattgtgaatagtgctgcaataaacatgagaatgtagatgtctctttgacatactgatttcctttcctttgaatatatacctattagtgggattgctggatcatatggtagttctcttcttagcttttttttttttttgagacggagtcttactctggtgcccaggccccagactagtatgcagtggtatgatctcggctcactgcaacctccaactcccaggttcaagagattctcctgcctcagcctccctagtactgggattacaggcgcacaccattgtacccagctaatttttgtatttttagtagagacagggtttcaccatagtagcctggctagtctcgaactcctgaccttgtgatccacccgcctcagcctcccaaagtgctgggattacaggcgtgagccactgcgcccagccctctttttggcttttcaaggaacctccataactattttccataatggctgtactaatttacattccaatcaacagtatataatagttgccttttctccatctttttggtaatagccactattttaactggggtgaaataatatctcattgtggttttgatttgcatttcttgatgactagtaatgttaagcagattttcatatacttgctgacaattttacattttctttggagaaatgtctattcagatcaagtacccaatttttaaagtcagactgtttttctactgttgaaacatttcagttccttctttattccagatattaatcccttgtcacatgaatagtctgcaaatattttctcccattctgcaggttatctcctcactgtttcctttgctgtgcagaagctttcttaactggatataatcctatttgccagcttttgtttttgttgcctgtgcttttaaggtcttatctataaaacctttgcacagaccaatgtcctgaagtgtttcctctatgttttcttttagtggtttcatagtttcaggtcttacatttaagtctttagctcattttgagttgatttttgtatatggtgagagataggggtctagtttcattcttctccatgtggatatccagttttctcagcatatgcattgaagagactgtctttttatcaatgtatgttttgggcgtctctgttgaaaatcagttggctgtaaacgtgtggatttatttctgggttctctatggtgtttcattggtctatgtgtctgtttttatgccagtgccatgctgttttggttacaatagttttgtatactttcaagtcaagaagtgtactgcctccagctttgctctttttgctcaggattgctttggctactcaaggtcttttgtggtgcctgccatacaaattttaggattgttttttctaaagaagtctgtggtagacagacttgtaaaatggccaccaattactccagcctcctggtgttcatgcctttgtgtaatctcttcctcctgagtatggactggcctggtgatttgcttctaactaacggactatggaaaatgtgataggatgccactccatgattataaaaaattgtgatttccatcttcctaggagacttgctattcctttctcagctttgtgatgttgaagaagctacatggaaaggaattcagagcaacctccagccatcagccagtgagaaaccaagcccttcaattcaacatcccttcaagaagagaattctgtcaccaaccaagttagtttggaaacagattattccccagccaagcgctaagatgagacaccagccctggctgacaccttgactacctcctgtgagagaccctgaaacagaagacccatctaggctatgccgattcctgacccatggaaacccatgccataataaaaatgtatgttgttttaaactactaaatttgtggtaatctgttatgcaacaataaataactattgtaccctacatggaaatcctgctgaataaactgcctggcaatttccttttttattttttgagatggagtctcgctctgtcgctcaggctggagcacagtggtgcaatctcagctcactgcaagctccgcctcctgggttcacaccattctcctgcctcagcctcccaagtggctgggactacaggtgcctgccactagtcctggctaattttttgtatttttaatagagacggggtttcaccgtgttagccaggatggtctcgatctcctgacctcatgatccgccctcctcggcctcccaaagtgctgggattacaggcatgagccaccgtgcccggcctttttttttagtttttgtttttttgtagaaacagtatcttgctggcggggcctggtggctcatgcctgtaatcccagcactttgggaggccgaggagggtggatcacatgaagtcgggagtttgagatcaccttggccaacatggtgaaaccctgtctctactaaaaacacaaaaattagctgggtgtggtggcaggcgcctgtagttccagctactcaggaggctgaggcacgagaatcgcttgaacccaggaggcggaggttgcagtgagccaagatggtgccactgcactgcagcctggtaacagagcgagattccgtctcaaaaagaaaaaaaaaaaagaaacagtgtcttgctatgttgcccaggctgatctccaactcctggcctcaaacggtcctcctgccctaccttccctggaactctgcccagccaggattcttaaatcaaatcacagtgctggaactgtgcccagccaggattcttaaatcaaaatatttttccctctatttataaatatttatccaaatatttatggggggaaaaaagtcacaggtcacacagtggccagttctgctttagctagcagtggttcccaaacttgtctgtgctttttttttttttttttttgagtcggagtttcgctcttgttgctcaggctggagtgcaatggtgcgatcttggctcactgcaacctctgcctcccggattcaagcgattctcctgcctcagcctcccgagtatctgggagtaaaggcatgaaccaccacgcctggctaattttgtatttttagtagagacagggcttctctatgttggtcagcctggtcttgaacccctgacctcaggtgatccgcctgcctcgacctcccgaagtgctgggattacaggcgtgagccacagtgcccagccttgtctgcactttagatcttcttgagatcttttaaaaattccaaagtccaggccatactcccagggcaatcaaatcacaatctgctggggaagggaaagggacaatggcatcagttgtccaagctccacaggtgatttcaatgtgaagacaggtttgggaaatcactgagctaaagttttatctgtgtgatcaagaaaaagctaattcaagatgacagagagagaggcagctgaatgaaactaactatatacacctgcccttctctgagatcgtaaggtagccttgatttccccctgcaaagttatgaattctgaaaatatcagagagaaggccaaataaatgcttattttgctttttggatttatccatgcctccattcgcctccagaattatgaacaagtgagaaattcacctttttgtcttttcttggtacttttcatggaaccaataaagaattctgccatattacatgtattcaacataactaataagacatgacttgaatgcttttttattaagcagatcttatttaatttagtcagttttgatccaacccacatgccaaatgcagcttgccaaagtaaaataccctatggacattaggatcaaaatgcctcctttttaaaaagtaaagtctatttataatccaatcctttaagttgaaattaggccttttataaattgaatttcatgtattctacagaatcaacagacctgcttaagaactctctgaccactctcagaaaagttagtcagtgggacccctctccattcctcccaggacctaaacaaaaaagaaaaagggcaagaggaagaagagaaacatcagaagaaaagactacatataaacccttataaacctattcaaaataaatttttgtgattggccaaattccttctctctaccactgtttctgctaattttactctagaaagagttgtaaaaggccaggtgctgtggctcacgcctgtaatcccagcactttgagaagccaaggtgggtggatcacctgaggtaaggagttcgaaaccaacctgaccaacatggcaaaaccccatctctactaaaaataaaaaaaattagccaggcatggtggcgcactcctgtagtcacagccactcgggaggctgaggcaggagaatcacttgaacctgggaggcagaggttgcagtgagtggagattgcaccactgcactccagcctgggtgacagagctagactgtctcaaaaaaaaagagttgtaaaagacagatgacctatctacaatttctagtccagtggcttttattaaggaaagcttataatcatcaaagaggctcaatatacttttgaaataccacagtagtggttacacaagtgtgttaattttataattcattaaccttataatttgtgtgcttttctttgtatgttacacatcaattaacacatttttacaatagatacatttgtcctgggcagaatctctgaaagattctaagtaagcaggtatcagaaatagtcaaggttacatgatttgtcctaggtcacagatatagttagctacaaatgaagtccttcatatcactttcctactctttctgttataaattgtaaatatgttgatattattatactttttaatttaacattactttcctacttaagactatgaaaaaaataagtattacaagtgagaactgcaaaaaacaagcaaacaagtaaatagaaaacacatgtcctgggttcataactgtgcactattgaagctattgtaccatccatatgaggaaattaaataaagcctaacgcccatgcaaccattttttttctttttttttttttgtttgtttttgagacggagtctcgctctgtcacccaggctggagtgcagtggtgcaatctcggctcactgcaagctccgcctcccgggttcacgccattctcctgcctcagcctcccgagtagctgggactacaggcgcccgccaccatgcccagctaatttttttgtatttttagaagagtcgcggtttcaccgtggtctcgatctcctgaccttgtgatctgcccaccttggcctcccaaagtgctgggattacaggtgtgagccaccgtgcccggactctgtgcaaccatttcttaacctcaatatcctttttcaaatgctttcaatgtagacatatgtcaaactattagtagtaaaatcaactgtgtacctattcagatagactagcattatttttgatatgaaaatatagggtgatagaacggaaaaagggctaggctgagcattgcagagtgggttttagtcatggctgtcccataaagttgttttatgatttagggcaagacataaatctctctggtctaagagtattaaaatgagaggatgaacaccagagctaggactaaacagaatctcaggttccttccaggtttaagaaaactcaaggactatttaacaacaacaacaacaacgtgtatatatatatatatatatatatatatatatatatgctttcaaaatgcattttacaaatgattatctctattcaaatatgtttaaagtagctttgtaaaataaaaatactagaattcctctggcacctgcttcataaatacaagcatattcttcagcttgtatcaaatgcaaacctctgatctgttgtctaggtgcaacaacctctccctctcagttggctaataataacattgttgattctttatcatcatgagactcttttgcctgcatttaaaaaacttcattttatgaatcaatttcagatttacagaacatgagttatttttatgagaaatatgtatctctcaatatgtaacagaagtctttcttaatttctaataatctactgtaatttgaaaactttccatggatgcatttatttgactaccctttaccaactgcctactagcactctgctaggcactttcctgctcctgaagttactatacaagaacaaaaagactgtggaatggttaattgaaacaacattatttcatgaatgcctccatctgaatattacacttatagtatttaaaaaattaagttggccttgtaaccacacaaccttaaatgtttcaggataacttataagacattgttaaagtgtctaaataaacagttaaatgctcactgttaaagacaatttgcctaggcataactattataagatccaatttcatcctccctataccctttcatgaggtccttataaaactatttcatggtggccgggcacggtggctcatgcctgtaatcccagcactttgggaggccgaggtgggaggatcacaaggtcaagagatcaagaccagcctggccaacatggtgaaaccctgtacctactaaaaatacaaaaaaaaaattagctgggcgtggtggcatgtgcctgtagtcccagctacttgggaggctgaggcatgagaatctcttgaaccagggaggaagaggttgcagtgagctgagattgcgccactgcactccagtgtggcgacagatggagactctgtcttaaaaaaaaaaaaaacaacaacaaaaaaactatttcatgcttattctcagatctggggctcccaagggaaaatttgtgcagctctccagccaaatcagagaaacttaatgctctgaaaggatcaacaaaatgcctgtcaaggtgattggcatttcaatacaacaaccctggtttgctcttggtagggataatagacaatttaagggattaggaaatattaacattaatttttaaacttcaatcctaacttcttagtataagaaacaaaagataaattagtaaaacatgaaacttgagatttccaaaaccactcatcccaacacatattataaacatattataaaccgtaagtcagaggctcagtgagatttttcccacgttgttacataaaaaaaacaaagaaataaatctgtgcccaaattgcaacaaagagaaaaaaaattacaaatgaataatacaaaaacagaaataaaatctagaagaggtcaggcgtggtagctcacgcctgtaatcccagcaccttgggaggccaaggcaggaggactgcttgagcctacgagtttgagaccaccctgggcaacatagggagaccccacttctacaaaaaaaatttaaaaattacggccggtcacagtgactcatgcctataatcccagcacactgggaggctgaggtgggtagaccacctataatgaggtcaggagttggaggccagcctggccaacatggtgaaaccctgtctctattaaaaatataaaattagctgggaatggtggaacacccctataatcccagctactagggaggctgaggcaggagaattgcttgaacccgggaggaggaggttgcagtgagtcgagatcacgccattgcactccagcctgggagacaagagtgaaacactgtctcagaaaaaaaaaaaacaaaaaaataggctgggtgcagtggttcacgcctgtattcccagcactttgggaggccgaggagggtggatcactttaggtcaggagttcgagaccatcttggccaacatggtgaaaccctgtctctactgaaaatataaaaattagccaggcatggtggcgggcacctgtaatcccagctacctgggaggctgaggcaggagaaacgcttgaacccacggggcagaggctgcagtaagctgagactgcaccactgtattccagtctgggcaacagagtgaaactctgtcttaaaaaaaaaaaaaaaaggtcattttggagacaactggagaaacttacagacttaatgttagataatattaagaaattactgttttgttaggtgttaataatggtattgtgtttatgtagaagaatatccttacttgcaggtgatgtgtgctaaaatattaaaggcatagtatcatgatatctttatttttaaaaagtttaacataataaacatattattaaacatatgacaacatgttgaatatagatggtgagtataagggtggttcactgtactattattcctggggctttttctatgttttaaagttttaataaaacatttaaaatatcaaaaaaagcccacaaaactgaagaactgctattatactagaagaaaaaatttatgaaattcaattttaactagtagctagtggcactataaactggtagttgttctgaagaataatctgacaatgtggctaaaaagtgatagcctcagacctaatgaaatcattttagggaatatattctaagaaaaaaactggaagaaaaaagatttataaaaagatgtaacagcgctacaatttagaattgtaaaatagggctgggcatggtggctcactcctgtaatcccagcactttgggaggctgaggcgggcagatcacgaggtcaggagttcgagaccagcctggtcaacacggtgaaatcccatgaaatacaaaatcccgtgaaaatacaaaaattagccaggcatggtggcgcatgcctgtaatcctagctactcaggaggctgaggtaggagaactgcttgaacctgggaggtggaggttgcagtgagctgagatcacgccactacactccagcctgggtgacagagtaagactccatcttggggaaaaaaaaaattgtaaaatataaataaaaacgaactgaaaatcacccaaatgccaaataaccagagtattttagactttggttgtcatatatccattaaaaatgataaatatacagatgtgtagaaaagtacgtcaatatattgccaaatgaaaaaagactaaaaaaacctttatatgaattaaatttgtaaagactgtatgaatatgaaaatgactcagaagttatgtacttgcggtatttaaacataatttttttttgttttttgagacggagtctcactcttgtcacccaggctggagtgctacggcatgatcttggctcaccgcaacctctgcctcccaggttcaagcaattttcctgcctgagcctcccaagtagctgggattacaggcgcacgccaccacgccaggctaatttttgtatttttaggagagacggggtttcaccatgttggccaggctggtcacgaactcctaacctcaggtgatccacccgccttggccttgcaaagtgctggaattacaggtgtgagccacagtgtacagccttaaacataatttttaaaatttcatggggacacgtgctattagaaaaagtataaacaatgcaaatataaaatcaggaagaactgcctgggcacaaataaagaaagcacctgagggctattactgaccacaattcaaatgagtattcacaatttaaatacagtactatcctgggcaaggccaacattgctaccattaaaaagacacaggctgagcacagtggcacacgcctgtaatcccagcattttgggaggcaagagtatcgcttaaacccaggaggttgagactggcctgggcaacataggaagacccattctctaccccaaaaaaaaaaaaagccaggtgaggtggtgaacacctgtagtcccacgtgttcactcaggagactgaggtaagaggatcgcttgagcctgggaggttgaggcagcagtgagccatgatcacaccactgcactccagcctgggtgacaaagcgagactctattttttttttaaataataatttaaaaataaaaagacacagaaaaagagcatatcattagcctggacagtacccagtcttcctcaattctatttgttattttaaaacaatactcagttttcctcaattctttccaatatttttttaaattatggaaaaactgaagaagtttcaaagaaaaaccaagaggtaaagaataggatggaaaagaggtaattttgaagaatggtttgaaatcaaatgaagtgtgacatgactattaacactgaaatatccatggggaggcttttgaatggagaccctgaaaagctgatgtatctctcaatgcccacagatgactcaccaagaagagagggctaacaaaaccctcaaagtttgttgttttacagaagagagatttctttattgtgctggcaaaagttactggcataggaaaatgagggaggctgggtgtgttgtcattgaccatctgtttttctacagggtgtttacttatccatgatcacctgatcatattagaatgtctctaaaacttgactcagttactcaaagcttgaatcaattatctaccatttcaaaattccgcagtgccatcctgctcccacacactggtcactcagcaacattcaaatgtcttagacctggcatccagggccccaagaaagtacgtcggcttcacttctccacaactcctcaacaaaccagcaaatcagacttctcactatttcattacctaaatattccttacattttcctatgtccatcattcctttggttactctctccttaatcccatttgttgcaatcttacccttccattttaataaattttaatttaatgcctctatgttatctcaaacactacctgttatgtgttgacttgtgccccccaatcccatccctgccaaatatgttagtcttaactctcagtacctcagaatgtgacctgatttggaaacagagtcgctgcagaggtaatcaattaagatgaagttactcctactggagtagggtgggacctactagtgaccttataagggaaatttggacacagagacatacagggaaaacgccatgtgacaacagaggcaaagatggagtgatgcagctacaagccaaggagcaccaagaattgatggaaggctcagcctctcaagtaggtgcgattagatgcacatgccagcacgcctggctaatttttgtacttttagtagagatggggttttaccatgttggccaggctggtctcaaactcctgaactcaagtgatccacccaccttggcctcctaaagtgttgggattacaggtatgagccagctatttgggaggctgaggcaggagaatcacttgaacctgggaggcagaggttgcagtgagccaagtttgcaccactgcactccagcctgggcaagggagtgagatgctgtctccaaaaacaaacaaacaaacaaacaaacaaaaaagagcagctgggtgcagtggctcacacctgtaatcccagcactttgggaggccgaggcaggtggatcacctaaggtcaggagttcgagaccagcctgaccaatatggtcaaaccccatctctactaaaactacaaaaaaattagctgggcgtggtggcagttgcctgtagtcccagctactcaggaggttgagacaggagaatcacttgaacccaggaggcggaggttgcaatgagccaagatctcaccactgcactccagcctgggcaacagagtgagactccatcacacacacacacaaaaaagcaaaagcaaaagcaaaagaaaatgtatataaatgggtactacggaactgatattcaacagattcaatatcagtaaaggagctgattaatgggaacttttgttgcctttgtgtgtgtgacggagggggaggggttgcagctggttaatgctaaatacaaactgaaatatctgtttaaagtatgaatgccctctgaatttggtgctcattaatattaactgatatagttaatttattaactgataatgaatattataactgacatagaatacacaattcatcacaaagtaaaggtatggtcctggccttctgctttatagagattgtatatcaaataaagcatatgaccaactctagggctgcattcctccttccatcaaagccatagtatttcatttgtgtatacatctaaatgtaactctagttatttactaattaactcagaatgtttattgagctcctaggcagctactttatgtcctttttagaataaggtgaggtagaaaaagatcacatttaaaaaaataaatgaatataccagacatcaaaataggcagacactggagctgaagggagggaagggggaaggcagagacagacaccagcccagtcctaaaggagcactcacccaatctagtgagaagtaagagagtaaactagctccatatctctcctttctccccatgctgatcctacacttcacaatcaggcttcctttcctaacgtacagctttcatcacatcactggcgaaaaacatttgatgacttcccactacctagtcaatcaagttcaaacttcccagcttggaatagaaatgggtattcaaagccttccatgatttgattatatggtatgcagagattaggaaggcaggctttgaaattagactacctggactcaaatactttctgtatcaattgttagctctcttcttcattttatatgtaaaaagggattaaaaaccagtgcctacctcatcaggttgttgtaaggattaaataaaatgctacttatgaaatacttagcacattatcttgcaaatagtaagcatgcaaaaaatgtgagccattggccaggcatatggcttgtgcctataatcctagcaatttgggagaccaaggcaggagatcacttgagcccaggaattaaagactgcaatgagttataatcacgccactgcactccagcctgggcaacagagtaagaccctggttctatttaaaaacaaaacaaaacaaaacaaaaaaaccctacccaaagaacactggggggaaagaaaagccactactactattaatttttttaagttttatttattttaggttttatctattattgttactattgttcatctccatttccacccttaattccaacaacacccttataacaatcctcttctccaagcaaagtggactctttaccatctcctaaatacccacctctgtgtttatgctttcactcagcctggaaaatacagcactgtctcatctccaagtattaagatactaactattcttggcagcttcgttcacagaccacctctttcaggtaccattctctagtatcccagctccataacacattacagacattcctcagcatagaaaccttggctagattcatcttggtatcttgcagagttctagccagtttccagaatacatggtagggctcaacaaatgtttgagaaaataatacctatatttcctttctcgtccaaccactctcttagacaacagctccacaatacaagtaaaaagagttcttctacagtatttcataaagctggccagctaattttctatcaccaatgtggtaatttctaatacagtacttaatacatagtagatgcctaaatattcaaggagctaagctgaatttcacctcatcttttaatttcatttatcattctattcattatgatcaagtatggctcatccttagaaataggttttagtatttacttgcccacaaactcatctgtcaatttctggccatcccccccaccatcccaatatgtcatttactggtttgggggagacaatattcaatacctcaataaagtaagaatcagaaaattaaatgtctgcagggccataaaaataaagagcaaagcaagacagcaaggcagactatggagaactaggaaacacatctcacctaaaagtttcagctggttaccgctataaatgaatatgggcttgctgttgacagatcttccaatttttcaaggttaagtcagaaactcagaggtctgtgtacatttttaagacattaaaaatattgtgtaaaccaaacaaaatacttatacaggtcaaatccaaccacaggttgccagtttgcaacctctgctacagaagttctctgcaaaagtgatggcgtgagaagagttctatcctagcagataatctaaggcagcccctaaaactaagtagctccttggaagcatctcctgcaacactcagcccaactctcaccattctgattgacctgaaaaccaaattaatttggcaatttaattgagcaaaatgagcccctgctctgtaccaggtgctgaggaatcagaaatgaacagtagtgctaaagtacagctaatatttattgagcatgttctaggtgccaagcactgttttacacgttatgtatattgactcatttaatcctcacaaaaccctatgagattactattatccttaaagactgaggcgcaatgaggttttatttgtccaaggtcacacaatcagcaagcagcagtgcttaataaggacctgagacagactccaccaaaaagagctcacaatttgaaagcaagccccattcaataaatgatgctgggatcactggttatacatagggaaaaaaaatgaaactggacccgaccttacactacacataagaatccattccagatacattaaagatctaaccattgaaaacaacagtaggtattccagaatataaagaataattgcaggctgggcacagtagctcacacctgtaatcccagcactttgtggactgcttgagctcaggagttccagactagcctgggcaacatggcgaaaccccgcctctacaaaaaatgcaaaaagtagcagggcatggtggcgcatgcctgtggtctcaactggcatgggaggtgggagggttgcttgagcccaggaggttgaggctgcagtgagccgagatcgcaccactgcactccagcctcggtgacagagcgagaccctgcctcaaaacaaagaataactgcaaatcttaaaggaaaagattgataaagttgatactaaaattcagaactttttaacaaatgacaccttaaaacagatgttttaaaataagcaacaggccaggcgcagtggctcacacctgtaatcccagcactttaggaggccaagacgggtggatcacttgaggtcaggagtttgagaccagcctggccaacatgatgaaaccccatccctactaaaaacacaaaaatcagccaggtgtggtggcacatgcctgtagtcccagctacttgggaggctgaggcaagagaatcacttgaacctgggagacggaggttacaatgagctgagatggcacgactgcactccagcctgggcgacagagcaagacttcatctcaaaaaaaaaaaaaaaaaaattaaaataagcaagaaactgggaaatgacatctgtaatatctaccaacaacaaaggattaataatcagaatatataaataaatcttttgtaaaagacaacccaataaaaaaaatggcaaaacaagcccgagcattatctaatccgtgtaaagctggcactaccacagttaccacacagtacactccagaacaatagaccttgccatcactgactgatataaatattcaggggtctgtgttatgctgcaggtacacagagcatgggtaatccagcccaaagggcagagccaagacgtttattcattctctatcatcatatagacattggatggcaaattagaggttgaacatccaacactcaaacacatagatcaggggttggcaaatgtttttgtaaagagtatttccagctttgtgagctgacacaacacatctctgtcacgactactcaactctgctattggtaccacaaaagaagatatggacaatatataaataaatgagtgtggctatgttccaataaaacgttatttacaaaaacagatcgtgggccagatttgacctatggaccacagtctgtcgacctctgacatagatagttgtgctttttctacactataggtaggacacttcccatgttttcccctgtcttttatgtctgctgacacctctgatttccttaaccaaaaactacaccacacttgacagctttgcaatggtttccaaaactctattactctgccaaaaaaaccttttcgcccttattatcaatgagaattctcccctcattttcctttcacttttttttttttttttgagacggagtcacgctctgttgcctgggctggagtgcagtggtgcgatctcggctcactgcaagctccgcctcccgggttcacaccattctcctgcctcagcctcccgagtagctgcgactacaggcgcccgccaccacgcccggctaattttttgtatttttagtagagatggggtttcaccatgttagccaggatggtctcgatctcctgacctcgtgatccgcccgcctcggcctcccaaagtgctgggattacaggcgtgagccaacacgcccagacttcctttcacttttttaaacctctttgacagacaccaccccaaaccagaaatttaaaaaactccccctaagccactcacaatgtcaataatcaacacctgcaaattctaactccactcaatgcccacagcctctgccttagttcagatcctcattacttctaactctgctcagtgcccacagtctctgccttagttcagatcctcattacttctaactctgctcagtgcccacagtctctgccttagttcagatcctcattacctctctggtcttcagtctaccctccttccaaagaacatccatttatctcctagaaattaaacctccaccacatactccccttctcgaagatcttgaatgcctctctcagctaaggattcagtccaaactccttagcaaggtccttcacaaccaggttcctaacatggtcttcctagtctcatctctggccatgctttcacacacattctatgctccagccacattcagttattaatacattccctgaaaacgtgtctttacctgaaaggcccttctctccatttcactggcaaattcctgtatcttttaggacacatctcaaatgtcaccccttcgcaacaccttccctgattctttgagcagacacacccatctccgtgtccttatagcgtttaataactcttctttggcatcgaccatcctgaactatgattgttcacatgtctacttcactcatggggctgcatacccaaagtgaagtgactctgccttaaaaacttctgaagctacagagcccagtataatgcttgatatgcagtagatgccttgaggcacagtaaacgtttgctgaatggaagacatgcctggcagtaggagtagggtttcttaacctggggttcatagacaggagtctatagataggacttcagtggggcttgtgaacttggacagggagaaaaaaatctcttttactaacttttaactgaaaattaccattctattcaaatatgagtgtaggtaacataccattctagtattagcagttctgtgactctgtaacaacagaaatctcaaatatctttatatcatactacaattgttgcatataatcttgaagtagcctttatgcgcatcatgtctttgaaattataattatcggatccatcactaaatctgatttcttaacgtgctgataaacaagtatatgcatattagatttgtatattttggaaactgtattttaatataattggtgttccttataattcaatgtactttattttatacaattaaaaaatattattctgaaaggggtccatggcacagataaggtcaggtcttcctgcattagaaaaacccagaataggctgggcgcggtggctcacgcctgtaatcccagcactttgggaggctcaggtgggcagatcacttgagctcaggatttcaagaccagcctgggcaacatgttgaaaccccaactctacaaacagaaaaaaaagaaaagaaaagaaaagaaaaacccagaacaaatgaattgtgttgctgtatatacatatggtattgacagttttattttatatatgcccgcataatatttttgttcgctaattctctttgattatatggggccctggacctattttccatgactaatttgcatatttccttcagaactctcccatagcccatgcgaactttgaattcttctctaacatgatccaacttcaattaataaaatagagactctgggtgtctacaatttttcacttttcttttttaggattttgtgttcctttgtggtaaacacctagaagagaaggagcatctctcttttttttttttctttagacagtgtcttgctctgtcgcccaggcaggaatgtcatggaatgaccatagcatggctcattgcagccttgacctcccaggctcaagcgatcctcccacctcagcctcctgagtagctgggactacaagtacaagccacatcaggtggctaattttttttatttcttttgtagagatggggtctgccagctcctgggctcaagaaatcctcccaccttggcctcccaaagtgttgggattacaggcgtgagccactgtggctggccggagcacctcttaaaactctagaaagttagaaggtctcaaagataacttctttgcacaattagagatgaaccaggaaataccaaataactggctgcctatacttttttgtattcccttcagcctttgtattgccacactcattacaggaagaaaacaaatttaatagttatctggtatatactgttatgcttcatttcttgttgtttttgtttgtttgcttttagtttcatcacaagaatgttatgcttcatttcttaacacctttctcccagctagcaaattcctttaaggcaatgtgtttagtgaggaagcagccgacaatttctagtacccctctgccactaacttgtaagatcttgaaaagtcaactttacctttctatgtttcagctaaaatcactacctgatttgaaatctttacttgatctctcaggcctttgtagtttttatacattcactcttcttcaccattttactggcttcaataacgcctttctgatgacctctccaggtgactctgctcttaagctgtgggctgtccccttccagggaagacaccttgggtcaccgcccccaaacagccaggtccctccttttaaagacacacacaactccctaagttgataaaggttctctccttccttgccaaccagttccactctctgtgcctcttttgctggccagctcctgcacccaaacctcagtctccctttgtcccccttttctctcatcaaacacctcctttttcctgttgcttcccccaagagggggtggaggatgcttgggacataagtcttcagagccttgggagttatacagctttgcaattcagccccagtaccccaaggactgccccaatctgaaccagcgtctgtacccaaagggccctcattcctcatcaatcacctccttccctcccagcaaagaactgctccagccctgacagcctgagcttggcccccatgcctccaccccaatccccaggtcctacctgcattagggctctaacaccgcctaaggcctaacccagttccacgtcctgccatcctctcagcccatagaccccaatcccggttcccttcggacccagtgttccttctccgcgaccctgaccacgaccccacgaccggctcccgcctgttccccaggcctggagcgccaccccgtgcagaccccggccagccctgcactccctcagtgcaccggcccccgcgcccagcaccctccccacccagcccggccgccgctccctccagcgcccccgcccgcaggcctggggcccgctccccaacatggcgacggggacacaagcgcggcgggcggggcggctccgggccgggcccgctctcagaccgtgccactcggtcgcccggcgccatttttccgcgcgggcccgggcggcgcctcctccccgcgaagccagcccgacaaggaccgcggacgcccggcgggcccaccccttacgggcccgcgccgccgtcccctcacctgagcgcggccccggccctcccgggcgggccttggagcgccggcccgggccgtgcgtgcccgccgccctcggtgcgtccgtccgtcagtcctcgcgtgcgcccgtctgtcccgccgcccgcgcccggccgcccgcagcccgacccggcagggcctcacggagccggcggggagggggatgggccggaccgggccggggagggagggggagggagggagagagggagggagcgcgagagggggcggggcggactcgaggggcggggcattgcccacgtgaccagacgtccccgggagcgcgaggtggagcgcgcgccagctcccttcggtgctgagtgcttagtgctgggatctcgtgggtctctgtcggctttccagggctattctctcgccagtgagtcccacttcggaagcacacattgcacagtcttttgcgagcgctctgagtatccttggacatggcaactccaagcctcagtttacccatctgaaatatggggaaaatcatagtgcttgtgaagagcaaatggaggtgggcttggaaagcacttgtcaccgtgcctgacacatactgtctaataataagcttaatgggatatagataaaagctttcattattatttgcctctaaatccctctcttctttttcccatcattacctccctagcaagctaaaatgctcagtaaatagaattattgatcgaacgagtgtggcccctcccctcttcccaaacgtagaaaggcctcctcagcactggacttcatgtctgtcatacaggcctggattcatatctggctttcactcttttttaaaaattttctgttttttcccacactacactgatgtattttttaaattttcgtaagtacgtagtaggtgaatatatttatggggtacatgagattttgatacaggcatgcgatgtgtaatcacatcatggtaaatggggtatctagcaactcaagcatttatcctttgtgttacaaataacccaattatactctagttattttaaaatgtacaagtaaattttgtgtgtgtgtggttttttttttgttttttgttttatttttgtttttttgagacggagtctcactccgtcgcccaggctggagtgcagtggcgcgatctcagctcactgcaacttccgcctccctggttcaagggattcgcctgcctcagcctcctgagtagctggtactacaggcgcatgccaccacgcccagctaatttttgtatattttttaagtagagatggggtttcaccatattggccgggctggtcaggaactcctgacctcatgatccgcccgcctctgcccctcaaagtgctgggattataggcgtgagccaccgcgcccggccaattgttttttactgtagtcaccttcttgtgctagcaaatactaggtcttattctttctaactattcttttgtacccgttaatcattcccacttcccacctacctccccattaatcttaccagcctctggtaaccctccttctattctctatctccatgagttcaattgttttaatttttcgctcctggcccggcatggtggctcacgcctgtaatcctagcactttgggaggccaagatgggcggatcacctgaggtcaggagttcaagaccagcctggccaacatggtgaaaccctgtctctactaaaatacaaaagctaggtgggcatgatggcgggtgcctgtaatcccagctactcaggaggctgagacgggagaatctcttgaacctgggagatggtggttgcggtgagcctagctcgcgccactgcactccagcctaggtggctgagtgagactccgtctcaaaaaaaaataaaaaatagttaattttttgctcccacaaataagtgagaacatgtgaagtttgtctttctgtgcccggcttctttcacataacataatgacctccagttccatccatattgttgcaaatgacacgatctcactcttttttaatggcggaatagtattccattgtgtatatgtacattttatttatccattcatctgttgatggacacttaggttgcttccaaatcttggctgttgtgaacagggatgcagtaaacatgagagtgcagatctcttccatacactgatttcctttctttccggtgtatacctaagaatgggattgctggattgtatggcagctctctttggctttcgctcttgatagctgtccttgcctctctgaacttgagcatcttcatctgtaaaatgggagttggggtctgttctgagcatcccaggagatagaggatgagcaggtggattgtaaactaattaaacaaatcagtcctactgatcccatagaagaaagggagtcaggaaccctttcattccatcaatatttattgagtacacacagtgtgcttggactggtgtagtagatacccaccatcttttcacattaccctgaccgccctctaatctattctccaccctgctgtcagagtaatgtttctaatgatcagaaatatgatcatgtcactactctacttaaaagtatctgttgatggccaggtgcagtggctcacacctgtaatcccaacactttgggaggctgaggcaggtggattgtttgagcccaggagttcaagaccgggctgagcaacatggcaaacgctgtctcaacaaaaaatacaaaaatggctgggctcagtggctcatgcctataattccagcactttgggaggtcgaggtgggtggatcacgtcagctcagaagttcgagactagtctgggcaacatggcaaaaccccatctctactgaaaatacaaaaattagctgggcatggtggtgcacacctgtagtcccagctaatcgggaggctgaggcatgaggcaagaatcacttgagctggaaggtggaggcttcagtgagccgagataacaccactgccctcctgcctgggtggcaaagggaaaccgtgtctcaaaaagacaacaaaagacaaaaacatagcaggcatggtgctgcacacctgtggccccagccactttggaggttgaggtgggaggattgcctgagcctgggaggttgaggctgcagtaagctaagatcatatcattgcactccagcctgggcaatagagtgagaccctgtctcaaaaaaaaaaaaaaatctgatggctctacattgctcttaagataaaggccaagccgggcgcggtggctcacgcctgtaatcccagcactttgggaggccgaggcgggcagatcacaagatcaggagatcggaccatcctggctaacacggtgaaaccccgtctctactgaaaatacaaaaaattagccgggcgtggtggcaggcgcctgtagtcccagctactcgggaggctgaggcaggagaatggtgtgaacccaggaggcggagcttgcagtgagccgagatcgcgccactgcactccaggctgggcgacagagcgcgactccgtctctaaaaaaaagataaagaccaaataaatgttggcctccccacatctctagatttatcttagggccctcttcccctttctctgggttgcaactacagtgatatttcttacacattgttctccctcctttctgagaacccttgcacatgctgatccccctgcctgcaatgctctccccacttagataactctcagtcttcagatcccagttcaaacggggctactccaaggataccttccctgacccattcccacacaggttttcttagcacgatatgcttgtccttagtagaatacactgagtcattattacctgtctttgccactagactatggacaccataaggaagaaaaccttatccatcttgtttaacattgttttctcagcatatagcacagcacctggcacagagtaggtgctcagtaagtatttgttgcgtttgtgaatcctaagcacaatactaggtattgggcccaagagggcagacaggagcaaagagaaccacaggcaaccgcaacaggggggcaccttagacctttgagcctatgaaattaacaccaaataaatttaaaatatcctggaaaaaaaaacttttctgaagctttttattttaacttttaaaaactgaaatataatttatatacaataaaatgaaaaactattaagtgtatatctaataatttttttgcctacattcctgtgttaccaccacctagatcaagttatagatctatcaacccagaaagttcccttttgttctcttttgtatgttctcttctaataaatacctgctcccccagatgtaaccattattctgacttctagcaccatagattaactttttttttttttttgagatggagtcgcgctctgtcgcccaggctggagtgcagtggcacaatctcggctcactgcaagctctgcctcccgggttcacgccattctcctgcctcaacctcctgagtagctgggactacaggcacccaccaccacgccaggctaattttttgtatttttagtagagacggggtttcaccgtggtctcgatctcctgaccttgtgatctgcccgccttggcttcccaaagtgctgggattacaggcatgagccaccacgcccagccgtagattaactttgacagtttttgatctccatagaaacagaaccatacagtttgtactcttgtgttagcctggaaatctgacatagccaaagggtgattttttggataaagatacaattaatgaatgacttgattaattaacctgaaagactgaatgaaaagctctggctacttcatcctacagacacagaggtcctgacaacagccagcccagaggctgagaagacctcactgacatatttccaaacccacaaagacttctagagataagaaagctctcaaagattccagaaactcagcaataagactgggtgctatggctcatgcctgtaattccagcactttgggaggccaaggcaggaggattgcttgagtccaggagtttgagaccagcctgggcaacacagtaagacttcatctctacaaaaaatttaaaaattagctggtcatggtcgtgtgtgcccgtaatcccaactactcatgagactgaggtggaaggatcacttcagcctgggaattggaggctacagtaagccaagatcacatcactgctctccagactgggtgacagagtgagaccctgtctcaaaaaaaaaaggcaaaggacttgaatagacatttcttcaaagaagatatacaaatggctaataagcacatgaaaagatgttcaatctctgtagtcattaaggaaatgcaaatcaaaaccacaatgagataccaattcataccctatttatgtatgtatgtatttatttattgagacagaatctcactctgtcgcccagactggagtgcagtggtgcgatctcagctcactgcaacctctgcctcccaggttcaagcaattcttgtacctcagcctctgaagtagccggaattacaggcgcgcaccaccatggccagctaattttttgtatttttagtagaggtggggttttgccatgttgtccaggctggtctcaaactcctgagctcagtcattccccctgccttggcctcccaatgtgttaggattacaggcgtgagccacggcgcccagctgctgttatttttttaaaaggcagaaaataacaagttttggcaaagatgcggagaaattagcacttttatgcattgctggtgggaatgtattttgtttttgttttttgtttttctttgagacgatctcgctctgtcacccaggctggagtgcagtggtgcaatctcggctcactgcaacctccgcctcccgggttcaagcaattctcatgccccagcctccagagtagctgggattacaggcatgcgccaccatgcccggccaatctttgcattttctgtagagacagggtttcaccctgttgcccaggctagtctcaaactcctgggctcaagtgttccacctgccttggcctcccaaaatgctgggattacaggcgtgagccactgcgcccagccaggaatataaattgatgcagccatggtggaaaacagtttggcatttcctcaaaaagttaaacataggcgcccctgtaatcccagctacttgggaggctagggcaggaggatcacttgaacccaggagtttgagtccaccctgggcaacatagcaagacccagtctcaaggaaaaaaatgttaaacataggattaccctatgagccagtaattccacttctgggtattcatccaaaataagtgaaatcacattagtaccactgtactccagcctgggtgacagatgagaccctgtctcaaagtttaaaaataaataaatgaacaagccaggtgtggcagcacatacctgtggtcccagctacccaggaggctaaggcgagaggatcagttgagcccaggaggttgaggctgcagtgagccatgtttccattcctgcattccagcctgggtgatggagcaaaaccctgtttcgaaataaaatttaaaaaataaagaagtgaaagcagagtttcaaagagatatttgtgcacccctgttcacagcagcattgttcacaatagccaacatgtggaagcaacctacatatctatagacagttgaatagataagcaaaatgtggtctatacatgcaatgaagcatcgctcagccttcatgaaggaaggaaattctgacccgacgtacaccacagatgaaccttgaagatattatgctaagtgaaataagtcggtcacaaaaagacaaatattgtatgattcctcctatatgaggttcctaaagtagtcaaattcataaagacagaaagtagagtggttgccaagggctagagggagagggaatgggaagtttgtgtttaatgaatacaaagtttcagttggggaaaacaaagttctggaggtagatggtggtgatggttgcatgtgaatatacttaatgccaccgaattatatgcttaaaaatggttaaaatggcaaattttatgttatatatgtattttaccatacacacgcacaaaagattccagagccactatcctaattttttcaccttgttgtccatgtccttaagccaagggtcatgggtgttcctgggatctgcaagaatgcaaagagctgagaagacaggggcgcattgggcacctgcagatcctgtaggtaaaaatagcaggagcctaggcaacacaaatacttgttgcctgcaggcaggcagcaaaagaacaaaaacaggccataaactagcagatagtatagcataatgattacaatattgggctctgaagccaaagtgaatctgaacacccaagttcagattctagctctgccatttattagctatgtgaagaaactgcaaccaaaaggagataaatgacttgtccaacagggtccaaagtattttctcatttatattgtttaaaaatctttacatgggttttgtttcattctatatccccagtagactgtaagctccccaaggaagctatgtttgtaatatcctcacttgaaatgtaacttaacttctttgtgcttcagttgcctcacctgtgggatgcagagaataagggctcctacttcataaggttgtcaagcatattaatgaatttatacctataaatgtttaggagaaagcttagtgcttatgatagtctcaacaagcaatagattgagagaggcttctgaagaggtggtcaggctatttcataaaatgttttgagcaagaaaaacagtcctaaaacatccaggattgttctagatttggactagagtgaagaaaaagcaaatcaattgttctttgataatttgatttgtatttattggacttctactttcatgtgtgtccaaacaggctcaagctctgcagtgataagactgacagtgaatacttcaatgatgtctttaagaaaaacaataataaaacaggggaaaaaagaaagaacaaaaccatctagaaagtgtcaacattttactgtctgcagggttcgtcacaacagtgccaaatgacaaacttaccacatttagttggatgaattttgccctgcagaaggatatcaccttttttttttataggcaaacagtttatttattcatcctccttctcttcctccccatcttcttcatcttcttcttccatcttttcccaggcaactttagcaggaccttttgtgccgtccaactttcctttcgacttatagtcagcaacatccttctcatacttcttcagctttgccaccttagtgacataaggctgcttttcactgtcatttaagttattccacatctcacccagcttttttgccacgtctccaatagagatgccagggtttgtggatttgatcttggggcagaattctgaacagaacaggaagaatccagacagtggccttttgggggcattaggatcgttcttgcctcccttagctggtccataatccttcatttctctatcacagtgcactttatccgcctttgccatttaatcgaatttagactctctctctctttttttttttctgagatggagttttgctcttattgcccaggctggagtgcagtggcacgatctcagctcaccgcaacctctgcctcctgggttcaagccattctcctgcctcagcctccccagtagctgggattacaggcgcccaccaacacgcccggctagttttttgtatttttagtagagacgaggtttcaccatgttggccaggctggtctcaaactccttacctcaggtgatccacccaactcaccctcccaaagtgctgagattacaggcgtaagccgccgtgcccagcctagacttctctttcccagacattgtcttccacctctcagagcactttttggaaaattctgcaaaattgacagggacctctggatttttcttatgctcttctctgcacgtctgcacaaagaaggcaaaagcagacatcttgccccttagtttcctggggtcacttctagccatcctgactgtattgttcactagtcttgaaggatatcacttttaagtggacaccattcacatgacattataatttgcaaatttattatgataatttaccagtagatggcagtaaaatgccttgttatttcagaatctgttcgttgtaacaattttcagatatatggaaataaaatgccttgaggagggggtcacttgtgctttgcataaagacatgctatggcgaggcgcagtggctcatgcctgtaatcccagcactttcggaggtggaggtaggtggattgtgtcagcccaggaattagggaccagccagggcaacatggcaaaaccccgtctctacaaaaaaatacagaaattagccaatcgtggtggtgcatcatgcctgtagtcccagctccatgggaagctgagatgggaggatcacttgagcctgggaagcagaggttgcagtgagctgagactgcaccactgcactccagcctggatgacagagtgagactctatctcaaaaaaaaaaaaaaaaaagcggtggtggggtgggggcttactatgggcaagccatggcttgctcttcaggaaaaaaatcattgaaaaaatagaagaaatagactaataattacacaattttaaaaagtggaagaatatcaagtgaccatacatacacaaaaaggtgggggtgggggagaaaaaaaaaactgttttcaaaaatattctgaaattttaaagctttttattagagtataatataaagacataaaagtacagaaatcgtaagtgtaaagcctgttgaatttccacaaagccaacacacatgtctaacaaacacccaaatcaagaaatagaacattcagccccacagaagccccttccagtcattacccacagcccccaaggttaaacagtattttaacttctaactccatagattagtctcaccaggagttaaacttacagattcatctacattgttgcatgtagttgtagcatgttcattttcattgctgggtagcatttcattatttattttttatttttttgagacagagtcttgctctgtcacccaggttggagtgcagtggtgggatcacaggtcactgcagccttgacctcccaggctcaagtaatccttctgcctcagcctccctagtagctaggaccacaggtgcatgcc

SEQ ID NO: 531 - DNA, 26140 bp, Homo sapiens
gattacaagcatgagccaccgcacctggctggtaacctaaaagtttctaatatcactcattcatataacaaatatttattaaatacaaatatttattaaatataatgccaggcactgctctaagtgcctggagatacagcaatgagtaaaacattaaaatctcggccgggtacagtagctcacgcctataatcccagcactttgggaggccgaggtggttggatcacctgaggtcaggagttcgagaccagcctggccaacatggtgaaaccccatcttgactaataatacaaaaattagctgggcatggtggcgcacccctgtaatcccagctactcgggaggctgaggcaggagaactgcttgaatgcaggaggtggaggttgcagtgagccaagatcgagccaccacactccagcctgggtgacagagtgagattctgtctccagaaaacaaaacaaaacaaaaagccattaaaatctctgcccacatggatctcaaaattcagtttataagattatactgcctctttcttaagaacccttagccctaaggagccactactacgctgaagctgttgctttgcttgctgaggattagaactagtgccccctcacccttttttcttttcctattagctttctcaggttgaaccccttttttaagctctagcatataaacatcttgaattagctcacccctttgaggggacccttctgaaatgtttggttaggggctaagagtatctaatcatcatcagtaaatcctcaagtgcctgctcttcaaaggatacaggtactggaaatacaaagagatgtaaaaaaaaaaaaacctgcaaaataagagatgctctcataaagtgatgcaggagctcaagaaagggaaaacgacaactaacttttcattatgaagttaaactatgaaaagaaagagggtacttccacctcaatattttaactaatctcttagagggaccaagaaatgcacaaggagttcatcaatcatcagaaggaatgttgccttctagaccagtaacctctaatataaaaaaaattaacagaaattacactttattagtagtataacaaaaaaattagccaggtgtggtggcgcgcacctgtagtcccagctactcgggcggctgaggcaggagaatcccttgaacctgggaaacagaggttgcagtgatctgagatcaccccactgcactccagactgggcgagagagtgagactccatctcaaaaaaaaaaaaaaaaaaaatagtagagccagctggctcagtggctcacacctatagtcccagcactttgggaggccaagggggctgatcgcttgagctcaggagttcaagaccagcctgggcaacatggcaaaaccccatctcttctaaaaatataaaaaattagctcggtgtggtggcatatgcctgcagtcccagctactcagggggctgaggcgggaggattgcttgagcccaggaggtggaggttgcagtgagccgtgatcgtgccactgcaatccagcctgggcgacagagtaagaccctgttccaaacaaaaacaaaaacggtatagtagtacatgtatacatttatattgaatatataacttgagtataatgaatattcacattttttctgatgatataaacatttggagaccattgcttcagattgtaagcctcaactttacaagacctttagaagaagggcagaatgatggaaagaaggtaggctttggacacagataggccttgacttaaatcctagcttctcagagtttcagttccctcctatgtaaaatggaaatatggtacttatcacttaggtttattatgaggaataaataaaatgtacagagcccctagcacagtgtctggcatgtatacatgtgctcaatgaatgatagtatctagcgctggaagcctgcaagagccatgaaatccatgagaaccaatcagtgtctaaaagcaataaggagaggatcattcgttctcttccttgttggcagagagggtgatattgtgtaaggtgtttatcttcacaagagccaagggaggaaggagccaatatctctgggttcaaagacagaccaggtacacgtgggtccaggcttgtctgaggcatctctatcacatgcattcagcctgacactgctattgctgctgactggaaagggggggggtggttgttttttaaatccttttgcaaaataagcccagaattaacttttctccaacttggcaaagctccttcttccctcacttggctcctcatgagccctaagaaacacacactgctcccaggattccacgtcagtatctaccctgtatacccatcaatagatcagacaatacctgctcaaggcagaaaggactcctctgtgtttcaagtccagagaagggtccctgaaatcaacctcaaatatttccaatgtgccatttgtgctgaaggaggaatctagctgttgggcagatgttcctaggcacaagaaaaggcagcatatgagcaacaatatatgcatggatttcaggtataagaaggttaaggagtgaagaagagaaggaacagaagagggctgggtataccctttctcaaaggtaactccacaaaagcaagaaaacgttggctgggcgcggtggctcacgcctgtaatcccaacattttgggacgccgaggtgggcagatcacaaggtcaggagatcgagaccatcctggctaacatggtgaaaccctgtctctactaaaactacaaaaaaaattagccagatgtggtggtgggtacctgtagtcccagctactcaggaggctgaggcaggagaatggcatgaacccaggaggcggagcttgcagtgagccaagatcgcgccactgcactccagcctgagcgacagagtgagactctgtctcaaaaaaaaaaaaaaaaaaaaaaaaagacgtacctaaccttgagccatagtcctaggcagccctcaggtacccaaaacacctaatatctccttgcttatgctgtgagccaccctatctttctatgatctgagagctttctctgatgttcaataaataattctagatactaagtttcccctcaacttatgtactcccagtggatcctaattcacagtgtcaccatacctgtggccagatacaaagggtattggctggctgggctccatgcctggacagctggccgctcaagttccttcagcttcatggtctatcctgtaggtggcagaaaactgacatggccctcagcccactgaaaatagaaaccagcaaacttaacagccagatccagggagcatctgcggacaagagttcttgtttgtctttctccatcacaagatagggcatttcagggcaacacagagtgacaaatacatgaccatctgcagatctaaagatagttcattcacccaattactgaaatgtaatgctttaaacctcaaatgatactcaaccacaatggctaccacaggtccagtggtgataaccatcaaaccagacaatctctcagtgatgtttgtccatttccttggctttaaatagcacccatatgctgatgatccccaaatttatatcaccatcacaaatctctcctctaagctccaagttcttatatgcaatttcttttcgttttttagaccaagtcttgctctgtcacccaggctggagtgcagtgacacgatctcagctcactgcaacccctgcctcctgggttcaagtgattctcctgcctcagcctcccgagtggctgggataacaggcatgtgccaccatgcctggctaatttttgtatttttagtagagacgtagttttaccgtgttggccaggctggtctcgaactcctgacctcaagtgatcagctgcttatacgcaatttccaatcaaatatttcacttggatatagtagatacttaatgggggagggaactcccattttagtctgtctaaaatggagttctctattctaccatcttttatggtctttttttatttgtttttttcagaaaggagcaaagtcacaatctcttctgttcttcctccagtttttttcatcttggtaaatggttccactatccacccaattgctcaacccagaagcctgaaaatccctcttgatccctccttctccctcattctcttctaatccatcatttagtctccttgatttaacctccaaaatatatctcaatctgtctacttttctctattttcgctgccaacagcctttttgattgtatcatctctcacctggagtactccaacaacctcccaactagctatcccctttctactcaagccattacccaattcgttctttacacagcagcaggagtgaacttctaaaataaaaaatgattttggcattccatgcttaaaatctttcaatgatttctatcacacacagaataaaattcaaacttctttgagccctgcccaaaggctccagcctaccacttcaacttcatcttttaatacttttctcattcattgtgcttcagccacactagcctttaatttcctgacattttccttccttagagcctttacaaatgctgttccctatactttgaatgctcttcccttcactttcgacatgactggctccttatatctttctgggctcagcttacttccccaaataagtgaactacccaatcacaaaaagcctcagtttttttcttcctagtaatttataattacatatttatttatattgacattgtcagtctcttccactaatatgcaagctccatgagagctgacactgtgtcggcttttgttcaccatgttgtaactagtttccaaacgaatgtctggcatatggtaaaagctcgaatgtggacatccattttaactctgtggtttctgatctaattccaatgtatattcaaggtcccatcccaacaggctagcaaacaggtagaaatgatttttaaaaattacactgaacttgaggagaaagcttgggacctactgtgacctgcttgagtaagctatagtcagatcagtctcacctacaaaaacaggagatagtattacttaatctctaaggtactttctagcgtgaagaaagtttaagcctgcccattaagccaagatttccaaagcacctttaaacacttgtggctactatcacgtattctgtgaccagctcaacactctactatacagtcaccagtgccacctgctggtcacagccattttaatgtttctgggaaaagattccctaacaacaaaaataggagctgcgataagcagctgtgcatttgatgtgcatatctcagttaattctctcagtggtcttatcaggtaagtactatgattatccccattttctagagatgacaactggctaggccgggatgtgaacccccatcagcatcaagagcccgtatttctaaccactgtactagtcgcaagtaaaccctagaaagtgttttaatcgctgacagtctaggaactgggaaaatgggctcttaattcacattgttaagaggcatctattcacaaaaaaagggcccccgctggggtcagattggccatgggggcgtgagggggagatgaccaatgaaatgctcgacagacctgccgtgcaggagggcaccagctacccttggcagtccagtccctagggaggacggtcagcacagcctctttcccgctgtcgccgaagcgcggcgcgccagggtcagcaatgacagaccttcccgcccagcccaaacgcagcgacaccggacggcctcggctgggccaggtcaggaccaaggcggatgggaaggcgcaaggcagcagtgaacagggagaccctcatccggctgggggttcccgtgcggcagggacagtagagccggatccaattcaagggtagacgtagtggaggcccccgaggcccggacccgcgggcagggcaggcgcgggccgggggctccgcagcaagcgggctcccctccgcgctctgccgagaaaggagcagtgctccgggtccccagcgcaatctctgctaccagggaccccagaccggcggggcgaaccaacctgtgcggaagaccccggacaagggtcaggcgcggcggccggagccgctcctctggcagggctctcgcgcggagccgggcgctgtggacggcggctgcggaggaccaaagcggcgcggaccccggcagggcaccgtcggaaacacgctccgcgggcgccgagcccgagacactgacagacccacggagaacgtttccaaacaggattatagcttttaaccgggcctccctcacctaccctgtgattgcgcagcgggtcagatctggaccagtaagttctggtctattcagtttgagccaggctctagggccagtctctgaaaagggaaaatactaactcattatctatgtattgaagcgggagaagacccggccctggccccaggagccctcagtggaatccatttagttgaaaacgtaaaaagcaatcgaggctgtaaatggcagtgagtgttgcactgcagcccagcagaaactggtgcccaaaacttggttgaattaagggctataagtgtatggagggtgagactacagggccaggggcttcctgaaatatttgaggaacataggaggggtgttatcctctggagctgcaagaacacaggtgatattccagccgataatgtattttttatgttgaagaaattgtgccacttccaaataaaaatgttctgtagacaggtcgggtgcagtggctcacacctgtaatcccagcactttgggaggccaaggtgggcatatcaccaaaggtcaggagttcgagaccagcctggccaacatggtgaaactccgtcgctaccaaaaatataaaaattagccgggcatggtggtgcaggcctgtagtcccagctactcacgaggctgaggcatgagaatagcttgaacccgggaggtggaggttgcagtgagctgagatcacgccactgcactccagcctgggtgacagagactccatctcaaaaaaaaaaaaaaaattctgtaggcagctttaaatcttagaaacttatgcttaacgcatgaattctctgtattcctgcctgatacacctccaaagatggggggccagttatcatgatggagcccaactcattgtgacacgactccagttcccttccatgtggatctggcaattttgaagttagacagaaggtaattcagtgcattatctgtgcctagcccacgcttcctacctactaagtactcaagtatttcctgaacttcttagctggcacaacagggaatgaagcctgaggaaaagtaaacagggttaaaaactaaacctgagagaaggaggcagaagagttactgatggaatactcctaaagaaatttgaaccagaagcttaagtcacagtttcgggtaggacatgattaagccaaattaaaagtgcactttctcaactcacacctcttaagaattcttgctgggagcagtggctcatgcctgtaatcctagcactttgggaggctgaggcgggcagatcactcgaggtcaggagttcaagaccagcctgaccaatatggtgaaactacatctctaccaaaaaataccgaaaaaattggctgggcgtggtggcatgtgcctgtaatcccagctactcgggaggctgaggcatgagaatcacttgaacctgggaggcagaggttgcagtgagctgagatcatgccactgcactccagcctgggtgacagagtgagaccatgtctcaaaaaaaaaaaaaaaaaattctttttggcctggcatagtggcccacacccataatcccaacactttgggagaccaaggcaggtggattgcttgagcccacaagtttaagaccagcctgggcaacatggtgaaaccctgtctctacaaaaaatacaaaaattagccaggtgtgttggtgcatccctgtggtcccagctgcttgggaggctacagtgagaggaccgcttgggcctgggaggtagaggctgcagtgagctgtgatcacaccactacactgcagcctgggcaacagcgtgagaccctgtctcaatagtaataatgataaagaattattttcactttgtattataactgctggtctcctatgtaatatttgaaggtgattactttgtcttgctcagttttatatctccagggcttatcagtgtttgatacatattagacacacaggtgtttgttaaggaaatgattatcaaatgctatagagaatgaagacagataaaaagccagtggggaccttcaaagaatagcattccacaagtatccactccctgacctcacaaaaggtctctcactgcctgcacaactaagactccacatctaatttgaatgaacttgcttcttttggtcacataaaatgtatgcttttctatgggacaggttttccggcaatatactgtaacttaagaatatgtccccaaaggaatatgggttggttcacttaaaaatagacatgagggctgggtacagtggctcctgcctgtattcccagtgctttaggaagctgaggcaggattgcttgaggccaggagtttgagccagcctgggcaacatagcaagatcccacctcaacaaaaaataagaaacttaggttcgtacatcccagtaatcctagctactagggaggttgagtaaggaggatcccttgagcccaggggtttgaggctacagagagctatgattgtgctactgcacttccacctggggaacagaggaagatcctatctctaaataaaacaaaaaacagatgaatgatagactctcaaaaacatagtttttctctaagactgttataggagtgtggatgagtcatcaaaagtaatcaaagctatgaacatgttcagtagtaactcactgactgtcctccaattcataaatacaggtaatgtcaacttattaagaagctatgattcagaagctgctttggaataaggaatattcttataacggaaataagatcagaggcagtcgcagccttaggcagacaggacaaaaacacttatcagtcctgtaatatacttgaaacacgttagagcacatttttttccaagtaaccactattattaaggagttttttttgtttttttttgttttgagacggtctggctctgtcgcccaggctggagtgcagtgccaccatctcaccgcaaccttgacctcctgggttcaagggagtctcctgcctcagcctctggagtagctgggattacaagcatacaccaccaagcttggctaatattttgtattcttaatagagacggggttttgctgtgttagtcaggctagtcttcaactcctggcctcaagtgattcacccgcctcggcctcccaaagtgctgggttacaggctgagccaccacgccatgccaaggtttttttcgagacagggtcttgctgtgttgcccaggctggagcagtgttgcaaacatggctcactgcacgctcctgggctcaaatgatcctcccagctcagcctgctgcacagctgggaccacaggcgcgcactgctgtgcccagtgaattttctgaaatttttttttgcagagatggggtctcgtcatgttgcccaggctagtctcaaagtcctgagcttcaagcaatccttccacctcagcctcccaaagtgttgggataataggcgtgagctaccagacccagactagaaaggttttttatgtgaaataaatcttgttccaacttggaaagttaggaacatttcttccttgaccctgtaaatgggaaaaggagggacccttaacacctccacacagctaaaacccttaagtacctttacaacccaagtgaaattaacaaattaacattttgtgcctaagtccccatccaccccaccctcttatcctttaaatttcagaaaaagaaaacagggaagacagcagacatcaagcagaaaaaaagggaaaaggatgaggttcctcaaggcagtgactattcctggggaaatgaggcacaaataacacagcactgagttttattagggatttcattaaggttaaatttctaggaatgagggagtcctagttagaggacccaaaagcccacgaagcctcctcagatctcatagtgaaccacccgctctggttctttggagggatcaccgcctcgttccaggtacagattattgtaaggatactgctttggtccctacagaaaaaaacacaggtcagcaagaacatacattcagtcaatacctggctacaccccactctgagttaacaatcacgcatggtaaatgggtacacagtagcctctggtcagacccagctgggctaggaaggcaggaacagcactcctcttcctcactcagcccaaggcagagagaaagcctaaattgtaagagaagtggtgcctacactgtgagagagaaggagaaagggggagggaagggggttagggaaaggaggggaagggaggaagacagggagggaggtaaagaaagagagaagagtgtgttagagtcagaggcaacactttctaaatgagacgatgcatccatccatcccactctctctcggggtcgagacagactcaatctcctttaagtcactcagcctctaatggttccaccactaaagtggcccagcaaatgaggcgtgcagcagcagtggtgggggaaagcacagaggagacaaggctgggacgtgctttaggggctgctggctttaccaacaaacagctgtcagagaacacagctcaaggggaggagaaaagggtgatgtgcttacagaactgaaaaatggaagagccacactgttccttgctctcctgaagtgaagttagtgctcaccctagccctacgtgcattctccagcatggagcccctggggcttggtaggaaggctcgtgtcagtgcacacagacataccagctaccttcaggacattgattgtctctgcagaggtagcactgggcagccaactgcaaacacagcagcctccctgctttcagcttctctccttccagtacatcctggagactactcctggattaatcttcctaagaactcagcattcattatgtcacttttctgttcgaaaacccaaaatggctccctgccacctagaggcagaccaagtcatcactgtatccccaaccgctagcacagtctgcatctggtacatagtacaggctccataaatatttgttcaattaatgctttattacaccatcaagtccaaatcccttagcaatgaaataaaagctgcccaacctaactgaccaacttacctcacaatattttttaacacagtgatttccaaatctaggtgcacatcagaattacctgggagcttgttaaaaataccgcttctggaaccctactgtgatgctactgaattaggagcaccaagaagtggggcctgggaatctgggtttttagcaagtctccaggaaaccaatgcagccggttatttaggaacgattctatacctctattctactccagctaactcaccctccttttccttcattgttttcttttttttttttcgagacagagtcttgctctgttgcccaggctggggggcagtagtgtgatttcagctcactgcaacctctgcctcccaagttcaaaggattcctgtgccccagcctcccaagtagctgggattacaggcacgcaccaccatgcctggctaatttttttgtatactttgtagagacggggtttcactatgttgcccaggctggtcttgaactcctgagctcaagcaatctgcccacctcagcctcccaatgtgccgggattacaggcgcaaaccaccatacctggccgccttcattgttttctcttgccccaaatgttttctccaacttcccaccacccaaagcgtgtgtgtgtgtgtgtgtgtgtgtgtgtgtgtgtgtgtgtgtgtgtgttagcatctaggtagcccttctccttgacagtaactcataccactaagcacatacgtgtgtgtgtgtgtgtgtgtgtgtgtgtgtgtgtgtgtgtgtgtgtgttagcatctaggtagcccttctccttgacagtaactcataccactaagcacatacattcactatacacatatatacacatagattgtacagaattcccatatatctgttcaaatgttgctcatgtaacttatctaaattttcttaactaaacttccttaaagctagagaattcattttctatgtcctttacattctccaaaatgtaagtctatgcctgtagtagactcttaattgcttccaatatactacaggacgtgcccttcacaagtccaacaaaggataagattttcactcaagattccttaactctactgtgaaagatcacttaatgaaatattgttaataaatataatccccaaatggcaactctggtgactagctggtttccacacactcattgctcatctagtcttcaagtgtatctactcacccagactggtccaagaagtaggggtggagaagtgctgtggtacttgtggcaggccaatgggtcaaggccctcctatcttcctatctcctaagactccaggaagccaagcttggtattgactggattcctaccccagagacttcactccctcaggaaatggggctaagcaagcgtgcctaagggagcacttctcggatactcaccacaggctggtagacagggtacacgtcccccacccagcacatgaatatcatgaaagccaggaaaccgaagagctgcatacacatgacatgccaagaaacaggtgtgggggatgtatccacacggttcctgttgtacatgtctaggtgccagtgcatctgaggcagaaagacaaatagctgtcacatactactcttcctgcaaaatgcaggcaagtccccagtgattagagcctgatacaaggctagacagaagcattctactgccctgggacaatatgctgagaaccaggtctgaggcacactgccctacaggattagatgctggcctctgtctaggttctgctgaatagggacagctccatcatggaagtgcacaactttcacagtacagagtttcatgattcccagacgtcccattcagtgtgccacatgcaatctcagatctcacatcactggaccttgcttccttgagcaggaaagcttagtgttacttggtcaaagaagtgccatctgagctaaagaatcgccaagaagacaaagagagaaggaaggtcaaatgagatatggttctcttaccggttcaccccagttcaacctcaggcccggctggtcccagctataccatggatctctctcatgctgtgagcggtcagggagcttcgggtagtcgccatacctgaaagacagcaagaacttctggaaagggctgtgagcagcctcagacaattcagagtctcctcatcttatagatgagaaacaaagtgacagagataactgcctcacctaaggacaaaggaactaaacctcaaggcaagagctcaagttctagtcactaagcacagaattaaccatagaagtccacactgtatttaaaagttcatggcaaactctgaaatattttaatgtacataagccttccctgggccaggtgtggtggctcatgcctataatcccagcactttgagaggctgaggtgggcagatcacctaaggtcaggaattcaagaccagactggtcaacatggtgaaaccccacctttactaaaaatacaaaaattagctgggtgtggtggcaggtgcctgtaatatcagctactcaggaggctgaggcaggagaatcacttgaacccaagaagtggaggttgcagtgtgcccagatcgcaccattgcactccagcctaggcaacaagagtgaaactgtctgaaaaaaacaaaacaaaacaaaaaaacccagcttccccaaacttctttcaataaaaagaaaaaaagtcacacaatcgtgtgatattagagatgaaagggaatttagcaatcaattacagtcatgtgccacataccatttcagtcaatgacggacaacatacacgaagggggtcccataagtttataataaagctgccctatacatatgtaccattttttatctttttctcttttttgagacggaatcttgctcttgttgcccagactggagggcaatggcacaatctcagcttactgcaacctccacctcccgggttcaagcaattctcccgcctcagcctcccaagtagctgggattacaggcacctgccatcacgcccagctaatttttgtatttttagcagagacagggtttcgccacgttagccaggctggtcttgatctcctgacctcgtgatctgcctgccttggcctcccaaagtgctgggattacaggcgtgagccactgtgcctggcccattttttatcttttatagcatacttttatgtaccttttctatgtttagatacacaaataccattgtgttacaatttcccacagtattaagtatagcaatatgctgtacaggtttgtggcctcagagcaacaggccataccataaagccgaggtgtgtagcaggccataccatctaggtttctgtaagtacactcctaatgttcatacaatgaggagataacctaacaacccatttctcagaatgtatccctgttgttaagtgacatatgactgtactctgattccctcattagatagaaaatgaaaaattaaagtttagagtctgaatccaaagtcacccagctaattggaataaaaacaaaaagggtacagattagaaaagcactcttctcgtaataactgtgttcttgaccacccagttggcattcatctctgcgtctcaaacacctcatgggacctcttgctaagctgggttttccccaacaaatccaggttcatctgacactggcttcgaacaaggctgctcttgtccacaacataagaaaaaacaggaaatgatgacaactagacatatgctacagaaaatgagtgtataacaagaagaatagaagttgctgaaaccaagattgaaagagtgacattaggacaggaaataaaggcgatgataatcacttcagataattaaccattgggatgttatgtgggtatggatacggaagagtgtggaagggataggataacatcaactggagtacgtaagggggctggctgtttaatctgcttaatagttgctacgatttccacagcactaacagaaaaacattttttttaaagagacatacacacaaatatagagtactccgtttacaaataagattctcatgacaggagtccagctccagcctggtcacatgcctggatgacagcacctgagcgcagcagatgctcaatctaaatgaaactcgacgctctggatagagccaaggaaggctcctgctattcgggggtcctcgagggagccattaaaacctcggcttcctcatttgaggaaacagcctgagccaaggagaaaattgaagtcctctcagctgcagctgctcacccacccccctcccacctccctccacagagaaaagcacccactccattgactctgaggggtcacgagaaggttcgggaaaaagggtcacagtcaagccacccaacccagccggccttctcccatcactacttgggtgcgagcataccctctctgtctcaccccatgccatcatccgggtaaggttcgtagtcttccacacgcatattatacttcttggcggcggcggcccgttcttctggggtcctaggatagggccccgggaacatgtccttggtcatgtgggaggctagaacgcagaagagaacaggtcagaagcgagcccgctctccagccgctccgaaggcttcaagtcgcaggggctgcagaggtccgagcccgggacttcgcaggatcagtgcgatcctccaccccattttctggatatatcaacgccacctccactccctacccggaggctgccgccgcggcatctacgatcccccctcccgatacaccaaatttcaggtacccccttcccacactgaggtctcgcccgttctcgcggacctgtccgtgcgcccagcggcatcacgttccgggatgccctttgcagccactggactcccaagaccccggccctggccaccgccatcttcaccttcttcacgtttcccttctgcacatgcgcaaaggcctgtcacggcggctgagccgggccaaacgtgacggaggaagccgggagtgaagaaaagccgaagggttcaacaggggcggggtttaaatacgcagttgggaagccaagggttggatagaggctgggaaggataagcgggaagaagggaaaaccaggcaggtctctgacatttcagaatgttgtgtcctttttctccctgagctgacttagacccatccagggatgatgggaactcggaacctgagcaactcaggtagacagcttaaccacctcccccaggagctgtactagtgaaatgagcctgtcttactctcttctctggctgcttgctttcctctccttcacgggcacttccttccatccccaaacatgatcattcttcaaattcacctgttggtcttgcttgttgttctgttctccaaatgggttgatcttcacttagacgccagtgcaacacacaattcggccctgaattggctccttagtttcagtccgtgtttccatctgcatgtctcagtcacctcaacccaacaaatgtaaaattaaacttatcaccagaggcagctctccagagacagcttaaagcctcagagttggtaggacttggataaaacaaattacaaaccggcccataatgaacaaactaactcaacagaagaattggagacattattatgtttgcatatgaatgttttcacttgggatttgaataacttacacattataaatatgcacgtatttccagtgacttttcaggtgaccactgttttggagcagaacctattattataaacattctcaagtatatatcagagcaataaaaatgcatataagctgggagctgtggctcacacctgtaatcccaacactttgggaggcctaggttggagaatggctggagaccaggagtttgagaccagcctgggtgacatagtgagacttcgtctctttttttttaagttataaaaagtaaacaaatatggatatatactatttaatatataaattttgggaaggactacacagcaacttgctgtcttgtaaatgacatcactagttgatgttcagaataattgcacaacatctgcattcaaccaatagcaaaccctgatccaatttaggtcaagaaacagagttgatctaatttatttatttttattaagatattattcacataccataaattcacccttttaggccgggtgcggtggctcacgcctgtaatcccagcactttgggaggctgaggtgggaagattacttgaggttaggagttcaagaccagcctggccaacacagcaaaaacccatctctactaaaaatacaaaaatagctgggcatggtggtgtacacttgtaatcccagctactcaggaggctgaggcaagagaatcacttgaacacaggagatggaggttgcaatgagccgagatcacgccactgcactccagcctgggtgacagggtgagactgtctcaaaaacaaaaaacaaacaaacaaaaacaaaaacaaaaaaaccttttaaagtgtacagtagttatttttagtacatttacaaagttgtgcaatcatcatcactatctaaaacatttttattgcttccgaaaaaacccatacacattagcacgttgcccctacctctacccactggcaaccactaatttactttctgtttctatggatttgcctattcagacagtttatataaatggatcatgcaatatgtggccttttgtgtccattttctttcacttagaataatgttttcaaagtttgtctgtgttgtagcacatatcagtacttcattcctttttgggctgtataatattccattatatgaatgtacagtacaatattttatttatacatttatcagttaatggacatttgagttgtttctgcttgtttggctattgtgaataatgctgctgtgaacattcttgtataagtttttgtctggatgtatgctttctattcttttggttatatgcctaggagtagaattgctgggtcatagggtaactctgtggtttaacttttgaagaactgccaaattgtttttcaaagcagctgtgacatgttacatccccattagcagtgtgtgagagggtttcagtttctccacatctttatcaacacttgttattgtctctttttagtatcaccatgcaagtgcctgtgaatggtacttcattgcagttttcatttgcagtaccctgatgactaataatgctgagcatctttccatgtgcttattggccatggtataccttctttggaggaatatctgttcaaaccctttgttcatttttaaattggtttgtctttttattgttgagttgtaaggattctttatgtattctagatacaattccctgatcagatacacaattcataaatattttctctgactctgtaggtttttttgcttttttacagtatcatttggaaccctgtgtttatcaggaaggggtgttggggtttgtcaaaagctttttctgtgtctattgagatgatcatgtagggttttttcttttactaatatagtgtattatgttgattataaatattaatcaataaaatattgattactacatggtgtgttatattgatcattctgagatgttgaactgaccttgcattcctggaataaatcccacttggtcatagtatataattcttttatatggtgttacactgagtttgctagtattctgttaggatttttgcatctatattcataagaaatattggtctatagttttctttctttctttttttttttttttgagacggagtatcgctctgttgcccaggttggagtgcagtggtgcaatctcggctcactgcaagctccgcctcccaggttcacgccattctcctgcctcagcctcctgagtagctgggactacaggtacccgccaccatgcccggctaatttttttgtatttttagtagcgacagggttttaccgttttagccaggatggtctcggtctcctgacctcgtgattcacccgccgtggcctcccaaagtgctgggattccagacatgagccactgcacccagaccagtgttaattttttaaaaaatgtttggtaggattcatcagtaaatctatctggtcttgagcttttctttttctttttcttttttttttttcctgagatggaatcttgctctgttgcccaggctggagtcagtggcacgatctcagctcactgcaacctccgcctccgggattcaagcgattctcctgcctcagcctcccaagtagctgggactacaggcgtgcaccaccatgcctggctaatttttgtatttttgatagcgatgggggttttaccatgttggccaggctagtctcgaactcctgacctcaggtggtccccccgacctcggcctcccaaagttctgagattacaggcatgagccactgtgcccagccttttcttttcttttgagacaaggcctagctctgtctcaaaaggctggagtgcagtggtgcaatctcagttgactgcaacctccacattccgggctcaagtgatcctcccacttcagcttcccgaatagctggaactacaggcgtgccaccatgcctgctaatttttttttttttttttttttggctggggggatttggtagagatggggtttctccatgttgcccagtctggtcgcgaccttctgggctcaagtgattcgcttgcctctgcctcccaaagtgtagggattacagatgtaagccaccatgcccagtttctgggcttttctttatgggatgtttttgattcctaattcaatctcttgttacaggtctattcagattttccatttcttcttgaatcagctattatagcttgtgcctttctaggaatctgtccatttcatctaggttctgtaattttttgacatacaattgtttacagtatgtccttatatgctttttttggggggtaaagtcagcagtaatatccctgtttcattactgattttagttcttttaatcttcttgatcttaattaatttatttatttttagtaagacaggatcttgctctgtcatccaggctggagtgcagtggcatgatcatggctcattgcagcctgcacctcccaggctcaaacaatcctcctacctcagcctccctagtagctgggactacaggcatgcatcaacgcaccgagctaatttttaaaattttttgtagagatgaggtcttgctatgttgcccaggctgatctggaacacccaggctcaagtaatcctcctgcctcagccttgaaaagtcctgggattacaggcatgtgccaccatgcctggcctaatttatttttaattcccaaggttatgaattaatacattcttgtaaaaattcaaacattcagcctgagcaacatggcaaaaccctttctctacagaaggaaaaaaaattagtccggcatggtggtgtgtgcctttagtcccagctacttgggaggctatggtaggaggattgcttgagctggggaggtggaggttgcagtgaaccaagattgcatcactgcactccagcctgggtgacagagtgagaccctagctcaaaaaaaaaaaaaaaattcaaacactgcagataaaatgaaagccttgattgccccctgcagcctcaaacacttccacagaggtagccctattatcggtttggtgtagcatggttactatgtagcataattacatagttaagccagtgcattcatttctattactgcataacaaattactgtaaatttagcagcccaaaacaccaatttattttctcacatattccatgagtccaggtactggttggctgagtcctcagctcagggtcttatcaggctgaaatcaaggtgttggctgggttagcgatctcatctgaggctccgtgtgtgtcctttcccaagttcagtggttgttgccagaattcagttacttgcatttgtaggattaaggtgcccactttcttgttggctgtcacccaggagcctttctcagctcctagagtccacctgccatttcctgccatatggcagtttgctccttcaaggtgaacaggacagctgtgctgtggcttcaaatctcttagattctgtctctgacctctagccctgatttaaagggctagagtgataagatgaagcccaccaggataaatcacctctttttgactgccttaaagttaattgattagggactttaattacatccttgtcatataagctaacctaattacaggagtgatgctctatcatattcacagtcgtgttttcttttaaggggagaaatgtatacaggatgtgtacaccgtagggtacaaatcttgggatacatcttagaattgggcctctcacagccagccataagaactgtccaagtaagcaatagaggtattaatatggccttttataatcagtatagattgtttgaaaatgtgagatgtccatggttggcctctaataacattcgattcacggcaaacatatattcaagtaggagacatggtgatataggcagaaaaatcaaatgatgctaaacaaaagaaaactgtctttgattttgaaagaattcaacttgctgtatatcttttgcctaagccttcagtcagcctttgctctacatctaccaatgtgatcactgcttttccttctgacttctttaggtgggtcaagagtttgcttttctccccattcatgagtgtaaagtttaatgcctaactgaacttgcttccttctttgactcttgtgtagactcgggcacatggggcaactttttttgtgttttgctctaccaggtcgtccctattccgtgggactagtgtctagccccatttcttcagcagtggagcctaggatgtagagctgcatactaccattaggaggcgcaccctcaggcctcggctccgcgttctttatgtctctggaccgctctctctcgcagctcatctctatggtttccgttgggtgtgtggtttttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggtggggggcggggccgcgtctaaagggagaggaggaaggtacccggttgagaggtcagaggtgaatggtgaaagagatgggagactggcagggctctagactagggcctatgggaagatggagagaaaggcgaggagatacggaacttaggggttcgtgctgattaacaggagaaattattctgaagttgagaagtagttgggatcatggaggccaacccaccggctccttggcattacttcatttggtgtttttcacctgttgttttcatttaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggtaaattccgaaagcttaattttctgttggatttaggacactcatttttctttcctatacttgtttgaaggtgtggcagaattgggtcaattagagattggcctctcccatctctggattccagttgaaggagtagtctggtcttccagcctttaaggggtttgagttcttagtggttcttggtgctacagccagctagttctgtagcttgagggatgagggaatgattaaacttgagctatgaatctctgggttcccatcttcttcctcataaagagttagttgcctagaagggtcaggcaggtgaatggaaggagtaatatcgtctgtgtgaaatcagtgatgaggctgaaggcataagccttgttcaaagtgagaagccaaggccggcgggggtggctcatgcctgtaatcccagcactttgggaggccgaggtgggaggattgcttgagtccaggagttcaagaccagcctgggaaacgtggtgagagctagtctctgcaaaattaaaaactaaaacaaaaaaccatggtgagaggtcattacttgactctgcttgcttcagttttggagtgcagttctagggttgggagatattccgattttcaagagaagttcaaaatcaggatttttatttaaaatcttttgactttaaatggagcaactaaatcagatttaaagaaaaaaagttgcagggggccaaacaaaaatgtttgtcactggatttagctctgaaaatgcctgtttgtagccattgtccttaagtattgtgatgactgaggatagttcaacctgaaaagttgtatagtttgttgtgattctgcagtaaagaaggttaggattctctagcttagggaagatcagattaaatttgtttttcctatcacaacagcaacacaagacacacaagacagtgattcttcctctctgcttttattcctgcttatgaggacagcctcttatgtaggtccgagacagtattcagtcccacactataacactgcctctggggaattgctttcgctcagtacttcacggtgaattaccctctcgcatttggtgtccaaccctgggtttctctctagtctcttgcttcactcactcctgttcctgactccttatcagcagtctgtggctaagtgaatggatttgaaatatctttttttcttcttcttaacacttagcagttgtcataatgatgggatttttgaccagaagagtttccaagatatgaactgtggtcgatctgtccatgatgtcttaatatattggttcagttatctcatgcattaattttctaaaatttaacacagtgtgtgtgtgcacacttccatatacacacacccaacattgagagaaagattgatttaaatgatgctgttggagtgtgtaattccattgaatgaacatatacccaagaataagcataagatatgtgaatcttgtggttcttcagtcgcttgaagtttcttgtgtcccatagtgagagcattttgcataagaatgagtgtaatctgtactttatgggtgattaaagagttttcaaggaaaatctttaattgtttggaagttttaccctatcagctgactttagcaccgagcagcttcaccagtcagcttcacttcaacctgattggacaggttgtggcgactatggggtgaaatgtattaggatcctctgagctattttgagcattaaccattctggtgtaatcataatattgtttagattcatatatgggcagtatcactgactctttcaaagttacttgcatattttttgggtgaatatataattattatctttggggagcgttgcattgagtcttgaggatttcatgttcctacaaaggtagtgtttccaactcatcaagatttcctattaaggctgggcatggtagctcacacctgtaatctcagcacttcgggaggcagatcacctgaggtcaggagttcgagaccagcgtggctaacgtggtgaaaccccgtctctactaaaaatacaaaaattagctgggcatggtggcacgtgcctgtagtctcagctacttgggagactgaggcaggagaattgcttgaactcaggaggcagaggttgcagtgagccaagattgcgccactgcactccagcctgggtgacagtgagactccgtctcaaaaaaaaaaaaaaaaaagatttctgattaacattgccttaaacattgtgattctaggcagtgagatgagatgcctttgaacctttcttttttttttttttttttgagacagggtcttgctctgtcacccaggctggagtgcagtggcatgatctcagcttactgcaaccttcacctcccaggctcaagcgatcctcccacgtcagcctgtcaagtagcagggaccacaggcatgtgctgccaccaccatgcccagctaattttgtgtatttttaataaccaatttatttatttaaatacataaggttttgccatgttgcccaggctggtctcgaactcctgagcttaggcaatccacctcccttggcctctccaagtgctgggattacaggcgtgagacaccgcacctggcctctttgagccttttgaaataatgatctcaggaccaggacagagatgcttctgtcttttttttaggtttgcacacttattaaatgtctcttgtgggcttgttcaagtgtgtctgggttttcatatctcttaagtaacttatgaccttcctcaggtatgttaggagcctgaggcctttacctaataagctatcttccttactttagctgtagaaggctgcaacaggataggtggctgaatcagttaagataaactaggcttcaagccagagctcgggctagaaacaacagaggcttatttctcacttactacatgttgatcatgggtaatgtcatattgttctttacatcatcttacttgctctggcacccagattgccccagcagctactatctagaactttggagttgctgtggcagaaggaaagagatgtggtagtggtaacttgttcttaaattacagttggaaacaacacaagtcgcttctgtggacatttccttggccagagcagcgtaaataagcaagcctggcttcaaggggatgtgaaagaaaactcgcacactgagggaaccagctcttggtgaacagtaatacaatttaccacagtggtcatcaagggccaacggagatgtctcaggctctgcgagtct

SEQ ID NO: 532 - DNA, 255418 bp, Homo sapiens
aagattgttcagggtatatttaaattgctttagaaatactaaaaaattatggcttgtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaattgcgatagagtcttgctaggttgcctgggctggtcttgaactcctgggctcaagcgatccttccatcttggcctcccaaagtgctgtgattacaggcatgagccactgcacctggcctgaagatgattgttaatgtccttaagtcctttgccctgggcacccctgtgccttgctccagtgattacttgtcttcctctctatcccttccattcctctagggaactacatgtgtgaaaaagcatatctatacaaccccctgagcccacctcattatgtaaccacttttaaagcatcctcaatcactagaaagaatagcatttagtcgagccttactgatgcctgcttctcaagccctacaaatggtgctgcactctagttatcacttccacattcgttaacgtcgttgtcttcatatctgagtcactgttgccactctcagattataattccctagagaagcagttgtaagccaagggtgtttaaagatcttttcgtacttattaaacagattctcaaatctctttcttagagattacgattttgcaggtctggaggggagtctctgagactgcatgtttgacaagcccctaaatgatagtgacataggtgctttcctgacctgctgggaggtgggggtgggaagccagggtagagtcacttatcaaggatagtgatgatgtgcctccttatgggccccacacagagaggggagatctgggagtgaggagtagaatcaagttgccagatttaataaataaaaatacagggtgcccacttaagtttgaatttcagttaaactatatctctctctctatatatatatatatttatatatatctctatctatctatctatatatataggtttttttttttgagatagagtctctgtcacccagactggagtgcagtggcacgatcttggctcactgcaacctccgcctcccgggttcaagtgattctcctgcctcagcctcctgagtagctggaattacaggtgtgtgtcaccatgcctggctaatttttgtatttttagtagagacggagtttcaccatgttggccaggctggtctcaaactctggatctcaggtgatccacccatcttggcctcccaaagtgttgggattataggcgtgagccaccatgcccggcctcagataaacaataatttttaaatgtaagtgtgtcccacatagcatttgggacatacttatatttttttaaaaaaatgttctttgcttatctaaaattcaaatgtaaccaggcatcttttatttggcagtcctacaataaaatgcagttgtgatggacttttccaaccattgctcctgagtagtgctgtgtagtgtggttcacatacccatctaggaagtctcatgaaggcagcggcttttggatattaaagaatgtaacagagttttagagagtgcaaacccaaggcatacggactttgaattttatctgaccggcactgacatgctgagactttcagattggaaagcatttgtggttactgcatgtatgtcccaaattcttcccgtttagtttaaaagatccaaagaaatatcttggttaggtaggcttgagtctagagaatttggaatggttatacatttactgacaataaggattataaaagaagacctctgtgtccaaggcttacacgtaattagggagggtaaagccacctgcacacaatgctagctagcagggtattttaaaaaactgtgcacgttggggtactagaaacataatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtctacttttgaattgtcttcgtttctgccttcctactaatgtttttctctctgcctggtctaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctggccatatttagacactttttttaaaaaaagcaggaagacacaatgaaaaacagtacagcctcaagtatgactgttttctgcattggaaaggtgtcttactttaaaacactcctaggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgtatggtcagggtatacttttattgatcctggttgggatagataatgaaatatgtgttaggcagctgatcgttttggataaggaaatgacttatgaagggtaaagagaggctcttagtttcattaagtcattgacatgaatacatgtcctcactcttactacctggactgtgaattttccagtccatgttctcattctttccacaaaaaaatactctcgctgggtgcagtggctcatgcctgtaatccttgcactttgggaggctgaggagggaggattgcttgagcctaggagttcgagaccaacctgggcaacacagtgagaccccatctctacaaaaaataagacaagttagctgggtgtggtgttgtgtgcccgtggtcccagctacttgggaggctgaagtgggaggatcacttgagcctgggaggtcgaggctgcaataagccatgatcacgccacagcactccagcctgggcaccagtgtgagaccctgtctcaaaaacgttaaaacaaacaaacaaacataaaacatctctctgagttttactaggtaatatcatcccttctgattcaattcaagcatttaccaactccagttctttataaggcaggctgtggcttggtcagagtatggggcgaattgccattttaagttattttggaaatatttagtaacttaaaagaacattttcagtgtgaatttttctcattagaatttaaatgaggttttcatcttactttgcagtaattaaaaggcctgagggataatcagggtgaatcacttcaaggagatagtctaaattcagactcttcgctatttgaagggaaaatagttcatttgtgaatttaaaaactatacataaattatggtttgcattattttcctccagcatgctatacattaactttgaattctatattcacttggtctttttctggcttttatatgaggattgaattaaaaatgccagaataaaatttctcagtccagcaaatgcttaatgcatagctttaaaaggcagaaactcaaatcaaaaaagcctgggcaacacagcaagaccccagtctctgcaaaattaaaaaaaactagccacagggtggcacacgcctgtagtcccagctactcaggatgctgaggtgggaggatctttagagcccaggaggttgaggctgcagtgggccatgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcacgcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaagggaattgctggtacaatataaaagttgtgtttttatttttagatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaagtaatattttaaatgatagaatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtccagttttggtcctctggaagccacaggaacatttcaaaaaaattgataatctgaaaaaatattttttctgaattttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtatatgagcgttggcattatgagtgttgtttctaattttgatagaaattgactgcagtatattgagttatgtgaacaaactcatttcatttctgaaatctggcacttttgttcattaattttctattgaatgctattaatttatttctacaatgcttgttacccatgaataatattttcaaaagaaaatcaacacagagataaaaagttttgttaactgaaggatgcatcaaagttcctttattgccatcagaggcaaaaatgagtaggtggggatggatggttgcctggctggctagtttgatggactgctggcagaaattaatgtacctctcaaaaggattttaagcttctttccacatagacaggatataatggaagaaaaacggtgagaaccattatgccaaaatgtatttgatattcatattgctggggaatacttcactgagatcaatcagctatttagcagcaaaagaaattgttgtggcatggccaagagaagactcatcccatactttctgagtaccttgcttttgacattactcatcgtagacactgaatgacatttggaccccacagaggcagtctagtctattgtgattgatttcttcccacatctttagagttacttggttcagtgataaattcagctactctttcttttcagtcctttttttcttttttctttggtctctacttggttatccattgccactgcctaattcatcacctccacccaaatctccaactattttggagttatttttgtcagagatcagagtatcccagcatctcactatcctcaccattggaggatagattctggcaacttcttagtgagcattttctctacatatttttaaagacaaatacattgctggcagaaacgtcccaaagagtcaaatctagacgatcattttcttgcatccaaaacagagtagtagcaaaatagtagttccttcctgatgtggaactaatattttatctgactttgattagactatgtatgtgttacatctcacatcaagactcacttgctgtgctgatctgagtaagcaagtgactgtcttccagcgaagtatgttcatcacacttctgagatagatttgagccatgggtgtagaagaggaggctctggatatttcatgacagcagtaattttcagactgtcctctgggtcccttcagtggattcaccccttcaagaccacccttcctcttagggcagtgacacctctgccttttttacatattggactttcctaagaaaattgcaaagaaacgctccttaaatggcagtctccccgactggagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataaacttgggcacttattttcatttcagcaaaatcacaaacatgaccttaaattggttaggggagtcattcattctgctgtcctgatgtcttttgttattttggttgacttactgtgaccagtgtgtacttgtttggactacggagtagttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagacaaatttagggttactggggtggtggaagggtaggcagaggaagaggggagaatgaagaagactgtttaagtgacaggtagaattttaatagaagaaataagaaacattgctttcaagtataagtctcagtgagatgaattgtagctatactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtactttctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagattatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgtttttgagtacacatagtgatgcatgatgtgagccattaaaatttcatttcattctggatttcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaaagctttccaaaaaacattttccagctataattattaaagatttagtatcacttaactaacatgggaaatgcccacactaaaatcagggcattgtatttctgaaacggaaacctttcgcaaagcctgtgcaggcagaggagctcacacacatccttgacgtggcactgtgtcttcaggggtgctgccctcttacagagagacagatctggaggccatggccgttttggtgagaaatgccagaaacagcttcagtttccacctactgcttcatatttataatcacagtaatctatttctcgttttgctatttctagagcaacaaattgtgtgatgcgaaattagtaccagaggaacaatgactccacttaacaaaaaaatagcaagggaactatgaaaaatggcacaactgcttaactttaatagttgaagtctttaggagacttcagtagttgaaatgacacagaaaaatcctcaaactaacatacctacatgaaactgagtttctcaaagtaacccacatttatggaaatagaagtttgtcttgcagaaacatcagctcattttgtaaggtgtatgtgatatttaaatttgtgatgcttgtgaataagggaatggggctttaggtctgaggaaaggggagcattcattcaaactggagggtattttgcatttttaaggctgctataaggtcacgaccttggtgagacttaacctgttttcgtatgtattgtgtactttctgttctaagccattgtgtgtgtctgtaactttctccaagattctctccaaatcttgcttctcttaatttctccagattgtgccaacctatttcccactcctgatctttagtgttatatcaccactaggagactggggaatgtggtttgtgttcttagactcaacagatacctaccatatgccaagcattcttctaacagctagtgagagatctatcagtgaacaaaacagacaaaactccatcttttttcctctgctgctcatattctagtgttaaccatttgcatatttctcagactcttcaatacatttattatttctttttaatcagtttattctgaccctcagtagatgacatatttcatgggtgtagggacagtgccatctatctcccttggggtgttcttacattcaagaaatgggttttcacacaagtcctgtcaaatacttaattccttacacaatataaagggattgagtttttcaaagataggctgactacttggaatgaaaagcatttaaatactgaagagagaaaaaggattctcttttcaacccttcatattctcggaaggaaaactgaaataccgagttagtatgtcctcaaccctggttaatttcccttgcaaacaaagagggacaggccttggtgtcagaagctttgccataagatgttacctagctaggatttttaaactggttttcattgtattttattaccttcaattaagaatagtttaaaacaagtagttttccatttatagcagtaaaataaatttgttcaagtatagcactgaatggatttaaagaaaaatagtaaaatttcaggtggtaaatatgataaaaagcatggaagtgataaatggttggctaaaatttaggactctgcttgacagtatagcattttaggccaggcacagtggctcatgcctgtatcctaacactttaagagtctgaggttggaggatcacttgagcccaggagttcaagatcagcctagacaacataaggagatccccccgtctctacaaaaaaaaaaaaaaaaaaaaaaaaaaatagccgagcatggtggtacacgcctgtgatctcagctacttggacgtctggggtggtaggacagcttgagtccaggaggttcaagtcttcaaggcttcggtaagcctgggcaacagagtgagaccctgtcttgaaaaacaaaaacaaaaaaaacaaccaaaaacggcattacccagaacctatctactttagaacaatagcatgccctgtctgctccagctgcacctaataccagagggaactgctccaactccaaattaaaaacattatcagtgatcagaaacaaaagttccgttatgagaacctttcaaagctcagtaatagcttaaactcctggcttcttaaaggattagtaacactttgatatctgtgtatatttggctcacagaggagaaccaaataacattaccttgaaaatctaggactaagggaccttatgaatacagagggaaactatccaaggaacagacaatagcagttttaattgagtgaataaagtgatcttggtttcaaattcaactgagaaaacatgactttctccttttttctttaagagggggctactgttaaccagacatgttatctgtagtcccctgggctctacactgagaaagatgatcaagaaatagataagcctgttattcttccaaccgatggttccaatgagcacccatatcctagtcatgtgaaacaaaggggtgaaacaaggcgggtatcttggttcatgctttaattctctatttttctctgagggactttcagcatcagtcctttctgagggattaagtatcttactaaggtgttgactcttattgactacagaattcagctctttcatttagtcacaaaggcatcctagaccctaagagaatgcccatattgtagtaaagcatactatctgtagctagctttatcacaaagcctttacaaaacttggatttcataaaatcataggcggcctctagggctatcttttccaaggagacacatacattcccccttagtgttgaccctatacagaccaggcaggaggtgacacgggttaatttaaaacagccagccacatatatcgggcacagccagtgcccgatatagtcattacttggtctgtcttttggagtgcttcaaggagtatggaacaatcctgcaggaataggacataggatcctttccttttgataaggagcaggggttctgaaataaccagcaggtaaagattaggccttggggaggttctgatgagtctgctttggagcctctagacagcaagagaatagtataatagtataatacaactcaggttatactgcagaaaatgaaacataatagatggagaagtccatgcctaccataaacgtttgaaacctttgcctagagcaggcctttcttttctttcatttgcaaatttctcctgagccacctgctatgtacccagcactgacaatgaaatgttggggtggggtagaggtagggggtcacaggggagtgtccaaacacactaggtcctcatgaaatttttacttttgtacttctaaacgtcttacatggtctaaactattctcatcgataccacttccttcccctccttcttctgccattcatgtaacatattcaacatatccaacggataatgatacttgactacctataagattaagttgaaggctcgttctgtctttatcaccattaaatttaaataagaacaatagcttacatttatttactactttatagtgcatagtctaatttcacatataaatctcatttccttcccaatagctttgtgaagcttgttattctttcattagtgtatcagacactttagaggtggaatgcaggcatctattttccaatggtttttaatgttgattgagtatcagaaatgcctatggagttatattttcttttaaataagagtacagatgtgcttgaacacttagagaatctatcgcacagttgtggaattccagcaccaaattaaaatatgtgtgcctgtgtcactacactagatttttggataaaatctagtcagtttgattgaagtgcaattttgttagtgttccaataatatgatactgagttttaaatatatcagtgtatttagtagatgaccaactttcaactcacttgggccccttacagccaaggctggctgcatgggcctgcagtctgtgcacggggccacatgcctagaagagccttgtgtttggtttaatgctctgctgctgctgtcttgaaattcttaatgaattttgaaaaaaaggcctgacatttttattctgcaccagttctgcttaaagccaagggcgtctactgtagggttgctttagcatggttgtcctaatgactgaatgaaaaatgtggttgaaaaggctgcttttaaaataagcaatgaacagatcgatggttgagagttgggcgggttggggaaggtgcagggtgaggcagattatggaaggtgtgagctggcagactcagcgggcatggaacagaggccctgtgatggcgctctgcagccttgggcaggggtgaggaggggagggcttatgctgtggggatggcaagaggcagctaccagtaggggatgcacatgtgagccttgaatgaacctttgctgggctccctttccctttttgtcttccctctccaaggcactacttacttttcagctcccaaaatatggggctcagaagtggtcaatagtgaggaaaggagtggtaactgaaagaagtctagggttctctgggtggaaagactcagaggaaacattcaaaccttgatagaaaggagatgaaaaatccatccttgcctattgttgtagctatagaaccccaaaagcccttgggctgcagatgtaccccccacaaatctatttatggtctaattaaaaaattaagttgaacttaatcataacagtgtcttcttcagatatgcttatcttctccgtaggtttagttgacatatttgaaatgttttaagactaaatgagccgggtgcagtggctcatgcctgtaatcccagcactttgggaggcctaggcgggtggatcacctgaggtcaggagtttgagaccagcctggccaacatggcgaaacctcgtttctactaaaaatacaaaaattagctgtgcgtggtactgcatgcttgtaatcccagctactagggaggctgaggcaggagaattgcttgaaccccgggggtggaggttgcagtgagctgagattgtgccactgcactccaacctgggtgacagggcgagactcctcaaaaaaataaataaataaaaataaaaaaaagactaaatgaaaatgtcacattaaaatgactatacatttttctaattctggaaacccaatgtcttcagagttctcttttaaaaacctcaaggccaggtgcagtggctcacacctgtaatcccagcattttgggaggccaaggcaggaggatcacttgagcccaggagttcgaaactagcctgggcaacatagaaagactctgtctctacaaaaaaattaacaacaaaaaaaattagctgggtgtggtggtgcacacctgtagtcccagccgcttgggaggctgaggtgaggggatcacttgagcctgggaagtcgaggatgtaatgagctaagatcatgccagtgcactccagcctgggtgacagagcaagacccactctctaaaatatatatagatatgtatatatgaaattaaaaactcaaaagataaaaacctcttgattcctctgactgccacccactaaggagaaaattcccttttaaaagctggaaggtaattatatctcagcccagagtagagtggtgctgacttttctctttatggaaaatatttaccttctttgctaatataactaaaggctacaactttccataaattcatcataaaattgtgtttcatgactcatcattatctagccccttttgcctcgaagatggttttggttgtaactggtatctccccagtctctcaaaatatgaacagatgtttgttgcttctgttcccttctcctccctacctgtaatgattaaaaaggtattctctgagagttttctcatctcagtgtgaacttagtcataacagtaacttcttagtcataacagtatcttcttagtcataacagtatcttcttcagatatgcttatcggtcaatttttccatatttatattttaaattttactcttaaaaaatgaagttcttgctacataccaaatgctttaacagattattgtgtgtaatccttacaaccacctttatgacattggtattattagtcccattttcagttcatgagactcaagttttttgagctaataatttgcctaaagacatatcactttgttaaatgtctctggttcagcctgtgctggttcagagctcacactagggatgtagcctggctgttggaatttgactcctagccctgccatctcctggccaggtaaccttgagcaagttacttaacttctttgttcctcagattccacatctataatgtaacaatacctactatgtaggtttgttgtgaagtttaaatgaggaattatatggaagacatttaaaatagtgtccagcataaatattgcataataaatatcactattattggtttccaaatattctcctaatgttatggcccatcctgctgtatgtcactgaacccaagtatctctgaataactccatcaagtgctgacagccagaactgtcaattccagcttatcagatgatagcatacataattattcaagtcatgaacagcagaggcagactaagaaaactttgaaaactaagatagtaaacagacgtgagaaccaaatgcaatatgtgatccctgactggatcctgaaccagaaactatttttcttcttttgccacagaagacatttgtgggtaaaaaatgaaggtctgtaccttgataatagtatcgtattaatgttaacttcttgattcgcaatcactttctgtggtgactgtagataatatcagtgtttttaggaaatatacactgaagtattgagagataaaggggaattacatctataacatactgttaaatattataaataattaaattcatatgtacagaaagacagaagaaaggatgattaacatggtaaaatattaacatttggcaaatataggtaaagggcttgtggaaagtatttttttaaacttttctataagtctgaaattatttcaaaatggaatgataaaaatattaatcagtagaaagaacagaaagagtactagatttggagttggaagaattgagttttattctagccactatttcctagtgctcttaggcaaatcatttagactctctgagcctgtctcctaatctaaaaattgaagataataaaacctacctcattggatttagtgggcatgtaagtttctgggtgaatttataaagttgtagcacattatacaaataatacttttttaaaaaggacatatggccccatgttcccactctgaaactagtagcccaggatgggctctgctacaaatcagctacagtaaagcttcagggatgggttttctcagttatgaatgccaagcaagcagaggggaaaaactcaggtgaccttgacacttcctcttagaaattcattttgtggctcccagagaagaaaagattttgacagggaacagtctatccttaaaaaaaaaaaaaaaagatttcaaataaaagaaattgtagatataaagaccagttctcaagattggtgattttcaacttggttgtacatcacaatcaccctatggatctttaaagaaccaaaaagtagatgcttacacccccaccctggagagtctgattcattaggtcttgggtaggtcctagacgtccacattttcaaagagcttcacagacacttctgatgtccactggggttgaaagccactgccctagtattgtttataaggactaaataagatcctttatacatagtgctcaataaacattaaccctaatctcatcttttcctttctctgtgcctcagaggaatgacaaactgaaattagaaatgcagatcttgttgacaaatgatttacaataaagtttctggatgaagaaaaaaaaagaaaactactgtcctagatagttagtcaaagtaggtgcctccgaaatcagagcccaaaccaagcccatctgatatcattatatgtgatctggggaaagaataaaacccctcacttaatttggcatttactagtatccacagtaccttggaggcacttaacatggataatgtgccaaggagacaggtaggcctcaaaagatgaagtggggaatatgggcagaaaagcagagtaaacttcaacaggattaccttgggtattgataaggaaataaagcaggcttacaagatgagttttataaacaataaacagtgattcgggaaaaggatcttggagtatgtcctcgtcattccctgaatacttgggccaagactgctgtctacgaggccatcaatgctgatatgctgagtgtcctcataaaggatgttgtcaattaaacccaaggaattacagtactctttacaagaaaaacaaaccacagaatattttatttcttgggaagttcctattgctatacttcatacacatttcagttagaaaagctccaagacaaaaataatagagttagaaaatagaaataaaaattttttagaagatggaatgcctttttttttataaggacagatgagaaaagtgaaaaagctcttagattggataaaagctgagagaatacataatcagaattcatgagataatgaagtgaatagctgggatggactttgtcacttaaaattggaaagaaattgtgaaagcatatgctgaggtaatttaagatttaagagaaaattacttcatatattgcttcatttaatttttactgtgaaatgtcattatttctactcttcaagtagataaaatgagtctgagaaaggtaatttttcctaagtcatgaagttggtaggaggagaagctggggatttgaactcagaccacctgactccagagtctgtgcccagaatcactatactcctggacctcccttatactttagattttccagaaggctaaggaaagcctatatggcatagtaagattcaagttcaactttaaacttttgatttacctttgaactcaagttcaaatcaagtaaaagtcattaagagctcagctaacatctttctattcatcacttctgtatgctcacagcctttgggctgattttgaaatagaaatgctagtcttgcaatattttcagctaagccagaataagataagatgtgttgttttcctaggaattaatttctccatttctagtcttcaagttttagtaaaacgatgcttgatgacttacagcaataaattcttaactggtaatcaaaaaagaataaactgtacttctgttcataaatagaggaaagaaaaagaagcacctgcaatttgataattataataattcattatactgcttacaaaggatacagagacagtatggcaaactagaaaaacccaggattactagttaggagagtaatgttctatacactaagccatgcaattttaggtgagccattttccttctttgggcaacacattcctcaatggtaaaaccaaggtgtcggattagaatttgatttcctcaaaacctagaatcatggaatgttagtgcaggaaaggggtttagaggagggcctctcaatctttgtcacctcatggtgcacctagaaaatgctcattctcgcatggcatcctggagccggcacaggaagtggttaaggattggagctgctgcctccaggtctcagaggatcaattattcagctcatttgtaggggagtccaagctttgagaattacaagttcagcctcatcattttccacatggagaaactaatgcctagacacattttatgaatttataacaacccataaattaaagtacatggtatcaatgtattttcagttgttatactattatttaacaaatctatcccaacctgacccccttcagtccattttccacatggtaactggagagacctcttaaaaactataaacctgattatgtcaacgcccattcccctcaagggttgcctcctgatgttttgaggataaagatccatattcttaaaatagcccacaaagccctgcatggcccaatctctatttctccagtgtcacctcaggcttttttttttttttttttgcattttatatttcttctttccttttctaaaacacaccaaccaattccccgcataagggctttagcaagtgctattttctcggcctggagtcaactacctttttcctcagctgacactcatttcaggcctcagttcaaatgccatttgctaaaggaaacctttcttaatcccccatctacaccaggttccccgattacaactcatcctgtctttcactacacagcaataatcagaatttatacttgtccatttccttttgtgattatctgattaatgtctgccttcctcattagactatgagccctgaatggaatgtgtgtctgaataggagctcttgttcattactgtctcctcagtgcttaccaatttctggtgtataggaaaagttcagtgaaatgttcaatgaatgaatttacggtttagttttggctacagaagtcttcctggcaacttccattcattgcactgacagctctgtacatcacatttcttgtaatatgaaacatggatatggttatgccttacttcactctaattagtgaacagtatgggcatttacttaaacttttcactgcaaatattctcaacaatttttttttattgtggacaactttgagatctaataagctacggaccatttcccccccagaatgaatacatccacaacattttgcaaacaatttcagccagtcagtccatggactaaccctatgaataaatttcaaactcctaaatttggcataaaataattatatgacttgagccttagctacctttccatgctcatctgcaattctctaatgtctttttaagctatgctatatcaaattccatgtagtttccctacatggaattagggattgctcctgtgagtagctactacactgtagcctgggcaacatagtgagactccatctcaggaaacaaagacaaaaataaaaaaccaaggtaaagagctaagagaatggatacataatatccctcaaatgagaagacaaactggaatactagcaaataaaattgaatacttgcaatgtgtaattatccacaaaggccattacaagagaatatattatacaacatacacactatttcttcagcctggaatactattctatgttttgttttttttaacatatcctccaatacttggagcagatttcatatctaacaggaggctcatctgattcttgtgctgaaacccaataaggatcaacctcctagcatttacttcctgataggggctttcatgaaacccaggaaggatcaatctcctagcatttactttctgatgtcaatttcgataacaatttttcctggagaatgttaaattctttgagaatgaggagtgtgtcttatttagccgtagtgcctagaacagtgaatggcacaaacaggccttcaataaatgtatgttaacctgagaaggaccaaaattatcaatgtgagaagaagccaggcactgtggcgtgcacctgccatcccaattactggaagctgaagcaggaggattgcttcagcaatttgtttattatacaacaaagttatttttaccccagtaaaatgactaaaaattgcattagcctaaggtatcaatgtcagtatcagtttctgttacagaaaatcatcatgtaaacactagaacaatgaattctttattaaaacaaactgaaggcaatactcagaaaacgtaccattatgatgactttatggaaagattcaaagctatgctgtgtgctactattgtataacgttttataattctctctgccttgtgaatagtaagcagcagattttagctctcagatggagattgtagagtaacaaacaagttaatgggtaatgagaaaagtggagaactttgcacggaaagatatgtacactgatattccaagcaaagaaattatttttgctgttttcaacttgcggtttttattcatttactcaacagattaagctatttctaactctaaggttggtaccaaaggggaccagtatttatcattagaagaattaccattcattacacaatggaatataagcataatgcataatggactttcacagtgtgattgggtagaatccaacgagacggctaattcactcaattctgtttcacttactctggtgctcttctctcttatgccagattcatttgttgtcataaggccagttatagaagcacagtgggaggcggggtggaggtgaggacagaagcattatcagaagcttccatggaggcacagtttttaaaattacccactgaaaatccatagatagcctcattgtagcctctttccagcccctactcttgctcagaccatagtggtaatgacagaatgggagatatcactcactgatagagtagactattctgtaagatgacaaggtcagtaaaagcagtaaataagggtgtgcttacaacaaagatggaattcacaatgtatgttgacccgaatttaaaaacaagaaatagaattatggaggaaaatcgaattgttataacccctagaaacaaaaacagcatccagcacaattgtgagtgcacagtgcataccacaagagatgtgagctaaatgtggtataatatgagagtatagtgggcctgaagaagaaagtaaaaagtggagagatacagcatttcatattatttttattgattcagagggtacatgtgtaggtctgttacatagatatattgtgtgatggtgaggtttgggcttctagcatacctgtaaccataatagtgaagattgtactcaataggcaatttttcaatcttcatcctcttctcactctccccgcttttagagtccccagtgtctattatttccctatgtatgtccatgtgtaaccattgtttggctcccacttacaagtgagaacacagcatttaatattatcggagggagaaaagatcccatactacacatttgtctcaaataataaatacatctgtggtttttcaaagaataagccctaatttccaaggcagacttcctagtccatagctataccatgagatggaaatttaaatgctacagtgatttggggtgattcacacaggcattctgtataaattaagcaaaaatgaatgtatttatcaataattacagataaactcaccaaaagtacagccaaagccctttggagtatgacataatttagcaataaaatcaggtggtgtacctaagggacagactataacatacatattctttaaatcccagtgacctcttcccaggggttaaatcagaggagtcatatcaaatccaagaaatatcatctttgaatatatttcaaaagcctcaaatgattaaacccaatgaccttttaataaatgtaaaataaatacacaaggatatcagctctaggtctgccttactccttcccttccttccacagccatttgtcaataatcaactaagttactgataaacagaggctaggttcttgggatacaaaggtaagacatggcccctgccctcaaggagttcacactaaggggtgaactacacagaaacaaataattatttaacaatacaccaagtatgttaacagaagtatgtataaggacaatggggacaaagaggagaaagtacttgtgattttgttcctcatatgacacattattattagaatgggagatgagaattatgtacttggtcattcaacaaatactgactatgcccctctcatgggtaagcacagtgaaatcacagtgagatcagaataatcctttggaattccaggggcacgtgaccttctctcatccccctcaagaactcaaaggcctcttgctgctgacaatacagcagcttgatagttaagaattttttaaggaataaataactttatatttttaatctaaaactgagttggacaagtttgtgaataaaaatatcagttaataaggataaaacctaagtaaatatctaatcattctaattacttttgagggaggccaaatattctgactctatttcctattatatcttccctcatgcttagtttttctagtctcactccccatcctatcatgaactctaaagaaataatacttgttacatttaagatcacacagaaaggcagtgaggttagagagtataaattctggacccagattgcctgggttcaagtctgtgctctgttatgttctagctgtgtggccctggggaagttgcttaactcttctatgtttcagttactcatctgtaaatgaagtcgtcaattaatgcatataaaacacttagaccaatgcttggcatatggccaggactccctacaagctagttaatattcctaccatatacataaaaataaaaaatcaataagcaataagaaagagttaatgcaaataaatttaatagcagagctatcttttaaacttcatcaagagcatgactgtatcaaattcgtaactatatcaagtaagcatttgcccaatatgagatttaaaagtaacgactatagtagtttggatttcatctatgcttaagaaagtgtgactttgctgtggataagatactttcaagatgttgtcttattgctatctttgtggctaaattaacattcagattaaaggtgagaaggatatagcgattgttataacttctttcacaattatctcacagaaaattgctcatacaatattatttcttgaaagaaataatttcaatttcttgaaagaaaatttctttcaagtttcttttattttattttttttttgagacagagtctcgctctgttgcccaggctggagtgcagtgctttgatctctgctcactgcaacctccacctcctgggtttaagcgattctcctacctcagcctcctgagtaactgggactacaggtgcacattaccacacctggctaatttttgtattttttgtagagccaagattttgccacgttggccagactggtctcaaactcctgacctcaagtgattgacctgccttggcctccccaagtgctaggattacaggtgtgaaccactgcacccggactcatttctttaaaagctttccataacctgcaaaaccttctcaatacatgtgctcttgaaaacattgagcctaatattttcctgttagactagtcttctgtttcctcttaaaacaggaaagcccataactgtctaaaggacaaagaacagtagtaggtttaacaattttcaccctaaagccaaagtgggagtagctgtaatattttatgaatgaaaaacaggatgaattctattagggcaaccatgttttagactcctttctaagtcacctcctagaatttttaatcagtcacctaagagttacttattaactcaaaaactgcttagtcactgactgaaaaatgaggcagggagcagaccaaagtcaagagttcagggtcaaactgcagagagcaaagcacaatgagtgaattggtttcatctttctcctcagtcttccagagccaggaaaatgaagggactggacagtgttggtggttggtaatgtgaacacaataccagctgtcttaggtgagtagacacaaaagtcacaggttaaaaagggcactttgtctcccttacttgatatgtggatcaaagccatgtacccatacatgtattgtccttggcatcttttctcagttttctctttcacaagatgcccatacacacaatatattctataccaatgctcttctggaagttctttcaacttcaagattactagaaataagagcactagtgagcatatctatttgttagttttaagtaatatttaacttgcagggcgcagtggctgacgcctgtaatcctactttgggaggccgaggtgggtggatgacctgaggtcaggagtttgagaccagcctggctaacatggtgaaatcctgtctctaccaaaaacacaaacaatagccgggtgtggtggtgcatacctgtagtcccagctactcgggaggccaaggcaggagatttgcttgaacctgggaggcggaggttgcagtgagccaagatcctgccactgcactccagcctgggtgacagagtaagactccatctcaaaaataataaaaaaataaaataaataatatttaactaagagaagttaatattttagttacacatttctctctactgctagaggattatatttggttattacagtatttcccccttatccctaggggatacatcccaaacccccagcggatacctgaaaccacatatagtaccaaaccctacatatactatgttttttcttatacaaacatacctatgataaagttgaatttataaattatgcacagttaagggatcaaaaacagtaacaatacaatagaacagttataacaatatgctgtaattacagttatgttgtgaatgtggtctttcacttaaaacatcttaagtactgtattcatccttcttgtgatgatgaagggtcaaagcagaacagcatgagattgcatcatgctactcagaatggtgtgtaatttaaaacttacgaattgcttacttctggaatattccattaaatatttttgaactacagttgattgagagtaactgggaccaatggaaagcaaaactgtggataaggggagattactgtgatactgacttattgaattcggattatacagttctgatatgagccagtcttttaacatctttctagtttatgactttgggtcccttcatgattcttaatcacttccattcaattataaaatacttattttattagctgggcatggtggtgcatgcctgtagtcccagctacttggaggctgacagtggaggactgcctgagcacaggaattcaaggctgcattgagctatgattgcaccactgtactctagcctgggtgacagaatgagactctgtctctagtttacaatatgtatatatattgtctctaatttactctgtatgtctgtatgtgtgtgtgtgcatattaagcccataacaaatatttttgtgctctataagacagctgagaaaaatatatttaagagtctaagggcaagctagtctatctgtatacttgttataaaaaaggtaaggtatattgtaaatacattgcatttaatggacaaatagttgctagtatctctctggatttcaagggcccttgctaaccccttaatttctccattatgataaaagatcaagaattggccaaactcacttaatatattaacattactgaagatcatcatagtaaaggcctacaaaatagagacaagcattgcttagtggtgatggaacaagcttttgattttatttgtttttaataaacagtaggcaaagggatattttggttgtctagaaaaaacatgtattctcacttcctttctattaaccagctaacttttgcctctcaaacttcagctacaaaagggaatcatccatgagtttaattgtactgccaggtgacagacaagagggtttatatgatgagaagagaggctggaaaaggaaaaaaaaaaaaaaaagaggagcaagttcagataggtacagaggctagcacctgggtactgacctttgaatttcttgcaaggcaatataatttgctcttcaaacataaaaggctacactaaaagaataaaagccttttccccgctatgttcctataaaactttatttatggacattgaaatttgcatatcacatacttttcatgtgtcacaaaatattattctacttttgatgtttttcaaccatttaaacatgtgaaagccattcttagctcatgggccgcacaaaaacaggcagcaagggatgggcccttagactaacattggttgactgctggattggagcattagagcttgggtatgagtcccaccccagggcttccaggagagggggcccaggctgatgccatctccaccctcattgctctaggcgggaaggcagagctggtgctgtatgaggtgtggctgtagatcctgggccagcccttcaccaaggccttggaagataaaaccagtcctgagtcccgggtgcttcaggggcagctgatgaaatgagtgaagtggcaggatggagtgggagatcagggaagaggcctcgaggggatggaggatgactggacaaggctttggtagaactgtgaccctcttcacccgctcctgactccccagctgaccaccatcctcagacctctacagaacttgacctactggaggtggagggattccaatgaatccagggtggccctcggtgacccagggctcagagctggacttggttgagggcaggaggctggaagagatgacctccgctagtcccccccaggctgtccagccccctgaagcctgtgatgatccttccaccaggccagacccactgactgccagagtgggtgccaccttcttgagggctgtgccagcccaggcccttgggtaagaatgtgtgcaccagtgtctggacaccctgtgggaggcagagggcctcttggtagagatggtcattccagacctcggtcagtatctctttccctctgcagaccccctccctctgtctatgtcctctgtccatctgcctcctccctcgggttcattgcccctacatgacctgatctgaagcctgcctcctcagcctgccttgcatcctcatgggagccctcccatgataaatttccaatttatctttaaaaatacattatttgaaaccagatttgttaaagcccataatcagttgaaatgaaaagaaaatccagatttgtgtgggttttatatttggtaaaaagataattaagtaagttctgacagtgaaattagagttttaacttagctgggatatcatttataaaagagcctaacaggcctgacacgaaacaggcctgccatagaagttatatatagcctttcctttgactctactatatttattttctaatggacaagttaagtatagaatggtaaagataataatttaaaaagataataataataaccaatatttaattgaatacttcctattcttattgttttacctatatcacctaatctatttcttgctgctgctctctgaggtaagtactattattattcccaccataaagatgaggcaattcaggcacaagagtttaacctgcttgcttggacagctagtaagtggcagagctagaattcaaacccaggtagtctgattccatatgcatttgctgtactgaaagtacttaacccagtctgggcacaaagtgagtgctttctatgatcatcattgcttttattattactggatttaagaaaactatattgaatgcctacccactggagaattgaggaatgaacaaaacacacaaggtcactgttctcatggatcatagaggacaggggaggagacagatactcttcaaagaattacaccttgatagtagaaatagatcacttgaaggagaagaaaatttctgaatggtcctattttagactaccaggtccttaagacttgttactggatgatcagagtatacgcgtccattactcctattatctactcaccttaaactctgctgcttggttaaagttttggaacctttatcgagtcacttccctgttcaaaaacctttgatggcttccagttttctagagcctaagtagccactgtgtgtcatacataccaagaaactcccatccagcatttacagcaaacatcagtaatccatcatggtgattttttttttctatttggttgtagttttatcaataaatcaaaaactggcacttgaattgaaacacttttgtcatcgttgacctagtttgctgtatagaaacactggttttggacttagacaaacttgggttcaaatttcagctctctgccactcattggtggggtgatcctggccaagtcatttcacctatgggagcctcactctcttagcatataaaatggagataatagaaactattcaacagagtttttaggtaatgcaggtaaacaatttggcatagtacctggtatatattgcttagtaaattaaagttattatttttatcactgttaccataatgttcattattgccatcagaaagctttccaaagtctccacaatctagctctaatttacatttccaaatttatctcccatactctaccaaaggaaccctccacttcaaccagaggaactcaatgtctcctaaaaccagcctgccatgttctttttctgtgtgtataaaaatctgccttattcttcaaataccatttcattaaattcatgaaatttatttcatgaaattttcctgacccccttcagccacactcatactgctctccattgaactctcatacttactgtttctaacacttcatcatacactatctggtaacattctcttatgctggtgtttaattttatattacaatttaattttacatttttttttatcttttccatctaaaccctctacttttctttttctttgagacaaagtttcgttctgtcacccaagctggagtacagtgatgtgatcatggctcactgcaatctcgaacctcccagcctcaagagatcctaccacctcagcctcctgactagctgagactttaaacacctgccaccatgctcggctaattttttttttttttttattttttgtagagacatctccctctgttgccccgactggtcttgaactcctgggctcaagtgatcttcttgccttggtctttcaaagtgttggaattacaggtgtgagctattgtgcccagtcaaatagggataatcacattttattttttgaaacagaatctcactctgtcatccagctggagtacagtggcatgatcacagctcatggcaactttgacctcccaggctcaagcaatcttcctgcctcagcctttggagtagctgagaccacaggtacatgccactacacctggctaatttttgtatttctttagagactgggtcttgccatgttgcccaggctggtctcaaactcctgggctcaagtgattctctcacctcagcctccgaaagtgttgggattacaggtgtgagccactgtgctgggcagaaatgtgtatcttcaaaacaatacctggtgaaatgactgcggattcatatcaatgaatgaatgaaatttaaataaaataacatgtggtagttaacttaaaattaagccatggattaaggagataaaattaatttttaattcctcatgttacattgaagaactcaatattataaaaaaatctctggctttttattttgaatttgaaaatcagaggccaagcacggtggctcacacctgtaatcccagcactttgggaggccaaggtgagcagatcaggagttcgagaccagcctggccaatatggtaaaacaccgtctctactaaaaacatgaaaattagatgggcatggtggcgtgcacctgcagtcccagctactcaggaggctgaggcagaagagtcgcttgaacccgggaagtggaggttgcagtgagctgagatcaagccagtgcactccagtctgggcgacagagcaagactctgtctaaaaaaaaaaaaaaaatcagaattttctacctttgtccattagtcctagttaaataaatatttttaaaaatatttgtgcccatgtataagtgttaaagaatactctatttctccaaataattataaaggattttttctttatttttaaaatatgtttttaaaatttgtataatttaaaaaaatttttttttaagatagagacagggtcttgctgtgttgtccaggctggtcttgaactccttggctcaagcaatccttctgcctcagcctcccaaagtgctgggattaccacagcacctgtcccaattttctttaacatagataaaatcaccactcgcaggactcaactagtttacattcctctttgacctatgaaatgtgatatatgttttccatatcaagtttgaataaaattatcaatcaaagactccataagcatgtgtaacttagcccagttgctcccaaccaccagatggtgagggtctaggatgacatttcactgctttctggcaaaatgggaaaaatgagggcaacaaagcagtgatgaagcaagggttggcaggagtagtccaccctggggaaggggcagtattttctcactgacgttgtttggaactgcctgtttatggtgataacaaaaagcagacaaactattagtggattctattattgttttaaaatgatctacagaagatgcaatgctgttttgcctgtgcctgaagtggactgcttcgaccatcatgcctttggcatgcaatagcaataaagtgagcttcaggtaaagctgaatttattcagttgaagagacagtccattattctgtgataaaatgctgttggtgattaaatgtccttttaaaacaaaacgatgatgatgggaaacaaatttttctaatgtcttcatttgttaaattttaaaaactttatcattgtgtctatccctgaagtgggttttattactgtttagttttttttttttttttgaaatgttccaggtctgtgaaatgtcaaatctgacaacagcttgacaaaaattaatcaagagaacaacttgacttaatggagagtgcacagtgttttttggctcagaacagtggctctccaagtgtggtactctaaaccaatagcatcagcactaactgggaacttgttagaatgcaaattctcaggctctatctcaggtctactgaactagacactggggggtacagcccagcaatccgtatttttaaaaagcccagccaggcatggtggctcacacctgtaatttccaacactttgagagaccaaggtgggacgattgcttgagcccaggagttctagagcagcctgggcaacacagggggaccctgtctctacaaaaaaaaattagtggggcatgacggtgcatgcctgtggtcctagctgctagggaggctgaggagggatcacttgagcctgggaggtcgaggttgcagtgagctgtgatcatgccactacattccagcctgggtgacagagtgagactctgtctcaaaaaaattaaaaaaaaaattaaaaagccatccaggaattgtgctactgtttgagaaccatttcccagggaataggtagagaagatgcaaaaagtgctgagacaaaatgcctggagattcttaaatgccccctgtaaggtcacttttagtccaatgattgtgtctatttattttatatggattttccatagttattaattaaccaatttatacaaaataaattaatctaaaataatcctagagtcttcggcaaatgattttataagtgcctatataaagtgggataaattatattaaatacagttcttaagtcattaagcttgttacttttcagattcagaaggcagcctatctgaagaaaggtggagctggcactgtacttgagaaacagaaagacctatgaacctgtaactccctttgaatctagcaatgaacttatgccccactatgacgggatataggagggaatgtgaaattgctccttatccaagattcttttatctgagaaaacaaccaatgctgatgaaatactaactgggccataaagaattacaatttgatagcttaaggcctcttatattatcatgatgtttttacgatgaatgtagagacttctgaaatatcaggtttgagaaggaagaaaagaatccatgcaaaccattcgctttccacatgcacatatttcaggttttacttgaataaacagcaatgaaagaagatgctggtggacgtggcctttttaattgatacataataattgttcacatttttgggatgctgcagtggacttttctggcaactggcaggtggagggaatggtgagatgtggtacttgaaagtggggctcactctcatcaggtcattgagacatttccgccacataaagagagagagggtatggaggtgcactgtccccattcatgatatattcccacatgcatttactcaacagactaaaagcctgcaatatgttagcagctggagatacaaaagtcccttataagcccaggtcctcaaggcacttacacaacccacagggagaatgacaagagttggtcccctgtacacctctgagccacatgaccatgccaaatggtgagtgcagatttgatgaacctgcagataactattttaagctgcaagaaacccagggcctctgcccttgttaccctcagcatccatgcaatacatgcataccacatatctcaggcctctcctcctccctgggagggcaaatggcagccttcacattgagacttccccccaaaaaatctgggtaatcaatcaggtcatggctggctccttccacagaagccacagattcccccattcagagactggagttccgttggaagtgtaacaacccttggctacaattaaatccatctagagaggctattgatcctttcaaagttaagaggctgctgctgcttccaactgtcagttaagtcctgaaagcaaaacaatccctttgctggccttctcacagggtctaggctttcctcaaaagcagaaccaaagccgacttcgaagaagtctggtgtatgtcttcttttgagaagtgtctgttcatgtcctttttgatggaggttttttatctttttggtaaatttgtttaagttttgtataagtgctggatattagacctttgtgagatgcacagtttgcccaaattttctcccattcgataggttgtctgtttactatgttgataggttcttttacaagttttaaaaaagtctggtgtgcccctactcactgggacagtggtttctaaatgctagtttaactatcagccatatcagaatatcagaatcacctgcaacataaaatacagtagtgcccccttataagtggggaatatgttccagttcccccagtggatgcctgaaactgtggatagtaccgaactctatctatactacgtttttccatatgtatgagagataaagtttaatttataaattaggcacagtaagagattaacaataaaatagcataattataacaatatactgtaatatttcctcatactactcagaacggcatacaatttaaaactttttattttttaatttttgcaaccctgctctttaaggtaccatacaatttaaaacttataaattgtttatttctggaattttccattttatatttttgggccatggttgaccatgggtaactgaagctgtggaaagtgaaaccatgaataacggggctctactctatagatataaggagctcataccagacctccttaaccagaatcttctataatagggctctaggcttacatagttaaaaaaaactctataggtgattttaatgcatgccattgattgggaaccgctgcactaggacggtagttctcaaatttcatgggcatcagaagcacctggagggcttgttaaagcacagattcctgggtcaaatccccgagttgctaagcagctggcctacagtggaccccgagaatttcatttcccctaagttctcaggtgatgcagctgttctggagcaggggaggacacataagaaccactgcactagggattagctagggccagttccattggaagcctgtttactagctaaatgcctcttgaccacctggagaagatactgctttttacctttccaacattcattctccctttcttccttctaacagtatcttgatttttgctagtgggagcaatgttcccaagtaacagaactacatttactcacttcctttctaaaaaggggcggccacagtactaaatcccagcaacaacaaaaatcataacctgaagctgttgggtgagggctctggtttttggaaaagcttaaaggtgggcgagggaggaagtgttagctcagctggcattcttcgccttttgccctcactcttctttctttatgcctggaaaaaagaagtgataactcgagttctgacaaccattctgtggcaacaaggcaaaaagcacatactaaagatgatgacggtaccaaggaggaggagactgggtgactgatggtattacggagttgccataccagtcccacatgcctaccttcagatctcaaattatggggcggaaaaataaaagttctcatttttaaagatgattttaaggtctctatttactagtgaccagaaaattaattattaatttgtcacaccccaacccaccaacatggaggccattatattcacctcttttctccgatcctgctattctcacatggctctgagattcttcttcccttccccaatctctaactattcctattgctttctgcagaacttcagtgccattgtaaactcccttgaaacttgaatctcttcataggcctcttagccttaaatgaaacttggatatcccctaagggcatcaattccttggagtccgcaggataagaatctctggccaggagggtaggagtagttctatcctttgtcccagtgctactttaagacctcctccccttatatatgaactcctgactttttgaggcttatgccatctggctagatcttttctccttgttgctgtcacacctttggttcacaaacttccctagtttgtgaaagacttcagaatttgagtcaccattttcttctccaccctacctcctaaccatgatcctaggtgatttcaatgccactcaacatgaaagcttctctcagttcctagacttacatatctctagtgactgatactgatctccactccacactggctacctccttccatggccacaccctgaatcatatcatccattaccatggaaagctccacttctgaagtgtacagtgacacagctctttccctgttattcctggggtctctgtaggtaccttagaaaagcattcggtcccttggcccatctactttatccctttcttcaagcacctcctgccatcacatctttccttgtttataacttcaactatagttgctaacatcctcaattatctttcctcatcgtaccctcctgtaaaaacctcacccctgggccaaactgttcaccagaaaataataacaccataatacatgtaatctcctaaatcaactgaattgtaaatacaacccataaatatatattctgtcatcagcactttctccatggccacttcaaactttgtctactatctcttattcaagactcctggtactagatgttttggaatttacaataataatctggaatatatagtatatattatataatactccaaggggtctgggaagtcactcatcatcaaatacattaatatttttacagcagtgtgaagagtcacactaaataggttaaataaaaatgatatacattaaatgttttgtcaagctactgaaacaaaactgtttaatgatacacaacttgatataagacaggttaggttttaccattaaacttatgaaaaaactttggttttcagacatttttagattattagattttggtaacacagataaagatggtactatcacgtttgcttggggataggcattaatctggattcattcccacaggctacctttcacatccaattagtctctgaggctttctgttctaccccactaaatgtcttttgaagctcactgcttctggctatcccttctgccatagcaattcaggaaaccagaattttctcctgaattacttaatagacttctacctagtctctgtccccctagactccacccacttgtttccctgcctgaccccagggccctttcatctgttctctatactgcagccagagtgacctctataacacaggtatcattgtgctattcccctgagtaaaacatttatttggatccctaatggcctcaagatgaagttcagttgtcttaatatgactttacgaggcccctgctgatgtttccagctttatctcttgccattttctacctcctggtcaaagccccagtcttactgcactatttttagatctctaagagaaagctgtttgcttttgtatttgtacaagttgttccctctttgacaatgtactactaaaaatcacaactcttcttctttcaagatagaagctaaaactaaagataaattatgagtgtcagtatgtgcagaggcctgcgttaatcacggccaagaaattggggcctgtccaatcatcttagtcaccatgcacctatgtttatttctgattaatccttgattcactattttttcccccagagtgtaccagaataagaatccatgcagaagtaattatgtatccaaattcagatttgatcaactacttatgaaactgactttgcaaagattatgacagtgagaggagtctagcatagctgactccatcttgcttctggcctcacagactggctgtcttcactcattcctgggtgtcagccaagctcaccatgagaggaacttagtctatagtttaacctgaaaacaagaactaaccccttcctggctagggaactgaaaactgtctttgtaaaactaatgaaaagccacaatattaatattatgggaggggcctgaatgctgctaaaatgtagacctaggttctataatgctttactgctcaggggtcatgtggtccagaggtcacaagatttgtgatctccccaattgatcccataggtaacatcactatcgtaaaacctaagattggtcttttgagatgttttttttagatatgcattccggcaaccgatggacctcaccttgaccctgacttatgactcaactgatcctgtggccccacccagaggtagactcagcacaagaggaccgttttctacatctctatgatttcatccccagtcagtcagcagtacacacttcctagcccttgcccaccaaattgtccataaaaaccttaacctttgatcctttggggagactgatttgagtaataattccatctcttatgtgggcggcctcttgtcaattaaaatggtaacttcaataccacagtcttggtgaactgattttctctgtgcagggggcaggaagaacccgttgggcaattaaacttatacatacaattaaatattttatatgcttcttaaaattttataatcacaaaagtggtatcaccaagttacagaacatttagaaaaaaaaaaacaggaaagacctatgttttcatcatcctataaaatatttgctatacataactgtctcctgaaaggtaagctctgtgaagataagagccacatgtattctgtttactgctgtgttctcagtgaagtgttttaatgtttaaaaaatataaatacaggccaggcatggtgactctcacctataatcccaaaacggtgggaggctaaggctggagaattgctcaaatccaggagttcaagaccagcctgggcaacacgatgagaccccatctttacaaaaaaaaaattatttgggcatggtcacacagcctatagtcctagcctctcaggaggctgaggcaggaggattgcttgagcccaggaggtgaaagctgcagtgagccatgatcacgacattgcaatccagcccaggagacagggtgagaccttgtctcaaaataataataataataaaagtacctaaatgaatgattgacctatcattttggtatacagaattaaaatttgaacatacttgaattttctaccatatacccattcagcaacattgaggttctcaattttagtacatgcaaagttttggttgttcccgtaagagaaaatcagaaaaagaaggtccttggaaaagaccacatgtttaaaggtaaagtgaaaggcaaagaagtagatattattttccccacataacaatgattcccaaagatgtttttcaacgaatcctggggaaagatgaaggaagcaaggagaaagtaaaactgcctctcacaagtatcactggtgacatgagatgacaactaacactgaagtggagaagaggggaggcgtacacgaggttgagtcataacatcacaaaggcatcattcattttcatagacaagggggagccaacaaatgacatctcgtatgagtaacgtatgccatacagcaaaataaatttgccagtatcttgttagaactgtaggtggaagccatctagaaaaatttctgatgagcaaagggataaatggatcaattaaattagaatctctacttgttatctttaaaggtgttaaggtcatgaaagtcaaggaaaaattcagaaactgatccagattgaaagagactaaggagaaaactaaatgcaatgcatggtcctgacctggatccttttgctagcaaagaaccttattgagacaattggtgaaatctgagtggagtctaaggattagatggtagtaataaatgaatgttgatttccttatttggatgcttgtaatgtgattatgtaaaaaaaaatgcccttttatgttaaaaatacacactaaaggattcagaagtatgcacataatgttgatgacttactctcaaatgttcataaaaaatttattgtactgtacctgcaacttttctaaaagtttaaagttgtttaaaaaaattagaatcttggccaggcgtggtagcttacatctgtaatcccagcactttgggaagccaaggcgggcagatcacaaggtcaggcgatcaagaccatcctggctaacatggcaaaaccctgtctctactaaaaatacaaaaaattagctgggcgtggtggcatgcacctgtagtcccagctactcgggaggctgaggcaggagaatagcttgaacccgggaagcagaggttgcagtgagtcgagactgcaccactgcactccagcctgggcaacagagcgagactctgtctcaaaaaaaaaaaaaaaaaattagaatctctgggggtgagtctggacgtcagtatttagaaaactggctaggtgattctgatgtgcaaccaaggctaggaaacactgttatagagtcttctctataaagtgtgacatactttttcaccgagtgcaaaaaatacaatttatttaactaaactcttccttcctttctttcaaaaatcacttattgaagagcttttatatgccaggcaagaaaaaatctcttccctactatgtgtactcacagtctcacatgagcaaacagacactgtgctgtaatagtaataataataataactactatcatttgttgagcaattactatttgctaggcacaatgatatttgatagggcaggtactgttatcttcgttttacagagtgaggaaacctacgcatagtgagatgagtaacttgcccaggagtacagagctattttgacttggctacaccactatagtataggaaggcaaagtgctatgaaaacacacatacggactgatgcagactatgggtgccatggaaggtttcttagaggaggtaaggtgggatgtatctgtaaacatgcgtattatttccattgttaatgatcacaaatactccttccatgaacatctgtgcagataactttccattttgtagtcctgctgccactctcttcctttgcttagatcctaagaagtagaattctgggacaaaagttatagaaatattccaaggctttcaatatgttttgcccatagttgtcaccagctatatgagggtatctactttactgtagcattgccagcagtgggcattattacttcaaaagttctttgccattaatagaaaactagtatttgattactcagctgaacattttaccatcaatgctatctttaacacacaaatttaagatcattgtagttacaaccagcagagtataagagaacattaacagtgacagaacattctagaatgtctcataaataccataatttattcctataatcacaaaattgactgggtcacaattagcaatattcaaagaaaacaaatttctgtattcatgctaagatctttgacctctcaaacttactatgagttctaggagaacagtagaaatgaattgtttgatcctatcacaatccagcaagtaaaacatgttctataattgtttgctataaaaataaataaataaataaataaataaataaaataatggataatgacaaaatataaactgaagccatactttctgagctctatacccatgacacatagctcagtaaacatcacattagggaaagattaaagagaagtagcatgttcccctctttctcttcttgccatataaataggataacaatatattctagtttgcgtgtgacagttctggtttatgcctcttgtccgaacatcttttctgattagagctgcctttcaaagggtgtttaattgggcaataaattttatggtcactctgcatctaaaggatgtccccctaatgaagagctgatcctaggaacaaagtgctcactgatcagacaacttgtcttgtgtcactcggattttcactttgaagacctatagccagatacctcatttggcctttatgtattttcataatattttatcatctgaagccaaataataatctgaaagtagctaattgataagggcatccttgactatctcagcactctttatttcattttattgataaaagaagtgaggcatggaaagaaaatgtgacttattcaagttcatatcaagaaaataatcagccatataagaggaagctactgatgctctaacttctgatttttgattaattctctaaaccacacagtcattaatgtacactgaaatctccagtgaagttagatcagaaaaattgcaatcatttagtaaatggctttgcaaactacaggcagtaataatctatttcaaacaatatgaacaaaatcataggcataccttagataatactttttcctttttttcccctcaggccctcttggataatatttttaatgggtataaatttcatggttaataacatttcagtctcattaaataaaagtctctattcaaacctagttgataggtccaagctatcagaaagtgaggaaatatttatttataaaataagttaaaatttaaaataaacatttaatctttttggttattaaaaaataaagcttggtacatttttacatttcacaagtatgtctaaatttcatacaaagatgcataatagataaggttttacaaatatcttggattataacagaaaatcttaatggagctaacaaagtcattttctataacaacaacaaagaaacttatggtgataaatttaatagactattactaagaactatatgaaaaaaagtgactctactgcttgcataaaaggagaggcataccacatatgaagttggagaaactcactattacagatatgacatttccatataatttataaacatattgtaatgtcactgaaagtcccacttgcattttgtaggggtggagtaaagacctcggtaaaaagtcatttaaagttcattcggaggttggccaggcgtggtggctcatgcctgtaatcccagaacttttcgaggctgaggtgggtggatcacctgaggtcaggagacagcctggccaacatggtgaaacttcatctctactagaaatacaaaaaattagctgggcatggtggcatgcacctgtaatcccagctatgcaggaggctgaggctggagaaatgcttgaactcaggaggcggaggttgcagtgagccgagattgtgccactgcactacagcctgggcgacagagtgagactccctctcaataaataaataaaaagttcatttggaggaatacattttagggactaaccaagaacacttttgtaaagtataaataacctacaataataaaaacagtattttgctggtacagatcaatggaataaaataggaagttcagaaacaggcaaggatgtatataagtattcaataaatgagaaagaacaatgaaaggatggatggatttagccatttaaataaaataaattgtttattattaataatattgtgatagctggctaaatccatacctcacactatatgtctaataaattccaggtggattgaacatttcaatgtatgaaaatgaaaacaaaatatttggggaaggcttttctatgtacaacttccaggacataatttttttttaaaagactaatagatttgatcacataaaacataatactcattaaaataaatgtgtattaaggatatcaaccatttttcttcatttaatcacttaaatttattatttctttttaaatttcatttagcttattttgacacaaaaattttaaaatctataagaagttaaaaaaataaaatatttatttacagtttccttcttggattttggcctagaaataactttcttaaccctaaactggacccattttcacttatattttctcagaatttttcatttcatattttatgttaatttaaaagatgagagatcaaatatggctttgtttcatattagctgtctggtttggggatgttacttaacctctctgagtctcaatttcagtttcctaaaaaaacagatataatgaataccagcctattggagttgctatggcaatgaaaagaaatcatttatacaacacatgtgtcatggtagaatctggttaataaaggtgaccaaaatgttagctatcactttgagtgctattgttatacttggtagctagtcgggtatgagcagggcaggaaagggctcccatacctcacaccaggagtgttgggagaccatcaggtgatggtcaggtggttgttaactgtctctctgaagtaataattggtcacagctggcgccagggaacggcggtctcctagtagatagaaaacacctaaaactggtgacgagcggcttctcaataagatctcaggagttgggcaagtggtcagaagtagtgcaagaccctggaggtatgccatcatataaaaacctcaagtcaaaaggtcaagccatacacttgtctttcaagtcacctgcttggccctcttccaagtgtactttcctttcttttgttcctgctctaaagcttttaagtaaactttcactcctgctctaaaacttgcctcagtctctccttctgccttatgcttcctcagttgaattctttcttctgaagaggcagatactgaggttgctgcagacccatatgaatttgccatgggtaacactatcacactgtatattagactccttccccgccttttttggaggcaaagtctcgctatgatgtccagggtggagttcaggggctattcacaaatgcaatcatagcatactgtggccttgaactcctggcttcaagcaatcctcccacttaagcctcccaagttgctgggactccaggtgcatgccactgagcctggctagacttcttaatttcattggaaaacagttgacccttaaacagtgtggaggtatggggtacctatcccctgcacagtggaaaaatctacatataacttttgattccccaaaagcttaactactaatgctgttgaccgggagcttcatcgataacaaaaagtcgattaacacataaatagactagtatctatatatatgttatgcactcataatacacatttttttctatttttttgatatttctaggctacaaagttcacccaagagttttttcaaattgtcacaaatctccaaactttctaatatatttattgaacaaatgaatatataagtggaccagcacagttcaaacattgttcaagggtcaactgtatgtattttcatgactagcaatttatggtgatggtatagtcacctgatataaaaacaaatttcacagaatttaattattttaaaatcaaaatgtatgccaaccagaaaaaaatatctaaattctttgaaagctatgcagcatgctacaatttggtctttcaaagttgcagtccaaaatcatcagatggccaagtaacagagtcatccaaggggaacatcacataccaggacttgtcagggggtgggggggataggggagggataacattaggagaaatacctaatgtaggtgatgggttgatgggtgcaacaaaccaccagggcacgtgtatacctatgtaacaaaactgcactctctgcacatgtaacctagaacttgaagtataacaataaaacaaaaagttttcttacacatcagaactcctgagataatttatgagcttgaaatataaataggatgtttaccttctttatcttacctctaataggccatcctctggcagatcagtacagtgaacagcattctggatcttagttttaccaaagattgctctgagagttccagggcgtaaatgccgggcaatttcctattaaacatacattcacatatagattaatgttagtcatatggtataaataagaaaaacactagctatatgaaacgctaacttatttatgaaatacatgttatatatagacagtgcttataagggtttttctgtggcccaatgtaaagtctgctttcatctacatcggggaaaaataataattgcatttctttttatcaatagattatgggaatcacacaaaatgtgaagctagttcattactgtgaaagacttgtattttataaagacagtagagatcttaacaactttgatttaaaatgaaccaatttgatgctattgatttcaaaagcttttaaaaaaatgttagctgtatcaacttaatggtagttcatctttaagagaaaaaatatggtcacaaatagccctgaatttaatgagggttagagagaggcaagggaatgataatgatgtacaaaaaaatttaaattgagaaagacaggaagagaggacctaggggataaagaggtaattgacaatgaaaaggtggatcaatgaatttgagctcctagtggtatgggataattattgagatctgtatgttagaagaagagagctggaaagttaaaagatactcgagactgagattactgtgggtgggaggagagggggctatagtgattgataatgatcagttttaaggcataaccatggataaggttagtctgagggcaagaatgttagaagaaagaagaacaacagattgagaggccaaggtcgtaagtgggtcacctctatgaaagtggaaatcagaaagaatcatgacaggtgtagcttagggtgcaaagattctgagcagcactcacatttgtggttccatcacttaaggatgttttaaagacatgcatttatttaattacttaagttttatttgccagggttccatcaaatgtcagctataaatgtattatgtttaggaaaaacattttgataaagtagaaaataaggatgtctttatattttatttcatatttattactttcattctgttctccgtaatttttctagcaagtaagtatccaatattaaaaacctactcagctgcgcgtggtggcccacacctgtaatcccaacactttcagaggtagaggtgagtgaatcatttgtggtcaggagttcgagaccagcctggctaacatggtgaagccctgtctcaacatggtgaaaccctgtctctacaaaaattagctgggcatggtggtgcgtgcctgtaataccagatatttaggaggctcaggcaggagaatcacctgaacctgggagatggaggttgcagtgagccgagactgtgcattgcactccagcctggacgacagatcagactccatctcagaaaacaagcagaagccttactctgcttatatagtgggaagctgtcattttgtgacataagatgtaatttatgaaattgtgaaaagtgagtactaacgttctttttcttatttccggtcagggaaaaaaacacttttaaattactcagttccagtaaactgttttattagaacctattctctatcaaattttgtttgatggccaggctcatacctataatcggcactttgggaggagtttgagagcagccttggcaacacagagagaccccgttgctacaaaaaatacaaaaattagccaggtgtagtggtgcacgcctgtagtcccagctacttgggaggctgtgtgggaggatggcttgagcctgtgaggtcgaggctgcagtgagccaaaatgacaccactgcactccagcctgggttgtcagacagagtaggaccctgtctcaaaaaaagaaaattttatttaacttgcactacattcattaaaagattactttcatataagtgtctgctacatgcacagcacttgaaatctgaagaggttcatgtgtgttggcctagcgcggtggatcatgcctgtaatcccagcactttgggaggccgaggcgggtggatcacctgaggtcaggagttagagaccagcctgatcaacatggtgaaaccctgtttctactaaaaatacaaaaattagcagggcatggtggcacgcacctgtagtctcagctacttggggggctgaggcagaagaatggcttgaacccggcggtgcggaggttgcagtgagccgagatcacgccactgcactccagcctgggtgaaagagcgagattccatctcaaaaacaacaacaacaacaaaaatggttggtaattcctggctgtttttttttttttctttttttttatgagttctctatttgcttgtcatagatgccagggacatgctgctagatgaggtattctggttgccttcctttcagaagggggtgctaccatttttcctgagtgttattagctgccttcccattgctctgcctctttagctcaagccccacattcagtgccttaggctgtggctaaaagtatcaactgccttctgctcaatgtaagcaagcaaatgtgaaggcgctgatttactctgctgctcttcatgcagccctccaactaaccaccctgcttaaggccccatgcccttcctcagccttgcatccatatgtctgatgtgcagcccacccagtacccctaccccttctggagcagttctctcctgcacgttttagagtgttggttttcctcaacgatacaatcctatctgctttgagtcttttgaagtttatggcctgtaacaaaactaaaaaaaaacaaaaaaaaaacaaacccacaaaaacaaaaacatacgtgtgtgtgtgtgtgtgtgtgtgtgtgtgtgtatgtgtatgtgtgtactcttccttgttttccagcatcactggagatttactctttaaaacaacacacagtgaaacagtatctcctgtaaattcctgtaaggacttggtaagcaaggggatgatgggcacatatggtcttctgccatcttcatgacacttcatcttactgacattctctatttctccaacacaacaaaccatctttagttcatttttcatgctgctataattttgtacctaaatgccaatacgatcatgttatttacttgctcaaaaaatctttgaaggctcataattgcctatggccaaatgtctaaactccccagtgtggcattcaaggtcctccccattcttgcctaaatctacctcactcacacctgccttgaaagcttacacatcccagtgaaaacactgtttcctctataaaagcaaattaagccttcccaatcagagtaatccttgcttcttcaatgttcctacagtagtttacacttccaatataggccttcttgacttgcaatttatatagttgttttgtgagcctattttagtaagatcccattagatttcaatccctgaacacaatataaaacttcccttatattctgtatcttactaatgaacacacagtaaatgtttggtaaatatttgttgactgatataaaatgacagtacttctattcagagtgtcaggatggagtagcaaataagggtgggggctgtggaaaaaggctctctggatttgaattttgcctctgccacttaacagttgtgtgaccacaccacattatttaacctctctatgcctgctttaatgttcttatttgtaagacaaggataaaatagaatctgtcttaaggagattaagacaattcttaaagagacagaaaggtatgttttgacaaatatcaaagataatctaaccaaatattatattatctttaaataaatatataacatctcttaagagttgtaatcgtcatagttttagaataaaggtataagtttagattagatcataagctaattatgacctattattatccattaataaacctcagaaaacatgaagtatttttactgatataaaatgttttatttaggtaaatgataacaatgaaacttaaagatataaaacaataggtattttcttcatatctgctcttaaaatctaggctttcatgttagatcctctttaaaaaaggtattgataaattaattttagttttgattagtataaaatatcacatatgcttataaagtaaaaaatattgaaatactaaaaaatacaaaaatattaaaaaatactaaaagtgagagtgaaataataacagcacttcccccctccatttcctgatggattgtccctaattttttctaacagatttacattcctcttgctgcttaaactctggtgaagaccatactaccacgcatagttcccctcccttcaaggagcagaagcaattatgagatcataaaagcaacacaaagtaccaacatataatttcatctaataccataaataattcttaaaaagttattgcagtatttataaataacaggttatgctgagaaaatcagactcattaaagagcgatacttatttgtacttggagggtcagcagtctttcaaattccacaaaattccaggcatattcatcctcccctaaaaccttgcatgctgagtcccatcaagtcaaattcttggctatgttacagctcatcataagtactaaaaattctgctcaggtaatcctgctgtgggaggaagaattctgacttatagaatgacttctaaatctaagatatcaaaaaaatgcaccaaatatagaatagtgattggcaaaatactgaaaataaagaagggaatatttatttaattattctatggctgtgttattgtaaagaatgtcactgtttattgaataggtctatcagattgataaaatatgtctggacaaagaataacttacttccataataaagccactcagtttcagttctccacaacacagaagagatatgtaagaattgaaaatgcccttctatttaagaaacaaattaaactagaaaaagatttatgaaatttactaattacagaaaaagatcaactgtagaatatattcagatacagtcatgcattgcttaacaacagagatatagtctaagaaatgcatcattaggtgatttcctcattgtgtgaacatcatagagtgtacttacacaaacctagatgatatagcctactacacatctaggctatataatttgctactaggctataaacttgtatagcatgttgctatactgaatattgtaggcaactgtaacacaatgataaatatttgtgtatctacacatatctaaacagaaaaggtacagtaaaaatatggtaaaaaatgatgtagacctatagagggcacttaccatgaatggagcttgtaggactagcagttgctctaggtgagtccgtgagtgagtggtgagtgagtgtgagggcctaggacattactgtatactactgcagactttataaaacactgtacacttgggctacactaaatttataaaaatatttttatttcttcaatagtaaattaaccttagcttactgtaactatttcactttataaacttctaagtattttttaactttttttgactcttttgtaataacacagcttaaaacacaaacacattgtacagctgtacaaaaatcttttctttctttacatcattattctataagctttttctattttttaagttttttttcttttgaaacctttctgttaaaaaggaagacacaaacacatgcattagcctaggcttatgcagggtcagaatcatcaaaatcactgtcttccacctccatatcttgtcccactggaaggtctttagggacaataacacacatagagctgtcatctcctctgataaaatgccttgttctggaatacctcctgaaggacctgcctcaggctcttttacagttaactttttttctaataagtagaaaaagtatactctaaaacaacgataaaaagtatagtaaatatgtaaaccagtaacatagtcatttattatcattatcaagtattatgtactatacataattttatgtagtatactttaatacaagtggcagcacagtaggtttatttatgccaacatcaccacaaacacgtgagtaatgcattgtgtgactatctcacaacagcaatttttcagctccattataatcttatgggatcagcatcctatatgcagtcaggtgttgatggaaatattgttatgcagtgcatgactgtaatgagtagcatatggtggtttatcacgaggtcactagtctaattccaggaaaatctaagtacaaggaaaaaaatattctctggactacaggataactatgttagcagtgatatacatatatggataaacattaaaagaggagctagtatagctcaagtcctagtaaccctaaaacagctgtgaaacaatgttacaatcattgtcctcctttcacaggcaatgagggtaataaaacttaatatcaaatgccagtgaggggaccactataactaaaacagcaaatattttcatttctatccattactagtattcttctgcaacaagtcttgtaatactaaacagcacatgctaagtgctctcttgactcctccggcacttcaaaaatatcttaccaaaactgacccatcaaacagcttttcccagtagtatgcaactttgtactaatacagttatgcagttttatattcctgggagataagcaatgtcagatgaattcaaactaaaatgagataatgaaagatggggaaggaattggaagtagaaaaggaagccagggagagacccagaggctactttctgctaagtctaaggatccttctagaacctatgcataggctttagaaagagtaattgcaaaattaaactcaactacttatttatataatactaatctcattgagtgagccacctgcaggttcacagtaaatacacttattggcactggaaaatacataaattgtttgtatatgaggaatcactaaaacatcaggcttgtggactctgacaggcttcacatctcacttttcattagataaaaaatagctgtaatgtaaatttatagaacctgaagagggtcacaattaaatgttatttcaggtgaaatatttagataattcaatcctgtctttttcattaggtttcaatagaccacatggcatcgtaactattgcctcttactgatctgtttgctgtttcagccaacaataggaactggctgaagtgaaaatgaagtcttatttgacacaggtgttacttttaaaagtaaaaattatgatctcttggttcttttttaaaagaattgggcattcttcagaaggatgagctcaactaaaaaagaagagtcagaaaaatctcttaactcacttttatataaattacttagtattttagcaaaaactacaaagattcacatatacaactaaaatttaagaacataaacattagcatagaggattgggttttttggtaaatattttcctatttctttttttctaaatacattttaagacatttaacctttaatgtatactcacattactactaaaaaatttaagaggcattcttttattttaacaccctggacctgaaagcaagagaggcattcttaatatctccccgcaaaagaatcgttccacattctactccatccctataacataattactatccagtcttgctttactattttaaagaatcctacaattcaatgctcagaaacttcctcaaaggaataaaataatgaaatagctgggacccactcttggcacttctaacatccaattcttggcaaatcctgtcaatacaactactaatatataccctgtatcagtcggcttctatatccactctagcaccatattctcctgcctagaatattgggcttttagattttatacttgctggtctatctggtttcctagatacctctactcctagtaaacatattgtccaaaaagcagttagaataagctttaaaaaaacataagttgaatcataccactttcctgccgaagaatctctgatgctttcattaagagaaaatgcaaaattcttgggctgggtgtggtggctcatccctataaccccagcactttgggaggctaaggtggaaggatcatttgaggccaggtgttcaagatcatcgtggccaacacagcaagaccctgtctcttaaagaaaaacttctcaacataacctatagtcctgcatgctctggctcctgcttaactctccaaccccacctgaaatgaactagtcacatcaaccccttccaacttttcaaactagtcacatcaaccccttccaacttttcaaaggcaccaagctctttcctacctcaagcatgaaaacacacagtatttcccttggctcagcaattctctttttttgttttttgttttttttgagacagagtctagctctgtcgcccaggctggagtgcagtggcgtgatcgcggctcactgcaagctccgcctcccaggttcacaccattctcctgcctcagcctcctgagcagctaggactacaggcgcccgccaccacacccagctaatttttttttgtatttttagtagagacgaggtttcaccgtgttagccaggatggtcttgatctcctaacctcaggatctgcccgcctcggcctcccaaagtgctgggattacaggcgtgagccaccgtgcccagcctctcctctttcttaataattgccttacaaatggcttacaataagcaacagaaatcagatgtgatcgattctacagagtgactctctcaactctttattctatcctccttctagatggaaattagaaatctaaaaactacattccccagacacatttttggctagaattcttgcgatgtggaagtcctaaatgagatttggaagacaggacaaagcagaagctaccttcttgctaatgttgctacaggcagacaaggtaggagacacaagtgtttgagttgtggcagactcaatgcctaagtcactgccatggtagtagcagtggaggcagcagcaacttcaggattctaggtatgggaaggtactcttgaaatcaatagctccagtggcaactcctgacttaaggccctgcaacacttaagaaacttaagttcgtaaatagctacttccttgaatcgaactcctttaaaaaacatccctaagctggtttctgtttcttgagctgaactctcagtgatattctgaggctccatctttcttcctcatctctacagaaagctgttttccctgttcccacttagtaagtacctttttgctatctggttttcagctttactgctctattgaaattgctccctccaaagtcacctataatcaattagacttctagctgaaacctcttcttttttttttttttttttgagacagagtcttgctctgtcacccaggctggagtgcagtggcacaatctcagctcactgcaacctccacctcgtgggttgaaacaattctcctgcctcagtctcctgagtagctgggattacaggcatgtgccaccacacccggctaatttttgtatttttagtagagatggggtttcaccatgttggccaaactggtctcaaactcctgacttcagataatctgcccacctcggcctcccaaggtgctgggattacaggcatgagccaccgcacctggcctaaaacctcttgtatagcagtgaagttataaaagtaccatcagaaataatggatctaatacatgtggccaaaaaacatatgaaataaagctcagcatcactgatcattagagaaatgcaaatcaaaaccacaatgtgataccatctcacaccagtcagaatggctattattaaaaagtcaaaaaacaacagatgctggtgaggttgcagagaaataggaatgcttttacactgttggtgggaatgtaaattagttcaaccattgtggaagacagtgtggtgattcctcaaagacctagaggcagaaataccgtttgacccagcaatcccattactgggtatatactcaaaggaatataaactgttctattataaagacatatgcacctgtatgttcattgcaacactattcacaatagcaaagacatagaatcaacctaaatgcccatcaattatagactggataaagaaaatgtacatatacaccatggaatactatgcagccataaaaaggaacaagatcatgtccattgcagaaacatggatggagctggaggccattatccttagcaaactaacgcaggaatagaaaatcaaatacccgcatgttctcatttataagtgagagctaaatgatgaaaacacagggacacatggaggggaggaggggagcaacacacactggggcctgtcagaggaccaggggtgggaggagggagaagatcaggaagaatagctagtggatgctggatttaattcctgggtggtgggatgatctgtgcagcaaaccaccacggaacacatttacccatgtaacatgaacatttacccctgaacttaaaataaaagttggaaaaaaaaaaaaaggcatgtcagtcaaagaaagaaacaatgggtctaacaaactgatcttagtacagttatatccaatttataaaataacatagagattttataaaatttaggtttatttgtcctagagtagcaacattagtctcagcagttagtagaaagattttggtgcctttaaaggcctagcttcagcgttatctggctgaattaattaagataatgcccataaaatgtctaatggtgtctggccaaactggaggcatttagtagatataatcattgtcttcatagtattataaataaactcatagctaacaatgaggcacttatatagtacttgtgtttttaaaagcatgtactatttcacaggaatcccacaaatccccttgtcagcacaattgctgacgaggcagacagtttttgccttttacagatatgggtaacttggttctacggacagtctcagacctcctatccagcaatgaagaaagagtatatccaaagatccaaccacttggggcaaactctctttaaaggttaatttcctaaactgccgcatgtcttctatgattccctttaaagttgcagtaagcagctaagattccagaccaaggtgagcattttttgaaaccatctaatcttctcctataattaccaatagcaatgttgtcaaaaagaaatgtaatgtgagccacctatgtaatttaaaattgtctagtggccacattaataagaagtgaaattaattttaacaaaataatttatttaaccctatatattcaaaatactatttcagtaggtaattaataaaaattattaatgagcttttttacattcttaatttatgctaaattttcaagtcctgggtgtgtattttgtgtataatacatctcagttagaaccagccatgtttcaggtgctggagagctatatgtggctaatggccatcatattggacagtagagacctagagaatagtagctctctcccaggaccgaggtttaacttctgagcaacattctacattaagggctgagccaagactaataatatctgcagtattaacctctctcatgctaatggaaaccttgaacataagcttgagggcagtcaatctaaccatatttctcatgctgccatcctaggctataatcctatctatttatctatctatctatctatctatctatctatctatcatctatctacctacctatctataatttatcatgtctgttgcccacttatcctccacagctggcattgccaatgttcgtcattatcctcaaggctccatcctcaattacatgttttctctcagcaactttgtttcctgcttcacagaaaaaaaaattaagactgatatcaagagattcagctccctcaaattcctacacacacacacacacacacacacacacacacacacatatatacacacacattatccttcccttccccctttccattcagtgccaaagaaagtgccatttcttcttcttttgataattaaccctcccatctctttgcaactctaggtcaggaaacttccttcattataattacctttcgcctgtgttttcaacctttctcttttcaagtttattttatgcatcctatcaaaatgctcatgtctctcccatcacttaacaaatagacaattttaattactgtcctacctcttcccctcctttttagaagtcttaataagctccactttcatttactcttcagccttttgcctcacaacactatctaaaccgctttggcaaaggacactgatattctcctaattgcccatagattctctcaatttgtgacttgtcttcagcatttattactctggaccattccattattcctgaagccctccatttactcagcccacatgataccacagtccaggatctcctcctgactgttcctctcaggctcctttatttccaccttcctactgcctagggtccactccatattctcctcttatcttctggctctccctgggcaatttcattcactactatcatatatctttagacgactctttaactactgcccagttctcttttctgagttgcaggctggactatacaactgcctaatgctcactgcagccttgaactcctgggctcaagtgaccttcctgcctcagcttccagagtagctcggactacaggtgcatgccaccacaactagctaatttaaaaaaaaaaaaaaacaactctgtagagataaagtcttgctgtattaaccaggctagtcttgaagtcctggcctcagagatctcctgccttggcctcccaaagtgctgggattacaggcatgagctataatgtgcctggcccccacagggctcttatactcagcttgcacaaaactaacctcattgtcttcctcccaaaactccccctcttcctaaattccctctcgtcataaatggcaccactcttacaccaagttacctaggccaacagcttgggagtcatcctaagactcctctctctcccttttgggccccccatctaatttgttaccaagtcacacagattctatttctttagcatagcattctttccttactttccaagtctactcctactatcacagttcaccttcacatcttgtttaggttttagtggtctgctaacaggctgcattacctctaccattaaaaatgtactgtttgtttacccttctgtcttaactccttaaaaacaaggactacaacctttttatatccaacacacagaatcctcatgaaagattcattgaataaaatattaatgatttagtggataagtgaatggatgaatggaatgactaacatgctcaaatttatataccccattaactttgttaatgatagggtagagaaactaggcctcttggttaccaatagtctgggctccttaggctatattagatccttcagaagtgcctattttaaggaaccccgaagaacatccttttgaaatctaagtaaccaccatttatctattttgtgaggtggtggttttgtgtatcacattttctcaaactaggacacacctgcctgagaatggaaatgagaactctaagctctaatccatagctctgaaagtaacttgctctgtgactttgattgaggataatattactgtttcatcacagatataaaatgccatgtgacaaatatgtggaattggactaatccactagaatagcattaagtttataagtgcatgctcataaatgacttttccagttgagatattaagactattccccaaagaactacttaatcttctggtgaatatccatagcatagaaaagaccaattcactctaaacatgagagatcacatataataaataatctttcatcttatgttagacatgtctattactattatatattttaaatatatacacctctataagcaataactcacatctttatatatgatcttgaggcaagactcccatttataaagaaaagaataaactctgttcactatagttgcaagtcaagtatattttcttggttacatatttcttaagaaaagccctggccgggcacagtggctcacgcctgtaatcccagcactttgggaggctgaggcgggcggatcacgaggtcaggagattgagaccatcctggctaacatggtgaaaccccatctctactgaaaatacaaaaaaattagccgggcatggtggcaggcgcctgtagtcccagctacttgggaggctgaggcaggagaatggcgtgaacccgggaggtagaacttgcagtgagccgagatcacgccactgtgctccagcctaggcgacagagcgagactccatctcagaaaaaaagaaaaaaaaaagaaaagccctatgtgtacagattatactgtattatcctattaatgagaacatttactaaatcagaatatgccatttcttaggtaatgtaaagttattgccttctgaaagtatattgtttttacttccctaatactttattgtaaaaagatttttttttctcatggtcacattataatagcttttttgaaaagaaaaactttttattaggagttatattctaaaaggtaactttaactttatcctcccccaaaattcatttttctcttcctaatagaattgtaaactgtgactatgatcttgaaacacacttacattgtttttaaaaaaaaaaacaaaattccatttcctcagtcattctcttctaggctatctgatctctgcttttccctgcaaacgtagtgttcagaatgtattataaaaatgcaattttctcttgtactattgaaatgaagcaatcttttaaaaaaataaataactttgaacttcaactagtctgtatagttaagtattttagaaagtcacaggaaaagtaatttcaaaactgtcatttgatagtaactggagtgaatgctgggcatctctaatcctggtcttttgacagtacctcaaacacaacatgtcccaaatcaaaacaattatcttcccctatgatccctccctctgcctctccctctcaactcagtttttcttcttcagtttctagtagtatcactattaccaaatgttcaggctacataatatagggctatttccaaccatttcatccattcccaaaatcaattggtcattacctaatttgttgatctcatttgttaatctgtccctctacatattcaataaatatttattgatacctataatttgtgaggtactgggctagaaataaggaaataaaaataagatggtatttttattctaaatggtcacagtcttataagaagtcagacatgttaataaacagtcggtgatgtgctagtaactgtttaacagttttcaaaaaacaacaataaaaaacagatttgtattgtttgctcattttcatggtgtaaatattcctaccaaggcagagcatagaattggaaagtgatactaacaattagatcttgcaagctggtgcaagctgacttcaacacaacactctaaaagcactcacagtgtaacaagagctctactagagatatatgcaaagtgctataaggggagcacaaaagagggaactctagggtacccatgcaacgtttcacaggatcctcttggttctgtgaacttctttccattctgaactaaagctactactttagttcagcaaaatgcaattgagagtcagcatgatacaatttcttcctgactcaaacacctctgatgggcctccactgtttgtaagtccaacaattaataagtccaaaataagacacgacaattcaaggaactttttcatcttgcttgagctactctttcagcctcatcattccttcatacacttctacatgatttatgctttagaaaatatttagaagtgaaaaaggcagatgaaatttgacccaggataaaaaagagaacatacatatttgtcataacagtaaacctctttacaaaacttccattgagtcctgtgtattttctctgtgatattcaaaatccctgtcaaacagaatggggtgaagcttattaatactttcacatcttgccattatgtgtttatgctgtgctttcccttagcttgtttttcctcttcttttctggtcaatgaaactctaagactctagaaaaattgtcacttccatgaagcatttcttaatccatagctagagttaataaacctctgtgctacaaagggtattttagcacagtgatttatattgtaactaaaattttatgttgtctgtccctctgtaagagcacagatcagaactgtattattccctgctatatccagatgccaagaacagtgccaagtacataataggtgtcgaattgttcaattaatatttacttagcatgcaaaaacttagttgtgaatgtctcttcctagagttgataaatacattagaattagagattgtgtcttactcatcttagtatcccttacagcattcagtacctctgacacaaggaagtacttaatatatgatgtttgcattggactgaatcttctctaggcctttcaatcttctgagcattcaaaaactatacaccagtatttataaaatacacatatttttaaaaatatataagtagaaatgcaccaaacagattgaattgcaaaatgggtaaagatgaactctaggcaatacaggaagaccaaccagaatttacattggggaattgtaataaaattagagtatttctactgcaaaagggaagagatgtggctgcttctctaattgttgcttttaaatggtacttcattaggttgagaattgaaacctgagactcacacaaataacaaaatagcaccacggacaggattgcaggctctagacactattttgcaacttatttggacaggcttcataggaacacacaggctaaggatttgaatgctctattgctctgaggggtttgactatgtacaatatatttcatacttaagattcatttaaaaacctaaatttcagaacttgttattggtctattcagggattcaacttctttctggtttagtcttgggagggtgtatgtgtccaggaatttatccatttcctctagattttctagtttatttgagtagagatgtttacagtattctctgatggtagtttgtatttctgtgggattagtaggtgatatcccctttatcattttttattgtgtctatttgaatcttctttttttctttattagtctggctagcagtctattttgttaatctttccaaaaaccagctcctggattcactgattttttgaagggtttttcgtgtctctatctctttcagttctgctctgatcttagttatttcttgtcttctgctagcttttgtttgctcttgcttctctggtttttttaattgtgatgttagggtgtcaattttagatctttccagctttctgatgtgggcatttagtgctatcaatttccctctaaacactgttttagctgtgttgaagagattttggtatgctgtgtctttgttctcattggtttcaaagaacttatttatcttatttatttctgccttaattttgttatttacccagtagtcattcaggagcaggttgttcagtttccatgtagttgtgcagttttgagtgagtttcttaatcctgagttctaatttgatggcactgtggtctgagagactgttatgattttcgttcttctgcatttgctgaggagtgttttatgtataactatgtggtcaattttagaataagtgcgatgtgggtgctgagaagaatgatttcgggtggagagttctgtagatgtctattgggtctgcttggtccagagttgagttcaagtcctgaatatccttgttaattttctgtctcgttgatctgtctaatattgagagtagagtgttaaagtctcccactattattgtgtgggagtctaagtctctttgtaggtctctaagaacttgctttatgaatcttggtgctcctgtattgggtgcatatatatttaggatagttagctcttcttgctgcactgatctctttatcattatgtaatacccttctttgtcttttttgatctttgttggtttaaagtctgttttatcagagactaggattgcgaaccctgcttttttatttttttctttccatttgcttagtaaatattcctccatccctttattttgagactatgtgtgtctttgcatgtgagatgggtctcctgaatacagcacactgatgggtcttgactctttatccaatttgccagtctatgtcttttaattggggcatttagcccatttacatttaaggttaatattgttatgtgtgaatttgatcctgtcattagctagctggggtttttacccgttagttgatgcagctttttcatagtgtcagtggtctttaaaatttggtatgtttttgcagtggctggtactggtttttcctttccatatttagtgctttcttcaggagctcttgtaaggtaggcctggtggtgacaaaatctctcagcatttgcttgtctgaaaaggattttatttctccttcgcttatgaagcttagtttggctggatatgaaatcctgggttgaaaactcttttctttaagaatgttgaatattggcccctactctcttctggcttgtagggtttctgcagagagatctgctgttagtttgacaggcttccctttgttggtaacccgacctttctctctggctgcccttaaggtatattttgtacgaagttcatcttggagagtacatcagaaaataacagcttcaaagacaaatgtctataagtattttattgatggtttttgttttgctttgtttgaatgtgtgggtgttttatttcatggcatagggcaagcaactgatcacacctgcttattttataaatttcaggctaaagctgtacaatcatgatctatactacagagctttggaaacttgattgttcaatcacgtctatgcaacaaattattgggaatgagttcaggtcctgcctgggtactccctcattaggggtatccatccattcaattgaatgtccatgctattctgaatctccacaaagagcacacctggcttggctaagaggtgaagcacactgctctgcacttgcatgtggacatacaataaccacattccagctatttttcagaaagtttaactctgaacctattgtcattcggtattaatcaaaaccttgacttaaagaacaggtatagaagattgcttaagggaacacaacaaacacatcttttcctttaaaactctattcctatattgcaccagctgtgggatcagatcattttgacttctcatataattgttacacactgaggtgataccataagcatcttaaaaggaatattctaagaaactggtagttattgaggacagtgaatgctggatcacatagtgtcttcatttgagatccatgagggaattttctattaggtatcaggaaaagttgggctttttgtgagcaactaatttgcttgtcatggacactgtcagtcatataatttgattgggtggaagtctaaaagctgagtaataatgtggctacccataacaaaagtacaggatttcatggcatgcattttattgtttagagcctcatttgctctctgtcttgatttcctcattcactttattttattatattgcataaattttataaatggccttacatttttactaaaaaaggaagtttaaaataaataaatgaacacaacaatgacaatgttgtaaacttttacaaaaatgtagagttaacttatacatattaacaggtattttaactattatagtgttaggtaactacagatactttttgttacatgcactcttaaaacaatgaatgtttaataatcacaaaatcattattttcgcacaatttcaatttgctatttaaacttataaaatacttgtaaaaatttttgctttattcaataaactgtatcaatgcaagtcctactttaaaatcagtgctgtgggctcatgtaattcatttattttaaaaatataatcatttttctattgaattcagctttcgcaacaggataaagagcaagttttgaaacacaacaaattagcatactatcaagatttgttagccctggtactccttagactaatatagatagaaagagttaaccagtttttcttttcttatattatttctgattggcctgactctgagtacactatgcttaacaaataaaattctctgcatatgaaacaaagacttaaaaagacaaattactgttttggcaaatattcattctcaattaaaattcatgtgagttgcttcatgtactgtttgtacaactaatgtctcaaatgtgacatgactataacagaactatggcagtgtaagctggtaagtcaagttgataaatgctgttcattgcaatgcctactgtttatgaactcctcaggttaattcgtgttccaaatattaagtagctcttttgtatattaatgtacgtcaggagccaacaaaagttttgctattgagagaaaataattttcaaaagaaactatgaaataatataagtcaaagttctattaaactacttctgtcgttttagaaagggcaagatgaaacaaattataaatgaacatcttttatcctctgacctagcaattttacctctagaaattagttccaaggtaaaaacttgtacaaacatttatgtataagtctggtctctgcaacatcctcttatataaaaattagaaaaaaatcaacagtaggggaatggttagttaatccatatgctggaacactatgcagctgttaacaaccatgttatggaaatatatttaatgatattagagaagaccacaatatattttttaatttaaaaaggatgttacaaagtagtaatgattatataatcttaattttatttttataatatatatataaaaagacaatggtttgaggtcaggtcaaaatgtttattttacagtgtttatttctgagaagtaggcaaacaagaatagttttaaaatttttagtctattaggtcttgactcttttccataatttttcttcttttttttttggaggtggaataggggtaataaacatggactactttagtaattaggaagaaaacaatgaaagtgttatttttataacttacatttaaaaatgtttgattttaatactcacggaacagagatgtcttctttagtttgcctaaattcacttgtgagaaattggagatttgggggtctggggagagaggcaatataaaaaaagtgtaggttgactcatactaaaataaatatggcatttatcacaggaaggaagcaagtgaactgtttcttttttttttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacagggtttcaccgttttagccgggatggtctcgatctcctgacctcgtgatccacccgcctcggcctcccaaagtgctgggattacaggcgtgagccaccgcgcccggccgcaagtgaactgtttctaagaaaacaaccagaaaaatggtgaagtgctatttagacacttcagtgttggcaatcaaggtttgaagtaagcataatttcccaggattacccttaacgtgttttctatttggggatataaagcgaatcaacaatgcactcttcctctgcaataaggagcatgggtttgttggttgccattaaagcctgaggactcagactcattgcttgttgataactattattgctccatttttgagttccatcaaacaagagaaaaaaagtctttacagagtttatactgaggatatgcgtaattcttgaccctgaaatgtgatacctatagaatctaagagtttactgggaaaaccatctgctccgcaaagctaggtgtcccaaataagagaaaagttagaaaaagtttgtattatttacgtgactagaaatgtgttataaagacttttgcttttcagcctgaatctagtgaagacagaagtagaagttattcacgtataatctcatccagtctggtattaatgaaaatggataagctaaagtccattcctattgatcagatggagaaatcagaaaaaaagatatctaacatcttcaatcattcagcgtattttttcaatcaatatctcagttcagtcttagtgctatttgcatattacataaaaatgcagcacttaacaaatttaaatctcttatcctttttctgaaaaaaaaaatggcatcatcaataaacatttgctgaaggtttgacagacactggtcactcagaatgtggtctgtggtccagctgcatcacatcacatgggagtctgtcataaatgtagaatctcaggccccaccccagaccagctgaatcacaattttcaattcaacaagatccccaggtgttttctatgcacagtacatggatgtttgagaagcactgttttaagagcatttttcaagtattggagataccaaaaaggtgtaaagagacttctctagttagttcctagactaggaagtaaatatacataaaagataaactatacaagaagcatatgacaactgccaggtgagaggtgtagacaattaacggcataggagtttgaaggaaggcaaaggtcactcaagattggggcagctggagacatcttaaaggaaagacagtatagctggccctctgtatccgcagattctgtatccgtgaacacaaacaatctgggatcaaaaaatattttgaaaaaaaattgcacctatacagaacatatacaaactttttttcttattattccctgaacaatatagtataacaaaatttacatagcatttacattgtattaggtataagtaaactagagatgataaaggaagatgtgcatagatcatatgcaattactacactattttatatcagggacttgagcatctcagattttgatatctgaggggtcctggaaccaatctccctcaaataccgaggagtactttacttggaaaataagaaaaaagggagtatggtaatactcaaccctcctttgcataagtttactctgtaacagttctgtaaattttatatacctagagctcttggtatggttattgtgtggagaaaaactatttggtctgaacaacttagttatggtaacttgaaaacagtatgcatgatgtacaaatatacagccttctgtgaataaggccaggctgttttccccaaactgtgtgtatttcattttttaaacaaatatattaaatttaggatttatttagaatgcaggaaaactcctttttgaagcactcctgaaaggaattcttttggaaaatatagaattattttataatatgaatagtcaattcctgaaatatatataccgtgagttaatattttcattatatttcaattaagtgcttttaaaaagatcatgcttggccaggtgcagtagttcatacctgtaatcccaacattttgggagctgaggcaggaggatcacttaaggccaggagtttgagaccagcctgggcaatacagtgagaccccatctccacaaataataataataataaagatcatgcttgtacatacttactatctggagctaatggttattgttttgctacagtgtcactaaacaaaaatcaacatacaaaggtgaaagggtggcacatgtctgctgattacatttaagggcccccaaagtctctctttttgtccttgcaagtggtaggattgtttcactgcgatataaataaaacgccttagtaattacatcctgagaacaccatggctcagtactattcatgccaacttaactgaactgaaacatggcactggtgtcagtggcttttacttattgatggatttgtaaggtggcaggctctttcatgtccaaaagcggtagtttcccagggtctcaagaagatttaaaaatattttccttccatcacaacacaaagcctactgactttaagtaatgctgctgagggttaacatttgaaactgacaagcagcacatgtgtattacagagataaggcctggcacatgttgctgcagcctcctgagattttgaaatgctagcagctccagctggtggctatgctccattcctaatgtgcactttttagggaaacttgagcccctccttctgactgtgatagggacatgtctgattggaatagggttatttttaaagatattcagaacaacgaacatatttattctaagaataaaaagagagtggaaagaaataaaagaggtaaaatgttaagctgagatcttaaagaaaacagtatcacttgttaaaaaaaaagaaaaatagtgaatgcagccaaagagcagttaaaaaaaaatcactagggaagaatagttttaaaaagaaaaaagaaaaaatgaaggaactgaaaggcactttttatgagaatcattcagataaacatactgaaaaatagcgaggcaaaaaagactgatacaaggagtagggaaatgaaaatgagttaaggaatggggaaacaaaaaccagttgaattccaaaatgaaataaaaacatagagattaaaaaaagaaaaagtacactatggaagaagacagctatcaaaatttctcaatccctatgggggctaaggtggcacacatggaatggaaggcaagggacaagaaggtgggtttggaagtagacagggcgacatagttctgtttaaataatattgataggagcccactggtctggactgaactccttcctgcaaaaggcccaacacaccaaaccaaaatggagtcacagatggtaaagttccatgttaccaagccaaaactcagtttatctgactttctgagagatcaggagagtgagagataatagcaaaatcttcaagttttagctggcatgataagaaaatcctctctgctttaacctttacaaggaaattaattttgaaataaccaacccactttttgttttctgtttctgctttcctcagtccttttgtgactataaaaccaactgctcagcttattggggcactcattctattttacagaatgaggtgttgcccaattctagtatcacaaataaaagtcaattaagatctttaaactaaatttgttgtaattttgtcttttgacaattcttagctgtaatagaagatgctaaggccagagaagcaggcaaagtcaaaactaaattcaaaatgttaggggcagagtcagaaaaagtacctaatccaaaaggatacttaggcaaatatcctcaaagagttaaaattccatgggtgacagtttcatgattggttactgaagttaactggaatattatacaactaatcttttgaggttggtgtttagaatgttaccactctcatctacaacatatatattagtactattatcacagacagaaatcatggagaacagaccagagactaactcagcagcagaattatattcttaaatgctttaagggcattcaaaacatgttttttgcattatatgcaattataatttggaaatatattcttgacattataaaacacaaacaattcaagatggaaccaggtagaacagagttaagatgctggctttttaataagaatatgtcttttggaaacaataaaaagatacttttaaaattctttaattttattttagagacaacaatcttgctctgtcacccaggcacaatcatagctcactgcagcctcaaactcctgagctcaagggatcctcccacctcagcttcctgagtcgctgggactacaggcatgtgccaccacacctggcttatttatttatctacttatttatttatttttatatttatttttcccagctggttttgaattcctggcctcaagtgatcctcccatctcagccttccaaagtactgggattataggcatgagccactatgtctggtcaaaagatacttttttaaaaaggttttaaaattaggttctttgagcctcatttctccaactataagatgaacatcagaaagtttaccttgaagggaactgaggattagagcaaatcgttatcaagtttctgggtcattaactggatatagcagtcataacaaatagttcatgagatgtgtatttaaacaatacagaatggacatttaattcatcttttactaacactcattctctcaaaaatatatactgagttcttactatgtaccagacacttttctgaatatatcagtgaaaaaccaaaaatcctttccttccaagagcttgcatgctagtgaaaggaaacaaaaaataagtgtgttcaatagtaaatggtatagtatgtttagaagctaatacttacttgttacagaagaaagtaaaaccaaatatagtaggataagtaattgagtgttaggctgttacaactataaatgtgggtgggaaaaggtaggctttgatctctttgagaatgagatattcaagcacaaatactactaagcacaaataactgaggtaactaagtaccaatttggatttctgcgaataaattgtggatgatatatggatggtgtttcattgttgttactgttatccaaaggcataagaaagctaaatttgctggaagaatcttatcttgaaatattcttacaactatattctattcttcatgctattcttaacttctctttggcctatcacagaacagtatttgtttaaagcgcaaccatttcttttgaccatgtagcagcagcactcattaatgccatgttcaaggttatcaatcttcagacaggcttccttctcaaagcactccccatctctcatattgcttccttattctcacagtacttattttactcatttgttgtctgtctttctattagaacaaaaactttgtgagaaaagggatttttttgtgccattactgcagtatccgcatgcttggcattgtctgacacataaaaagcacttgatacatggttgaataaataaaagcggtaagtaagaattagttttagaaaagaaccacagtgtagaaaatcattaggatactttcacaattaataaaggcttgaaatttagagatttaatatttgcaacttcaactacttaagagaaattctaaaagtatgtgatgtgcactaatttgtaatactgcagaggctggtgagtgggagcaaatcactcagctagtgagtgcatcctaccaagctgctcacataacatgaggctctgtcattctctactgacgactgagcatacggctacgcagcaagttatttgctagaatggtatgaaaactggagattcaagatcccaggatgcagtcctcttgtatataaaagcctttgatatacttgttataattagagaaaatattttatataataagatgctgattcctaatctaacagtatagaggtagcctgatagagtagccagagtacagaacggggttaggaaatttgtgcagatttgtcttaagctgagtgagtgacctggacagatcacttcatgttttcatgattctgttttttcatagataaaatggagttacaataatataagtaaataagagtacctatatttcaccatattagccttaggaccaaaatgaaatgttctatatttaactgctttataaattgaaaaagatttttggaaaaatataatacttgtcaaaataaaaactatgcttttagattttatttagaaaaatttcaggtttatgaaatttatttatgaaatttctattcatattcatatttaagtgtgtaattctggatgattcatttctgatgtctagttagctctataatcatgactaaaaactgtgtattaattaaaaactactctgtgtgtgtgtgtgtattcttagatgtcaacattctctaggagaaaaataagacaaaacaagaaaatacctaaagatcaaatgtacacatggcacaaagatagacatatggattaatggaatagaattgagagctcagaaataaatatatacatccactttcaactgattttcaacaaagttgccaaggccaaccaatgggggaaataataatcttttcaacaaataatgtttcaacagctggatagcaatgtgcaaaaaaatgaagttcaatccttacctcacaccatatacaaaaattcactcaaaatgaataaaaggcctaaaagcaagacctacaattttagaactcttagaagacaacataggagtaaaacctttatgatgctggctttgacaaaggattctcagatatgacaccaaaagtataagcaataaaagcaaaaaatagataaattagacttaatctaagttaaaaaacttcctgcttcaaaggacaccaacaagaaaagtaacagacagcccacagaatgggagaaaatatttgcaaattatatctctgataagggacttttattgataacatataactcttacaagtcaataataaaaatgacttaatttaaaaataggcaaagaactgaataggtatttctccatggaagatatacaaatggccaataagcacataaaaagatactcgatatcactagtcaatagggaaatgcaaattaaaaccacaatcagacatcacttcacacccactgagatggctagaattaaaaagtcatactaacatatactggtgagaatatggagaagtgagaaccctcaaatactgctagtggtaatgtaaaatggtaaatggtgcagccattttggaaaaaactctactagtttttcaaatgattaaacacagttaccatataactcagcaatactactattaagaatatactcaagataactgaaaacatatattcccacaaaaacttgtacacagtgtttacagcagcatcagtcataatagccaaaagatagaaacaacccaaacgtctatcatttgatgaaagaataaacaaaatctggtatatccatacaatggattatgatttagccataaaaaggaataaagtactgaatgcatgatacaatgtggatgaaccttaaaaatattatgctacatgaaaaaggccagtcatgaaagaccacatattatatgatctcattcatatgaaatgtccagaacaggaaaatctatagagatagaaagtagattagtgattgcctagggctgagggtgaggtgggaagtaggcaaatgatagccaaaaggtatagggcttgtttttgaagtgatgaaaatattctaaaattgtggtgatggaaaccactgagctatatgtttttaaacaagtgaatcatattggtatgtgaattacacctcaataaagctgttaaaaatcacatgtatagaccttgctcaatttttacacaaagattttcttattttcctttttaaaaagacttctctgaaagaattaaattaccagacaggccacctaggtaattataaaacaaaaaagatgttcttacattgacttgtatttcgatttcataaaatgtgactaataataataataatacttaaacgtacttaaagctacatgtgtctacatcatattatgtctatttttcatttatcacaaataaggccactgaaccttgaaaccttggccagtatcatactgtttaagagtgcagagtatcattaaatagtgataattataataacctctattacaagagtgacaataatgttagctaacacttattaagtattcactatgttctagaaagtttacataaattatctcacttattcttcacaataataattccatgaggtagatatcattattattacaattttacaaatgaagaaactaaagttttcaaaggataccacacttgccaagagcaaagctactgagtggtggaggtaggatttgaacttagatagataacagaacccagggtcttttttattattattattattattattattattattattattattatttttaaattgagatggagcctcactatgttgcccaagctggtctcaaactcctgggctcaagtgatcctcccgcctcagcctcccaagtagctgagtctaaagtgtatttcaccatgcccaacagcacccagggtcttaaccactttgctatacttgttggttcctattgtctacaaaaataaaaatcatgtaccacatttcccagagctgcaactttcaaaactgcacattataactctaagccatataaaggtaaaaggaaaaggtataattcaccaaaagtactaaaagtttactcagccaaaattcagaattttagagttggaaggagaagcataaatcatttagtttgatgacaacttagtgcaaatgataaaactgaaagactttggcctaactcttcaggttttaggaaataaaggaaattcaatgatgatgagttttccacaggtatgactgatatagaacttattaattcattattaattcattcacctattcattagttatttttcatctcagtcaacaaatatatactgaaagtcaactacacaccaagcaccctgctaggttacaaactccagaaagtaaaaaatgagtatgacggtcccattcttcaaggggcttatggtctggactggtgggggtgggggaaaaggtgtaaaataagaattcttattttatatatcactatataacgtgataagcaatactcaataaacatggcagggagttattctgttggaaacatccgggagggctttaccaagaatatcattaaattaagagataagcaattatttccaagaagatatcttccctccaggaagagggtagaggaatttagccttgagtggttggaaattcaagtcatttagaattgcttggagcatagccagtgagggtaagagactgtgttaagcacatctttttattctgatgttttaacatctggggccttattgaccctgaggagactgtccctcccaaggccagccatcttctagagataataaagggctcccctgtgagattgcctttcatatgcaaaccaaccaggtcagaccccatccactccaacctcctctatcaggctcttacaatctggatcaatattcccctgccctaatttcctcagggacagggtcagacaacttagaacagccctgtacaccctacagtccactgaaattattcaaactagccaatcctgaacttgttagcccttcctcacccattccttcccaaggaaatcacaatagaagctcttgcccatatttccccctattcttctgtttcctgacccaccctcatgtttccctgtgtggccctgcatgtgcagtgtgcactgtcctcttggggattgtagctatcttttcaatggcaatcatctgatgcattggcctcaccatccctgaatgataataaaactgacattataaacaaagattcaagcctgggtgccatggctcacatctgtaatcccagcactttggaaggctgagacaggaggatcccttgaactcaggagtttgagaccagcctgggcaacatagagagaccctatcgctacaaaaatttaaaacatgggccaggtgtggcggcacgcacttgtagtcccagctacttggcaggctgaggcaggaggatcacttgagtctaggaggtagaggctgtagcaagctatgataatatcactgcactccagcctgggtgacagagcgagactgtctcaataaataaataaataaataaaacaaagattcagtaaattctgctacatagacagaaaggggcaagaccatgtaaagtgttgtctgaggagttttaactactcaggagacattgggagccacagaacagtgttaagcaggggcataatatgactagatttacattttaaaaagattactcaggcagcagtgtggttacagaattgcagtgaagtaattctgaaggtatggagactaattaggaggttatggtataaaacagtcgggaagtgatgaaaatctcaattaaggtaggggaactggaaatggacagaaaggaatatttacgagatggtgagaaggtatcttgaaggacttgattgactataatgggttggggaaaggcaaaagcaaagacacacttcaaggtttctggcttagctgactgtggctggtaatgaatttatggagataagaaaagaagcacagaagcaagtttgcaaggaaggagaatgggatctgcttgcctgtaggattgttcttgtagagatactaatagccagttagaaacatggatctggtgctcaggaggtgttcttagactggaaacaagatttgagagttaccagcctactggtggtggttaaggtcataaaagtggatagaattatcaaaggaagacatgcagaaaaatatcaaagttcaggttgaaaacagaattccaagaaacaccacaacttaaaaggcaggtagggaaatggtgtttgcaaaagaaaatggatgtggtaagataatctggggagtctggcagcagcagcagcaacaatggcataatcatcaccatcatcaccagatggctaatatttcttcagcattactatgtttcccacattatgtcatgtgttttacatgtatagttcatttgctgcacatagtaactgatagtttggatatttgtccctgcccaaatctcatattgaattgtaatctccagtgctggaggtgaggtctggtaggaggtgtttgaatcatgggggcagatccctcatgaatggcttgggccatccctttggtgataagtgagctctcactctgagttcaaaggcgatctggtggtttaacagtgtatggcacccccctccccaccaccaactcctttgcttgctcctgcttttgccatgtgacatgcctgctcttgctttgccttttgacataacagtaagcttcctgatgcctccctataaaaccatgagccaattaaatctcttatttataaattacccagtctcacgtatttctttatagtaatgtaagaacagcctaacacagtaactcagtgaggtttaagagatgatgacataggcctacagaagttaagtaaggcctataaaattgttctcctttgcaatctctctaaagcatggcttcttaaactgctataatgtgtccattgaagaatgatgaggttaataactttgaaaaggagagcttatttctcattaagggttgtagtctgaagggtggccataccaacaggctaggaagcataatctctggccagaagccagaaacatgcaattggagggaggggtaaagggaacagaaatttatgctgagcagtttggctaagtataaatattcaatgggttataggaggagctatgaatattcatgaagtaatggcatgggtatgcacagtaggccaatgtgtatgaaacatgtgtcccattgagagaagagaaaggaagaagctggtcaggcaggcgggcagggagggtgggtcctcagttgaatcctttcaaacaaaagaacagcctgcaggcacaggtaagggaactgcacaggatggcttgcctaagacatgcccacagccccactgataagaaaggctacacaagtgacttgcccagtcaggcttgcaatggaaaattccatcccctgacacatgtgcagtaaggggaacaaagaaatatggagtaagtcaagctaaagcctgtatgcacattaggaggatgagctggagctaccagaaattcatgccttatgcaaatgagacacccagccctcaatgttttcttataaaagtctttgtattcaactgtacaaatggtaaccctcttctgggccctctctccctgtcagagagctttcttcttgtgcttattaaactttcactccaacctcactctttgtgtccacgctccttaattctcttgattgtgagacaaagaattctgggtgatacctcacaatgagagactgctacactgtggtgcactggtgagactgcaacaccatgttcactctagggtgaagatttaacatttgaatgtattacaattaggccttataaatcaaaaggtaaagcagaggacataaaagccctctgtgctcagtctccgtagaatggccagaaccattctgtggttggtggtctctaatcaggaaggaatgctggtgggttgccctgtcaaaactacagaagggagggcagcaatggtttatatggttgatatcagcagtggagcaagtttttcaaaatggctagtttctctttaacccttagggaaggctaatgatggttagcaaaggagtaggtataatgagatgtgtctgatcccgcatcccctcatggctgggaactcgtttattttcgtgttttgtttttgagacagggtcttgctctgtcaaccaggctggagtgcagtagtttgatcaaagctcagtgcagccttgacctcctggactcaagtgatcttccttcctcagtctcccaagtagctgggactacaggtatgcaccaccatgcctggttaatttttcagtttttgaaaagacaagatctcacaatgttgcccagttttgtcttgaactcctggcttcaagcagtcctcccaccttagcatcccaaagtgctgggattgcaggagtgagtcaccacaccaggccagggaatttagcttttaaggtttctctggggtccccttgtccaagtgagggatctgttcagtcagtagggagcttgggattttatttttatttctcaaatgcctcagtactggctgcctctcctcctaaactttcactcaatccatactagatattgtcacataactcttactttgatcacatgacagtgctactttgtcagtaaccttcaatggtttttcatgtttattaagtaacaaaattcccagccttggactcattatgatgctaatatctctctagctttattgtctactattatactatatccaatgcttcaaactaaattactcagccttgcaatctcaatgcctatgtgacataatctctcattttaaaagtacagattcccatttcagattatagaaattctaagtattccacagggttcaccttctttcagatgtcgcactctctcggaaaccttacgcacttactccagagatgtaagcactttccttgaaaatcttattcacaacctgtatctctcttaaagcatttatcttactgtcagatttattttgccattgtctgtaaacttatcttttcttacaacagtttgcaagcaaaatctagtaatgccttgactaccactacatttcaataaataattattgactcaattttattcaattttgaactcttatcaaagctctcaaatttgctatctgtgttctttgggcaagcttagtatctttacagatggtgtaattccattggaagtttcttttctttcttgaaggtcataaaacaaggatggcccaacatctcatactgaaaacagttttccatctaattttttgatcaactataagattattctataagaccaaagcaggaagcctataaatatatatttactattgtcacactaataattagtctagcaaaatagtatgcttatgttattgttctttaggataaactgacaatgtaatgttgcagtttacttaaaaaacaatacttactattataaccacacttttagttttttcatttactaattcactactttctataatcagagtcagtgtcaattgttttcccatgatcttatgtaatttgagctttagcaccatcatcacatatatgtatgaaaagaataaggttccagatctaaaggcaacatctggtgcttcctttcctcaattactctcctaaaatcaagacataggaacaaggttgcccaaaactcattcaagtcttcccatcttgcccattatgtgtcaaatagttgtgtggtaccctcacagcatgtatcctaggctctgagaaaagtaagaaaaatccatatttatggaatattctaagaagtttgcccatattagctgatataatcctcacaaccggcttattctttttccgttttattggtgaagaaacagattatattttacagatgaagaatctcaggcggcctggctctagagcccactgcaaagcaccacatgtcaagtactggcattcattattcattcttcctgcttctgctccggccccactttgtctattcaccacatggaagccagcattattgtgttaaaacatgttaggttatgttggtcctctgctcaaactctgcaatggtccccttcttactcagagtaaaagctaaagtattttcagcagctttccacgctctatgtgatcttctttcccatcctgtatctctttgacctcacctcacacattcactccactctggccacactgtcctcctgacttcttccaatatactaagcatactccagctttggcacttgctgttcctccagcctggattgctaggtgactgtcaccctcatctccttcaagtctgtatccaatgttaacttttaaatgcagccttctctgtccattctacttaaaaactataaatccctcccttttctggaaaaccctatttccctcccctgctttattttcccctacacacttaccatcatattatatattttacttatttattccgctcctgatctgtttccccccaactagaacgtcctctgtgaagatagattttattgtttgttcttttgccactgtatttctactgtatctagaatagtacttagtatgtagtaagtccccagaaaatatttgatgaattaactaattaattaattcaaatatctatatggaagttggagctgatgttgagagactgaaaaagaatggatggctacaagtcttacaaggaggaatacctcagaggcctggaacacggagggtagggaggattaatactaggacaaggaataaaaaggaagaagctgtcttgggttaatgcttggtcttcaactccagggattcttatttgacctttgtgtatcttcctttaggactagggttcataattttgtcttatgcaaagacaaagttaagaacctcttttggcagcctgatggagcctatgaacccttctcaaagcaatgtttttaaatgcataaaatacatagaattgcaggaaattaattactctaaaataaaattatcagaatattttatattttgtgatataatgtacatatttattaaaatgtagcagctgatttaataactcttataattttaaaatagcaatgactgtaaatgatgttttaagatatgtacaattgtaatgcaatgtgaaaatgtttgcaatttctggtggttgctaagttaactactatattaacacatagctataacagtgattagttgtttatatttatggaattctaatattcagtcagatattagtgaaaataaacacgattctttttttctcatccaagttcacagaccccttgtcttagtccgtttgcattgctataaagaaacatctgaggataggtaatttataaggaaaagaggtttatttggctcatggttctgcaggctataccagaagcatggtaccagcatctgcttctgatgagggcctcaggctgtttctactcatggtggaaggtgaaggggaagtggcatgcagagatcacagggtaagggtggaagcaagaggaagaagggaacgatgccaggctctttttaacaaacagttctcaaggaaactaacacagtgagaactcagtcattaccctgaggatgccaccaagccattcatgagggatctgcccccaggacccaaatgcctcccactaggccctacctccaatgctgagaatcacatttcaatatgagatttgggggagtcaagcaaaccaaactagagcacccctgaattctattcccaaaagccataggggtctgtagacatcaggataagaaccttgctctaggattagtctcagggtacacccaagggggaagaggatcaaaattaactacaccttcactatcacagaagcagaaggaaaaaaagagacaacaaagaaaaacaaaacaaaatgatttttttccaaattcctttaactaaaggcaatctttttcaccttataactagaaaatagtctgaaaaatgcaagtatttatgagttttggtgtatcagtatgaataagctttaataacaggacaatgttactttctaacattgatgagaaattcaaaagcaggaaagcatagaagcctccaaatcagtgcaaagatctgatgcggtggggaagggagggtgctggagtgagtagtctggaaataaagaaaacaaaataatgaaggctagatttatggagtcctgtttatcttttttctcttccctaaaaagtaaaagctatgtttcaaagttctttatgttctcttcaaggtccctgaaagcagcttagcaagaattatggtcaggaatttctccttatcctggttgtcatctgtaacttttggcaacaaaattggaaaatacttcataccagatgccctcttttggagattcacaatgcatgtcagcatttgacatgttctagagtcctttagtacacaaatctgcttaacttcatttaaaccagtatttctcaatcttatttgatcgtaaatttttttccatttaatatatgtctattattgcaattataagactttattgcaattattgacaatacaattcttttcttcaactaggacataaattcctctggctcagcaaaggtgtcttgttcatgttttcattgctagtactaagaactattaatacttcatatgcactttgaaagtctgtaaatgtttggttggttagtggttggtgggttggctgactgaataaatgaataaatcagagacaaaaatacttcaggccaactttactgtgtatattatctctgtaacatgtcaggaacctttagaagccttttgaagtaagtttaacagtgaaaaggataacaaagaaaaaatggctgttaacagctaactccccagtggaaatctacatacatacttatgtttaaaccaaaataatagtaaaactttccagaagaaaggtatatttctattctaatcatttctgtagctctgaaagtagagattatagtgttaataattcaaagagccatttcatttgcattctgtgtagtaataagtgtaacatctcagcaagtgtcacaattcctagaagtaaattatgttaattaattagtaggaaggcttaaaggccaaaactggaaataatcccaaaaagtctctaaatgttgcctttaattacttagatcaagtttatgggtgataataaagtaatacaaagatccatagatttacaggtttggaaaaatacatatatattggttggatttcgatcctgtaaggttataaagaatgtgtttccatagtccatctgtttttagattttagtcaattaattccatccacacatgaatctccacagcagaactaataagaaagcaacatctgctggttatagtagggtgaaatatagcattttttgtttttacaaaacttgagtttttaaaaaatctacaaaattaaaattaacactgaaggagcagcataagacctcattattgccacaccactactttaagaacaaaaccagacatactcaagacctttttcatcaaagactagggggttccaaatttactaaaacctaatagatgccaaagttaaaatagtttaaattcaagattgcatgcatttttgctatttctacctcctgcttttgagagtaaaagctatttatatgtacgtgatatttaaatctctggaaaagctccagagaaacattgaaacaatgaataaaggctttggtgttttaattactgttactgtatatattccaaaataaaacaaacatttctatcaagaatttcttcatctatagtaaataaactatgtacttgcttgtgcccatgtccaaattaccaagttcttccagttctccttccaaaatatatttcaaaaccttccactgttaccatccaagcccaaggtcccattatttctagtccgatttcctttattttcctccaacaaattttccacatcatagccacagagctttttaaaaatacaacctagatgtcattaattctttatttaaattttccatggagcttcctgttgcactcagagtaaatataaactagttaatgtggccttcatactctggcctaagcaatctctttagttaccttgtaggctactttcctctttgcattgtaggctagagccaaattagacttccttgaattcctagaatatgctaggttctccccagatttagggcctctacaggcttcagaataaatgaaaatctttcaggaattcctctacttcagctaagctagagcctcctgttattaatataatttcttgcacaattatcagattcttctaaaagacttggcatagttgtaatatatacaactatgtaatcatttgtttaataacaatattcctcactagactataaattccatgtggacagagccaatgtctatcatgctcagtcctcaatacccaacacccacagtgtatttaataattttagtcaaataaaactgagtaaatctcaatctaacaaaaatggaggtaaaagggcaaaaatcccttaaagtgaaatttatttctagtttacccaagtctgtataccacagggaatctctgagagttttattcctaagacttttctatattctccactacactagaagatatgcctgaatatatgaaagtattgttgatattattccaattattgcttgagactgaagcctccattccagaaatgtatgtgtcaacctagaacctagagagcatcccaatgcttggttcctaagtgaggtaatagtaaacattatcgtggcaaaataattctgtatcagatgtgttggtgccccgtgggggttggaacattggtattcatctagaaactatgttctaagtttgttgtttagatagtccttctgtggtagtttcagatgctctagaacaaatcattcataatatttaaatacacacacacacacacactccatcagaataaaggagtacactgtaaatgcaatgtgccaaaacaagaacaatatgttactacaaaatgacagttactacaaatttgccagttacgtcataatcacaaataaaatggggaaaaaagaaagcaggggatggggaggaggttctgtaatcagaggcaatataatacctctagagaatcacacactgaacaattatcagctaccctgccccagtcgttctctcccgtttctgcttcattcccctggcctcatcggggcttccttcccctttgtttgcaggccacattaaataagacttttaggtatattccaggtcacgggactatcatattcctaccatagtctattgaatccctcatatagatcataagctctttttttttttaatttttcttttgcaagctccagttcagctccagatcattagttctttcagatcaaagaacatatctcatgttttccctttcttttttaaattccagtttatcaaagcataatgttttgcttggaagactgtatgagaggatacaattaccatatttggtgaactatatgatgaagtaatatttaaaataaatctggaaacataataaacatttttgtaaaataatttaccacagcactatttatcatgtatctgttaaaaatgctgtttaaatggttttataggggaaaacattattttgttcctatatttacagtatgtcatacctaggaggctgagatagtataaagttctttttgcctttaatccaatcagttaacgtttctctgggttttgactttctatccataatacaagtaatcatgatataggaaatataaggtaaaaactgtcatctatcttgttgcttttggatcagcttacagctaaatcacctggaaaaaatattatgcaatctctacttttaaaacttaacagagaatacttttctatttaattttcaaaagtcattagatttgcacatgttttatgccctggtaatattgtgataggatcacgaacatgtaataaaacaatatgatataatggttaaaggcatgaagttgagagcaacaatgtgaagatttgaatcccagttatgatacttaatggcaggaacaaccagaaaagagaaaaatcttcatttaaaaaatttagttaaaaaatccacgcattacaagaaaaggatatataaaattccaaacctctgacttgtaaatttgaattacatcttctgctttttcaggaaaagattgccgttgattcaatactattatatttgaataaaattttaattttcatagaaaaatatgatacaatattgttttatacagtagtttaatgtcaactgctgtttgttactctcttactaggttgcaatgtttcttctttttatattcacagagagagtaattattttcaacaaatttggggattgagcattatttaacaccaaagcaaaagaaatccaagacacacagttattctgaaatctaagtattttctagtatgtaatttttactaattgtattaaacccctttcagccacctcctcttcaagagaaattcttttctttagccagaatattttattaaatgaaaatatttattttaaaaattagttgctatttactttgctatttacttaataaatttgttttacttaataactttacttaataaattatttaataaattgctattaaatacttttaaaaaagtcatttaaattcattgttaaaaaacatagaaaatatagtcaatccccactgtttgtggattccatgtttgtgaatttacctactcactgaaatttatttgtaaccccaaaatcaatattaatagcacatgtatggccattggtagacatgtgcagagcagcaaaaatttgagtcactcaaatgagtactcatgagtactcccaaatgagggtgaacaaggtgacactctctgccttcttattttaactctcacacttcacactttaaaacaaatgtccttttttttttttttttttttaagtcaaggtcttgctctgttgccctagctggagtgtagtggtactgtcatggcccactgcagcctttaagtcctgggctcaagtgattcttccatcttagcctcttgagtactgagtagctaggactacaggcacaggccatcatgcccagctaaggtttttttgtttttgttttcgttttaaatatttttagagacagggtctcactatgttacacaagttggtctcaaactcctggcttcaagtgatcctcccacctcatcctcccaagttgctgggattataggtgtgagccactatacctggctataggtgtcctttttgcagtgtacttggtgttacattttttgcatttttgtattttctgttggtgactttactatttaaaacagttcctgagcatagtgccgaagagctgtcaagagtcctaagtataacagtgctgtgatgtgccttataaagaaaatatatatgtaatgcaggcatcattcaggcatgagttacagtcatgctggccatgagttcaatgttactagatcaacgatatttatttagtgtctttaaacagaaatacacacaaaacaaggttatatattgatcattaatatatttgttgtgaccacaggctcacaggaacctaactctgtatttctcctaggaacaatagttcagtattcaccaagtcagtgttcatggtaactttatagaacttaactactgtaaataatgagaatgaactgcacaggagtaaaaaaaaaaatctcacccatagtactacagcctcgagtacctcttccaccacatggttgccaatgctggattttatctatttttttaaattttgccaacctcactggtttaaaaagttgtattattcccctttaatatgcatttccctgatcaataaggctgaacatatatgaaataggcatctttcctgtgtatcactccccattaattttttctcttttttgtctttcttaagtacagaattataaccaactaatctttaaacatgccaaatgctaaaggaaggaagagaacaagaactgaaaaattttcctggtctttagctggttgattgtccaaagagatttgggtcagtgtttagctctggccaaaagagacccatcctggtcagacagcagttgagctgtctcataaaaacaataatcttgggaaaaaatataaaaataaaataaataaataaatatatatatatatacacacaaacatacacacacatacagggtgtaagcttgttaagctaatttccagttaataggtgctccagattacccagtgctatacattcattctctttgtaatacatattgattggtggtaatgagcccacagatgtccacagcagtaagctttctagtatgtacaagcatatcttttgaagatctatacagttaattatactgatcttggaatttcaaaagtgaattatgagaaaggaaaaccttagtcctcttcaggctttgtagtttaggggacaaaccaagtataaagaatgagaaagtgctcttcaagataaaacgtaggaagacatgttagaagcaagtggtttggaaagggagcttatatcatggattaaaattagatgagtagacatccaagaaaaaagtctcaatattgatctccattgttagcccctttgaaaagactggtctttcctttcctaacctgctctctgagcctgctgaagaaaagaagggaacagccttgtttgaaacatgactatagaacccgtgtggctcttctgagtcccctgagttcctttattgatttcaaaaccatgaaggcttttgtttgaatttttgccatttcaaaaaatgataataggtccaagttattgttaaattctcataagaacatcaaacattttctgactagaagacactaaacatctggtataatttgcttcttaggataactttatttaaaaagagaggaaagagaaaagaaaaaggctttgtaactttctccaggaccatgtcaagaaacaaaggtattgataatgcaggatattttcttgatcccttcatgagacccatgacagcggtgccccatttactcagcctgccatgctcaatgccttgtgggagggcatgcgtaggtgagcaaatgcaggaaccagctggccactttggcaccggcagaagcaaactccatgcaggccctgtggcagcatccaagtgggggtgcctgcaatgccaagaccccagagggtgtgttacaatgctctcttagctccaccacctgtggacagcagtgtgttaccagctcagtgggccctttgccttatgtggggcagctgccctccgccagtgagggcaaagggccagtgtgacagcctttttgggtattcacacttggtgggccccgaattcttgtctggtgcccaagaagaatgaagtcacacaaatgaattgaaggatggtgaatgcggataatttcactgagcaatgaaagtagctctcagtggaaaggggagctggaggggaagggaagggcagatctctcccctgaagtcaggttgcctctctccctctctccttgaagtcaagctgcctccttctgacatccagccatcatctctgaagtcaactcacctcttctagatatccagctgcttctcccctctactggctgagtctggggtctttataggcacaggatggggggcagggtaagccataggtagttttgaaaaaggcaacattcaatttgtaaaaagacattattcagaaagaaccaatcaggaaagaccaggcaaatagggatagaagttctcactttgggccacgggtttcaggttttttggcttgaaggtgaggcttcaccagggactcacccctgtctgcctagagtttctctgcctcctacctctattattatttattttgttgtaaagagaagtgacaggtactaatgtcaaaatgaaacaaaaaaaaaaggagaggtgactcattttttcaaggttgctaaatactagcttagcatcttatttgagctttagaaagcaaggcccacctgggaagccagaaaacagttagttttaaaggtaggctaaggcagatgaatggataagtgatgaatggttaaagaaaatgtggtatacatatacaagagaatattattaaatcataaaaagaaggaaatcctgccatttgtgacaatatgaacatggaggacactatgctaagtgaaataagtcagagaaagacaagtactaaatgatctcacctatgtgtgcaatctaaacaagtcaaattcatagaaattgagagtagaatagtagttgccagggcttggcagatggaagaaatggagagatgatggtcaagggtataaactttcaggtataagataaaaaagttctaacttctgggaatctaaagtagagcatacatactgtacctgaaatttgctaaaagagttgtgatattgtgaaatatacatttgatctttgtctaaacacatttggtcttagtcctgggatacaactcctagaatctttggaatcttcaaagtgataagtacctttttgtatgctaatgagtttactgatggctgacaccacccaggtagcttcagaatgagagctgttcaccagaaagatcaatgtatgatcagaagggactttcagctctacttcctaacttttcgggagggaagagaagctgaaggttaaagccaatcatcagtggccaataatttaaccaaccatgactatgaaatgagactttcataaaaatacaaaaggacagggttcagagagcttccagatagctgagcaaatgaaagtccctaaagggtggtgcacccagagacagcatggaaactccacaccccttcttatacatttcctttgcatctttatatcctttgtaatatcctttataataaagcagtaaacgtgtttcccttagttctgtgagttgctctagcaaattaatcaaactcaaagtgggggttgtggaaactccaatttatttatagcaagtcagtaaaagcacaagcaaaacaatctgggaattgcaattagcacaggaagtgggggcagtcttgtggaattgaaccctcaacctatgggatctctaggtagataatgtaagaattgaattgaattagagggcaactagctagtgtctgttgaagaatccgctacagaattgattggttgttggtagggaaaaatccccacacacttcttggtgaccaaaagtcacagaggtcttttctgttgactgttgtgatataaaagcagaagaataacagattttttttgtttttgtttttgtagagagtagctcttcaatgtcctcaccacatacacaaaagttgtaactgtgaggtgatggatgtactaaataacttgactgtgataaccatttcacaatatatgtatatcaaatcatcatttgtacaccttaaatttttatagttatatttgtcaattttgtcaataaagttgaaaataataaaccagagagaaatatatgcaaagaaatcaaaactaagcaatattatactttattgtttattctgacaacaaacccaagtatagcactccaataataacaaataatggagaagacttctatattcctaagcaatgtctgttgaaatggtctcgactttcactgtccaatatggtagccacatgtggctattaagcatttgatatttggctagttagaattgggatgcactccaagtgtaaaatgcatgacagacttcaaaggtttagtgcaaaaaaggaaaaagattataaaatattccattaataatttttgtattgattatatccttaaaatattttggatatattaaattaactatattgttaaaattaatgccatctgtttctctttgatgtggctactagaaaatttcaaatgtattacattatatgtagcttgtattacattcgtattggatagtgctgactgaaaactatccaaattgtaaaatctgttctatttgcagccccccttccattgtattcctttagtctcagaacttaacacaacagtaggataaaaagtcatataagaaaaacgtcaaagaaaggaaaagtatttaccccattgccttctcccctttgatatatttaggaaaacaagactgttacgtacatttgaatcaattgcatggtgtagcctttttgtgctggttgcggcttcactgtttacttcctcacctgccacagcttaaagcagcactataagctgcactatgcttttcaatatgatgccactccttcctctaggcaccagcagtagtggtaaatgtgttacacatttatacttcccttttctacccacaccaccaccacccaaagctttaatatgtactaaatttccttaagttttgggatatagaggatttatgccccagaaacacaaatatctcagacttaaattttagaaattatgttctgaaaattccttcacccacccagatgctaaattctctttccccaggctcagcctctgctggtggcttaactgcttttttcccttttatttcttatgtagaacagtttagctacacttttagtttcttaccgtagtacaacttattcccctagagcctcacctacttccctctgtatcctaaatgactttgcctacatttctctatacaaaacttttcctgcttgaaaagaactactggaccaggtgcagtgactcatgcttgtaatcctagcacaccggatactgaggcaggaggatcacttgaactcaggagaccagcctgggcaacatggtggtacctcctctctacaaaatattttaaaacttagccagccatgtagcacatgcctatagtcccagctactcgggatgctgagatgggaggattgcttgagatggggagattcaggctgccactgcagtccagcctgggtgatagaccaaaaccctgtctcagaaaaacagaaaaacaaacaaacaaagcaaagcaaagaaaaaataatagtatttcctgttaaggcatttaaaaaatttttccaattttgaattttttttttttttttttttttttagtaatatagcccaatgccaatcaatgcagcctgccaaaagtcttcatctacagtagccctgggaaagaggaaaaatcctttgcagagaatacccattcccattagaagtaatctcagtgtttatcattaattccactggaagtaggaaaaaacacaaaaataagagactaagatttcagatgacgtgagataccacttttgaatgcaactccatccttaagataaatgccctggatcttaaatacaactttttctcctataagggtgaaacttcttgctgaagatccagactttccttagggaaacttgaaggcagatgggaggagctttaatttcctataagtaggagctcttcatttctctggaactttccttctttgccaagccaaatttaactccttctttaaattatagctccaggcatcatttcctcagggaagccttttctgaatagcctattccctaggcctcagccccaccccactcaacacagactgggttgggttccttcagagtaaaatcagtcctccatatccatgagttaatgcatctgcaaagtcaaccaaccacggatcaaaaatatttggaaaaataaaaaaattgtacaaagttgcaaaaagcaaaacttgaatttgccatgtgctaagtactacattgaatccacacaaattaagtgatgtgtaggcattgtattaagtagtaatagtaatctggatgtgaataggttccacgcaaatactataccattttatataagggacttaactatgcgcagattttggtgtctgagggggtactggaaccaagcccccaagataccagaggatggctgtatttcctgagcattctgtacttctcactaagataacctttatcatatcttataattattatgacttgagataggatctcactgtgttgcccaggctagtctcgagctcctgagctcaagtgatccttacacctcagcatctaaagtagctgggactataggtatgtgtcactgtacccagcctacaatacattattgcaatttatttgtctgattctcccagtatactgagagcttcttaagggtctcaactcctctttgaatccccaataaataaacatgatatcaggttcatagcaagtgtttaataaatgcctgaatttatgaatagataatgacagttgaaataaataaatatttactctaaatctcctattctgaaatgcgttccaatataccttatatgatgaagaagctacagaaacttgatggaaggaaggctaaggagaccttccaagacagctttttcctcatttttttatcattttggtttgcctccttcatgaaagattttcacaaatcatgagtttgaacacggacttacatttcagttacgcatgttttccccaacctctatactttagctttcaacccatatgttgttttgagaagtgggcctgtacttaatacctctacctgtaaataattccaatgaaaggataacttataaagcaaatgaaaagttaattaaaaaataaatctaattgaccttttgtggatgtgggtggaagtagtttaactgtacttctaagcttttataacttaatataacatctatttaaaaattataagtgaatataaataaactttattacagttcaattttaagaggtatacaattaaaaggtaaattatttagagtgattaaccatcccacttttcctgggattgggggatttctcaggatgctggtctttcagtgtgaaacctgtgacagtcctggccaaattgggaacggtgttggtcatccaactaatatacgacattgagatgagggttttctttctttttctcggttagacaaatgtttcttcattaaacacatgatcattttctccaggattattttgtaatcactgaatcacttaataggtattacaagttattgcatgcaaatcacttcaaagaaaataaattactaacacataactttttttatatatactcactgtacttggattactttcaattttcttatgttaaaatgcatttaaaccacttaatactttcctgaaaatgtatttttaaattatttttacatttgctaaagttaacaaaatgcttataaaataaattaagttgattacctaagaaaaatgtttcttttactataaactagtaatagaaatgcttggcacatgttaatctgtggatatgcctgttatctctggttaggtataaatgccttctctaagcgttgttatgtactaaattgacaggcaggaatatgaattcaccttccattttctcatcaatagagtgagataaaatcataatagagtagagagaactctgttttattccatttctactccgtagaactaaggattcttccatttccctttttctatttcatcaatttaaccttcatctactcatccacttaagataaagagaaaaaaggtaaacacatggtaaataacacccgactatttctcaccatgtctattaccaccatcctggtccaactcaccatcatcttgtacctggattataacttccactcttgtctttagactattctcaatacactagtaacaatgattcttttaaaatcaaattatgtcactcttctctccaaactcttcaataacttatggtcccagttagagtaaaagctaaagtcattatgaggacctatgagatctgccctgtccctcatctctctgaccttatcttctaccttgctcattacatggtgtttctagattacctcaagcaagctcctctcccaaggcctttgcactggctgttccttctgcctaggatgctcttcactgagaaatcagcatggctggctttttcaagagctttatatgtatatatgtttacatatatttatacatattcaagtctttatatgcatacaaatatatggaaatatatttgtatacctatatactgtgtgccaggtagtatatgtgccagtagaatatataaatatatttatatatatttatatacacataaacttgaacacacatgtgcacacacccaaatttttttgagacagagtctcactctgtcagtcaggctggagtgcagtggtgcgatcatggctcactgcagccttaacctattacaggcatgtgccaccatgcctggcaacttttgtattttttgtagagatgaggttttaccttgttgcccagtctggtctgttgttgttgtttgtttgttttatttttgtttgtttgtttgtttttaaatagagacagggtcttgctatattgaccaggctagtcttgaactcctgccctcaaacaatcctcccacctcaaccttccaaagtgctgggattacaagcatgagccactgtccctagctaaatgttttcttaaatatcactttcttagtgagcccttctctgatgactccaacttataatcaaatcctatctacacttccttaactcaggttgcttcctttcttcattttccatcatatgaaatactatgtattctattttttatttgtttattatctgtctccaactagaatgtaagcttggtgccctgtgaggagattttatctctctgtctctctcactttctcatttgttttgttcactggtgtatccttggtgcctagaatactgcctggcacacagtaggcactcaaacatttatgaatgcatgaatgattgaagggcaactatgaagtcctgtaagtcagcttttcttagcttcctggaaactaaaattccaaagttgaaattttcttttaaaataaaaataatgaaatctgtttaaaaagtaaaggaaaaggaaaaaaccccaaggaaatggtaatatattgattctgaatagtaatttgtgtctcagtgtgaccaaattgaccagacctgcttagagactttgttctgttaagacaatagaggaaccccgggctgagacctcaggactatggcgaggagaggaaggagctaaacaatataatctatttctttcacattttcagtggagctggccttgacttcacagacaatgacattttatttatttacttatttttgagttgtaaaaacttgacattttaagttttattttgaaagaactgtaaatttatagaaaagttactaatagactacagataatttgtttttgctatgaatcgttcaaaaataagttgctaatctgatgctccactacctccaaatattttagtttatatttcttaccaacaactacagcctcctatataaccacaatacagtcttcatacttagaccctggtgaggtttcactaattatctcaataatgtcatttatggccaaagtatcctgacttggaatcacatgctgcatttagatatcatgtctcttcagtgtttttcagtcctgaacagttcctcagtctttattcaactttgtgacctttatatttctaaagattagaggccatgggcatgtcatatttctgtataattgaattcagttataaatatttggcaggaatatcacagaaataatgttacattctttttatttcatcctatcttgtggtatatgatttaattttcctccaatctatgatattcacttttatcactacatttttttaatatttcttattgtctgccagcctatgttaacattattaactataatgttaagggtttttttttaattaataaatattttgtgggaagggattttgaaactatatatatcccattttaaacaaaattttgattaattaattactatttgtctaaagtcttggtttcctattttagtaacaatgaatagattataacgtgttgctatcatgatttacttagatgctcaaattggtttcgattcaactagtggaaccccttcaagctggcttctgtgtcctattgatatgtcaccattactttggcataaaaagattttccaagatcatattgtattttgcttcccctagttctggaatttgccatttcacttctctgaggatcttcatttcgtagagtgaagaatggtatttagaagtcaagatctggaaactaggtatgttctttgctatggaatatgtgtatgggaatacatgcatatatatatatagagagagagagagagagagatgtatttttctgagtgtgtacacatacacacatttatatcttttatttctacatttaatctgtgtatattgaaagccatgccttcatatcatatctccaatttcaattcgaacacaaagttcattgcagttttctcattttctgtatttgtatatctctcctctgagagaaatctggctcctattgtctttaatttatctagttatttgatgaattctaccacatataaccaacctcccatatctgtcatcatctattccccatgaagatgctcttctcatctcacacaggcttcaatatcctgacccaggcgatgcctctcacctggatgccttggtcatgccaatcaggctctgacacaccaggccagatctcccttctgtatcaatgcccatctggcactgggctgcctccaagtgtgaatgctctcttcacctcactcaggttctgactccccatgccaggctgctccccaggatcacaggccctcctctctgtgcataagatcgggcaccctatgccaggccattccttctacagggaaaccatgcttaccccacctgggctctaaaaccccatactaggttgtctttccaagtctgaaccttcctcatcttacgctaagctgtcttcaggtgtggatgctctcttcttctgagatttcctgtttaatagattttggatattcatatatgtatatatatgaatatatacatatatacacacatttatacatatatatttaacagatctgtaatattttacatatcatgtcatactacaatatgagtggtgaaaacaaggcaaattcaaaagtctgggggaaatcctggactttttttctttaataggaccatattctatttcgaaaaatctattcatttgtccagtacatgactctagatgtattcttccattcatttgttccaccatcaactatttatcaagtgttttccacattcgaggtactctgctacatgctagaaatactaagatgaataaaacatgatcttggggaacaatttcaggaagtagacagacggtaaataaataagtacagtaaaatttaacaggtgatataaaaatagtatatatagggtaaaataaggccacaaaagaggaagtagccattctgtctgagggtggtgggaccaatatttaattctcaggtgcttgggcaaagtttcaatagctgaggaagtttctctgtcaataagacaataagagaaggatatagaaacagaagaaagaagaaagacactggtttattaaggaagaataaatagtgtgatataatatataatttttttttctttagacagagagagtatcacttttttgtccaagctggagtgcagtggtgcaatctcagctcactgcaacctccacctcccgggttcaagcaattctcctgcctctgcctcctgagtagttaggattacaggtgcccgccaccatgcctggctaatttttatgcttttagcagagatggggtttcgccatgttggccaggctgatcttgaactcctgacctcaagtgatctgcctacctcagccttccaaagtgctgggataacaggtggaaccaccctgctcggtccagtttgacgttagtggagggtaaagtgcaaatgcagaggacagaggaaaggcacaaaatgcagcaagaaatgaggctagaagtaggaatggctgtttcatggaggactttgaaagccttcctatggaaggtaatagggagccactgcagggctttaagcagatattttaaataaattatagaaatgcagtcttatcagtccacacattatattttattaaaacttaatctcattattactttgtagatagtaaatagaaattgcaagtctaatatttcccccctccctaatgaattgtcttgtgcaccctctcctctttggacaccacttctagagagaccgaaaaaaattttgttaatacataatgagcattccttccagctataagaactggaaggggaagaatatgccaaaagcacagacatcaatgatgaaatcatgtcaatctgcaacatatatagttacaaactgatttaatggtcactgttaggctgaactttcttgtgaatcactttataaaatagctctatatcttagaaaataatttgtaagaagcaggacccatttcgatagaaaaaatatttaaataataagttagtaccaggtgttaggtatatatatataatatagccagtttattcattagttcatcaaatatttattgcatggccattaggtacctggccatcttccaagcactaattatatttgcacatctcatcaccaagggtctttctttagatatgggagtgactaggcaatgaagaaatgaatttctaaattattttaagataatataatacatgaatagactggcacatctgcactttaaggtgagattactatttaattatcaattctatctcttcctagagctagatcatacattcttcaaaaaacaaacctgtattggtttgatcattaatataaacttagtagcacctagcagttactggcatgcagtaagcattcaatatccatttgttggcgaggtggagagaaaagggggaaagaaaagaatggagaaaaggaatcaaatggattttgaaattctgagaccaaagggaaagagccattttattgtcctcaaaacatagcttgattgtaactactatagtatttcttctgatttgaaaacccccatcaaaggcatacagtcctgcctgacatcctggatctccacttagaaacagaatgtaactcaggagtctgagacacaagataatcagttcttagaagtatatgcctcctcattcaaaagttcattaactttcaggttttaagataaaaagtatttttgttattataaaagtaatataagtactttaaagaaattttgcaaaatataggaaaacagaactgaaacattatcatatttccacctcctaaagataaccactgttaacattttacacgttaaatcagttccaaattttaaaatccctgtggtgcaactttctataatgctatgaggaacttatagacaactaaaatgaaccaaaaaaacacagtagagtaatgccatccatacttaatgagacaagattcagggccctgaaagagtttcaagattgagctatcatgaggttacgaggtccttaaggaaatataacgtattctagtcatcttttttatgccccagcaataggacccaggagtgagccttgcacatactattcactcagtaaatgttccttgaataaatacttagaaaaaaaatgggaatcagcattgttttcttttcgagactcttctttctatgatcgtgaacctgctcactccccagctcctcccgaatgaccccatcctttatcattccttgcgctgaacattagttccagcagtaataaagagcttgctgtagccccaaagtgttgttgttttaggcattcaaaactttaaccatatcatttgccaccttcatcactaagataagttctaattccttacaattcagctcagaagccatgtctcccctgacatttgtcacatatcttagtccattttcttttgctacaatatctgagactaggcaatttatggagaaaataaatgtatttctgctgggtgagagcatttgaaaatattttttaaaagttatttctgtaagaaataactaagttctgaaggctggaaggtctgagagcacggcactagcatttggtgaagaccttactgtgtcataacatgatgcatgatatcacatggtgatagggcaagagtgtgcatgtcagctcaggtctcccttcctcttctcataaagccactagtctcaccatgtgggcctcaccatgatgaccttatctaatcctattacctcccaaaggccccacttccaaataccatcaacatatacacatggggattaagtttccaacacatgaacttttcgtggacacattcaaaccactgtgtcacacattcccaggctgagctaagtgctatatttctgggttcctagagtacccgcaaatatctaacaatgcaattgccatattgcatggaaattagccacttacagttgtttactcacaggctaagatctttgaggcttatattatatcaactttattacataatatatatatataacaaaaataaagatagaaaaaaatatataattatgtgtgtatacacacacacacacacacacacacacacacatatatacgtgtaattttatagcaatagggtctcactatattgccaaggcaggtctccaactcctggcctcaagcaatcttcctgccttatcctcccaaaatgctgggattacaggtgtgtgctaccatgcccagcctgggcttctatatattcacaaatactgacatgggctcaataaatatttattgaataaatgagagaacaaaagaatgaatcatcttatttctttccttttttgttttagtttttatctctttaatttacttctgtttgttaggtcaagctgatcactcacagttttacttaccttaaaaaaaagtacaggccgggcacggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagtacaaaaacccctcttgcccatcaaacagaaatcagaaatttaaaatgttaaaaatggcaaaaactgttacctttactcatctagccaaaaagcaatcccttcctaatttattataattaattttcaataaacagcatcattaccaatttctctcaatggcctttgcaacagagtcaccttgtaatcattactctatcacaaccacatgtgttatttaagtatctattctttctccctgaaaagatataaaggaggtcctgccgactttctctattgatgtcatcaggtctgtctctttctatttctagagcctctgactttaatctcttccaatttagtttgacctagttgcatcaaagtaacaattcagtatagtcaaaattaagctgcatacaaggaattccaatttcctatgatatgggattcaaattaaatagaattacaatttttatcctggcttctaaggctaaaatcacacccatctctaccagaattctctaccatatttcctctatctaagaaaatgtatttccttgtgcttccagctatgtatttcccactgaagtcaagaaaatattcttgctgtataccacagtaaatttgcaaattccttcattggtgtttttgcacatgctttagatcttttctcattctctttgtgccctaatttgtctttcatacccctgcttatatctctcttcctttaagttttcttaactactttcaggtcatattaactgctctgttgctacacaatccaacatttggattttactgaaataacaatatccttatttgcatgtggcactgtaaatgttctaaaagatctttatgtatatacttttagatcactgacaacaggagtgttgttctcccctactgggcttaatctagcagcactttgacacaagatgatttcttaatagatgctgtggatttattgtcttacatctaagggtgttcaataaatggccgggcatagcggctcatgcctgtaatctcaacactttgggaggccgagacaggctgatcacctgaggtcaggagttcaagaccagcctggccaacaggataaaaccctgtctctactaaaaatacaaaagattagccaggcggggtggcacacacctgtagtcccagctactcagatggctgaggcaggagaatcactagagcccgggaggtggaggttgcagtgagccgagattgcaccgctgcactctacactgggcaacagagtgagactccatctaaaaaaaaaaaaaattaaaaataataaacaatgccctgaataaaattaaattgaattggctgctcatcttcaataaactacttataaataatagtaaaatacaggaaacagtacatttacattaaggttagtatttaaatcattaatacttcccataatcctatcaagtttctaatatttgcatagagctttatcatagcgttctaatgctacttctacttgtcacccccctacacctatacacacatacatacatgcactgttaaatgtccaagaaaaagtagtttgctttaggaagaaaacccaaagcaaactgaaaggtatactagtgaataccaaatttcacataagtcttattgcccatatttatttatgtattggtatgttgccactgtattataaaagctttatttatggcccccctatgtcaaaggatatataataccttagataatttctattatgaagcttgcaaaatgtatttacctggacaatttagcaagaagaaagaaaaaaagaaaatgcgatagtaaatgcttctgcctattctatattgtcactaagttaacaaaaaaaattatctttcttggaatgttatgtaaaaataaattttatgaagtgccattttgaattaaaactttgtatattatattcatttttacattatttacttaaaggaacaaacgaaaaattttaaacctgttaaaatagtgaatagataacacaaactaggataatattttaaacaataacttacaggatcagcaggtccacaaaattctcgaaatgtctttgtagcattattctgttgaatctccattgctacacaagggccagaatacatttctgtcaccatgtcctatgatatgtaatataaaagaatgaaaagaatttaacaatttttaactctccccttttaattgtttcactgttccactaatgtccttaaagtcatctgtgacttcttccccacttatatcccacatatcaagcagttcccaaattctgtccatttttccttgaagaatattttttagatatgctctctcttctccattcctatcacattttaatataatgctttatcatccgacactttcattatttggaatgatcttctagtatatcttccttgcaaaggccttcttgaatacaatgttgttgaattcacattactaaatatatatatataaatttcaaaggttttatcctaaaaaaccttttaaaaatcataatgcattctagcaacaagaaataataggaccagatttattctcccatattaaacatctagaaactagataaaatatacgaaacaatagttttcatacactgggtgatgggcagcacaggtctatgacccctgaaagtatggaaacagattaggtgagctgtagaattgctctgtcttactgtctagaggcagtttccagaccagtagaccaggtagaggaaacacaacagagcccaacgttctctgagttgaaaagacaaagattgcacttcggggaggccaatgtagccttattttcaggaaagaatactggagagatgaggggagtatgcagaaaataagctacaggatctgcagaggagttcccatgagtctttggctactaatctgtcacatgtgtacagcaaactacttgaggctggggaaagaattgccagaaagtagaccaaacaactcagagacagcacaaggctgagaagagtttatgtttctaccagccagagtgaaaggcctttttatatgatatatggagcatcaaggagagtcctcagaagggtactgcaccatagcagttggcctaaattagccctagattgtaagatgctctatacccatcctacaaagattaaaagcaagactcaaaagtttcaaattgattccaagtgatttaactaggtgccagaccaaaattgagcactctttacaaatctaccatgtaacaatgtaaattttacaatatacagtatccagtaaaaaaattaccaggcaggcaaatatgtaggaaaatactaaccattaccagaagaaaactcaataaatagacccagcaattaaataaatgacataaaaaggatatccaaacagctattataagctccacattctcaaattatacaaggaaatataaacttggtgaggagaaaataaaaaatatttaaaagatccaaatacaacgtctagagatataatctaagacatctaaatttaaaaatacactgaatggggtgaacaggatacgacactgcagaagagcaataaatttgaagacattcaatagaaactattcaaaaataagcatggagagaaagaaaaatgaagaagaagaaaaaagccctgctgtgcaaccatgtcaagctgtctattatatgtgtaattagaatctcagaagagaagaaaaggtgataaacataaatatattttttaaaataagtgctaaaaactttccaaatttgctgaaacccataaacctatagatccaacagaacccaaggataataaatgtaaagagaagtacattaggatgcaaaataataaaattagctaaaaacaaaaacaaaaagctttataagcagccagggtgttggggggggggcaggggaaagaacattatataacagtgggaaaaagataaggatgacaacaatgatgaccaaaaaatgtaaatctgtattctatacccaggtgggaaaatatttttcaaaaatgaagaaaaaaggaagacgttttaagacaaaaaagacctgatacaattcaccatcagaagcattatataataagaaatattaaaggaagttctttaggcagaaggaaaaaaatgccagacaaaaatataaatctatacaaagcaacagtaaacatgtcaagtataaacataaaatgcatttttattttttagttgctttatttttcttttttttcctttctgttgttttcttttctttttttttttttttttttttttttgagacagagttttgctctgttgcccagctggagcacagtggcacgatcttggctcactgcaacctcagcctccagggttcaagctattctcacgcctcagcctcctgagtagctgggactacaggcacccaccaccacatctagctaatttttgtattttcagttgctttcaaacataattgttcaaagaaatgcattgtattgttgggtttatagcatatatagatgtaaaatgtatgagaacaacagcacacagaataataggggaaaaatataagtatactgttttaagattcttagctctctatataaagctgtataatgaaaaacatgatccaagaaaaatgcctctcatagtgtctagaacactcaaaaataatttttttcaccctcttgaataggaaagaatactttaggcagaagtgaaaatggatataaagactttgaggcagaagtacagtagggatatatgaagatcagcttagaggctaggagctgagtgagactacgggaaagtagtaagagatgaggccagaccatgcagggtcatgtaaaccattttcatgactttgaggatttacgatacacaacatcaaagtaaaataatttattacagaatatatttgaatattgatccaaaagcagtcatctcagctaatacaaactacagaagctaaaagaggaggaaaaggacttcaaaatttatatggtactcataactctactcattagagttcctgagtgtatcccccaaagccattttgctatttcacaaaggtcatatgtaattgattttttatggataattatattgagtctgattttctgcctctgatattgaagtactgcctacacacaaatgtcaaagccaaattttcagaaggagcagaaggcatgaacaagttttccaaaaacagaagagtaaattttgtctgctcttctccctcccttccttgtttccttccttttcctctccctcctttttttcctttgtttctttctttcttctttttctctctccctccttccttttttctttctttgtctctctcactcattctctttcagtgttgattacagataccactgaaaatagacatacaaggctgtcaaaatgtataaaatggaaagaaaaaacatgttaaacaaagaacttcatcaaaagcataacatgttccttcaaaaattgactcagaatttttaagtcaccctagtttttaattaagtcacaaattttttaaacaaaaaaacaacctttctgtttcctttacagccttttgactgctgtccttaggtagctatgtgtaggatcatttgatttcatgtctatcttctccagagcataagctccataaatgcaggcagtatgttttttgttcatcactgattatttggcttatagcagatactcaatatatataataagtgtggatcatagtaacagcatgagataggaattatcacctttttatgactgtacatgttgaagcagaaaatacaggtgtaaataatcaacacggaatctactaccaaagaattatatcagactaaataataataaaaacaacaataatagcaggtaatatttactgagtacttttaatatgtgagacagttttacataatttatttcatttaattcccacaacaatctcataaggtaggtaatagcattattcccattttataaatgggttaatcaaggtttaaagaaggtaaataaattgtcgatggtcatataactagaagatttaagatctgaacctagcatctgactctacagagggggaagaaaaaagaagagaactgaatttaggaagctgcaggctggttgcaatgaattttgggagatatgaaaggtatacagtttgaagaatgtaatgtggaaataactgactggttaacatcaggttacctcaggttactttttgttgtatggatgaaagacagagaaaacttcattattataccaaacaaaattagcctgtttgggaaatttggctcgctctctcctgatttctcagaaggtcagataacaacctaggtcgttgacacagaactttagtatgaatgactctgtattgattttcagtctggccatttgggacctagtacaggagcttagtccaaaacactgcatcctatacttttcacttaacagtacaaatgttttacatttacttttatacttacatgatattcggtcactactcctttataaacttcatagaattcctcaacattaacccgatccatattgaactatattaaaaaataaaacaaaacaaaaccataaaccaaccaacaaaagggaaataaataagccacacttagcacttaacacttgtaatctcttctttactctaaaacataaactttacatagattactctttgaagaaaaagtgttattaaacatcaactcatcaagaataataatggataacagcatcactctaggttctatacgtgcatcatctcatttagccctcacaaccaccttactgcataggtagtattaatggctccaacttacagatgagactactaagactcagaggagtcatacaacttcctcaaactggcatcctatctcaagcagtctgaccccattgataatacttttacctactacactacacctctctctgaataaaacctcattcttgatacaaaagaagatttatatgcaatattaattatactattgatagattagtggcacaagaaagaaatattactaaagaaaagtagttcagacttttagaggaaacagaaaacaataccattttcctcccaagcattcggaaaaatccctagttagtctggtttgtgttaaagcatttatacaagtcatgtggacttcctgctactcttcaaaaagaactgtaaaagtgtgcttacaaagtaagtctagagggacttattcttatcaaggctgaatttaaatttagttaggaataaaatttcgttaaattctaaggttctcaaaaactaagaccttattttttttaaaaagtagcctcagaattcccagttttattttccctccattttgcttgtttattgttgccaggattgaagacccactgagaaatttctgccaatatggacaatcatttaagctaggaggatttatttttatgggcaacattactaccatagggaggaaattctgttggatttcagtgttttatccaacattcacatatgttttgctaaatgcaacaaaatactaatagaagatatcatttattaaatacttagaatttgagccagaaatgattattttatttaatctgctgagtaacccatttaggcagatactaatgctttcattgcctagatgagaaaactgagaataagaatgcttgacatttggccaaggccacatgcctagaaaacagctgacccaagattcagaaatagatctttctgactccacaagtccacgactgtgtttgctactacactaccatgccttacctataggctcaattaatcatttttaaaattatttttttcattagtacaaactatacccaatcaccaatcactatgctaaactgtagatctagaattaggtcagtgtttaaaactaacatttctatatttttttaaataggcttacatgtcatcctacaatcttgttaatatatcaccaagctaatacttttagaaagttttggctgacaattactttataattctaggtaagattcttcaaatatcagttttctcattagtctttaagttttgctcaatgactttgtaaactatttcccttttttttttttcttttttggcttattggcacaaaatagaactccagtttgtgtcctggtccttgattttgggtaatcttaagactttagaaagctgtttcttttcagaaaataaaatacaaataataccagtaagaaaattctcagcttcaaaatggctattttggtatttcactatcaaaaaagcacaaacttgctgggcttcaaacactgtaaaaaccaaattgtttatctgatttatataataatctgttgcccaatttctagtcaaatgtaccgatgagtacagcacaaaggtatgacctctaccaaagtgggtgttgtttctcactgaaaggtttcctaggagtgtatgaacaacgcaattttgaacaagcgtgggctctgaaggtgcagcggtacaagtgccaacagagttgctagaatacactaactccaaagacagtcttgagagaaagtccaaaaaccagcaaaaggcactggttagggaaaaaaaatctgaactgattctcttccttcattatttgtttagtgaagaatccagaagacagaaaactcatcacaatttctcactttgattctactttttgtttataagaacaaaatacagtttttggtccttatttattttgcaactaaagtttccagaattgtataaacttaccttataagcttaaattaggtgtatcattgaatattacttctctcagtaaaatattatatgggaaaaatcatttcaaaaaccattttttgactacaggaaggttactgagttcagtaagtatgtcttttatttttaatgtggttcatgagtacacagggaacattcaatgtaaagcattttataactatttttgaaaaaaatcctcacaaatattatggttcattgtaaactacctaccatctgcatagctgagatttcaaaacctgcatctcggatagccatcaggatctttcccaacagtcctgaaaatgaaggacaatgagtgaaaaaatacaaaattttaagacattttagtttcttagaaatgcaaattttttatagcaaagtactttttgtttatactctatatttaaaaaaacacatattttgcaagagaaactaaattaaatccctaatactgagcattaaatctaatcatttgatttcctttgtaagtgcttcaagaatatcaacaatggttctgaggtttatgcaaaaaacttttaagataatattttgcctttaaagcccctgaagtctaggtgatatagagaacataaaaatcaaacaattataaatggcattatttaatacaaagaaacgaaatgccaaagtaccagatacagaaggaattcaaacaagagttcaaagaaggagaaaaatcaaattgtaactgaagagataggaagaagcttcacggggaaatgaaaagcatgaatggtccttaaaggctgtggacagatgggcttatacagggataggagagaaggcacacatctgggaaagtatgagcatatttaaaagacagtaagaagacagaaaagaaaaacaaataaaaaaggaaaagagattgaattcaaatcgataaaggccttggataccaacatgaggaatatagtctttatcctacagatgagtggtttctatattggagtctatagtctctgggcaaatggggctgactttgagattccatttgtttcctataaaagtctaagtttctttttttcaagtcaactaaaactctgtctcttacacatacatgcacaaaggcacacacacacacacacacacacacacacacacacacaccatattctggatcatctggatcttaccgagtgaccctaaatcaccatgtactattagtgtctgaatgtgcattcgtatttactatcttaccatagccaagtagtgctattttaattgtagcaggctgaggggtgagaaaaagccagaggtggatctgtttctcaaatgatacatctgtaccaaatgaaggccaaatgatatcatagcatgctgtagaaacaaaggttctcagaagctcaaagacagaaaagtggtggattaactgagtcatcacagtagaacaggctcatgcctaactcagagtctgtactatattcacgttaagcttgtttttatggcaaataacatcttctgtcacattaatgctattatgttaaattctgttttatattttccttgctacgaatttgcaaattattttagccatgcacttgtatgtgcaaaagtttgtatttagttttatatttggacatatttaagttgtattactaaaaattaaaataatttatgtcaacactgagcgtccatgagaatagttttccttcaaaaagaaacactgccaaaagaaatgagaagtcaacaaaaatgttgagtgagaaaatacaaaactaaagtagtattttaggaaggtcactaatgcaatagtgatgagcaagctggtctgaagaaaagaataagtagtggaaagaatagcaaaagcttttgaaatcatttagaatgctgattggaaaaaaataggccatgatatatttaaatattttctctcttattttgagcttcaaagcgtggatggcagcagtagagaaaggaggtagtgaatataagatattttcacacaagaagcaatgggattaaactggatacagagtatgaagatgaaagaaggataaaagatgatttcaagattttgaatccaagtgaatggaagaatgacaatacttttaagaagaaaacaaataatgatgaaaccaaattaataaggggaaagacactgaattattttggacatagaaacccaaaacatactaaatagcatttatagagtaggaaactgatcagatcttgaggatgcagcatatccaatggctgaatgagtaaaataaactccctgcacaaaattagtgacatgggattgcataccaacagatagagttataaagacagaataagaggtacagagaggttagaactgaaatgatgccaagaggcatttggagacagtactttatataaagagctggagaagaatacatattcaaggcaaaaggaacattaagcaaaggtaaggagatgtaaaacaccatagttctggaataaaagtatcttcatcttactgaataatagagtggaaaggaaatgagacagaagagaagggagcagaggtggcagaagccatgatagaaggacttatggaccatatacagaggtttggattttatcctgtaggccagaagttctcaaacattttggtcacatagaccctttagctcttagatagtactgaagacctttatataggttatctctatcaatatttattataatataagttaaagtgtgcttattctcctttacttgacaagtggtagtttcttagcctttatataggttatctctatccatatttattatgagttaaaacaaaattttaaaatatttaaatataacaaaaatcctttaaatgttaacataaataacattttgtgaggaaaattataattttttaaaaatgtgatctaagccaaaaggtcaggaagagattatagtattttttttaattagtgagaagagagatattgttttacattttttaaaaatctctttaatgtctcatttaataaaaggcagctggactctcacatttacttcagctttcaatctgttgccatatgttgttttggttggagtatatttagttgaaaaatagtggaatattttaataatcttttacaataactgtgtatattttcctttacttgataagtggtagcttcttaaaagtttgttgcaatgtataatctaaaacctttatcaataaacttttttttaccctgttacattaaaatccactggtctatcttgtatgtacttcgaatgaaactatgatatgactcagacatgatttttaatatcacacattaatcatttggcaaataccagctcactgagttatgcagattttccaaatgctgattcatttcattatacgtcaaaaatcaattaaaaatttgttaatatcatcaccaatttcatcagaatagtctttctattctgttatacaatgtattgggaagttgtcaaactgaaagtggtgaatacagttttccaaggttctaagtttagttttcctttgtagtttatcttcacttggattttatctttggcaaaggctattgtcagttgttttctttgatatgataggcttacttaatttgaaagacaacgcctgccaaatacccaagtctgaataagcacaatttgtctgtcagtcattctttcaagtaaaaatggtattccataaaagaaaaagcatctaattgagctgacagtgcaaacaattgtgaataggattactcacaaatgcttttccttaaaaccattatatggagctttatgtgtacttcacattacttcacacagagtattaaaaagacctatatttgaggatcaaaaagtaataaaattatttttactgcatctaagatattcttaactaagtatggcttttttttccccctgcagatgcatgatggttaaaaatacagtaactactagcacagtttggtgccactgccttgattcgttctaaggcagtggcagttttgttcaccatcgcttttgcaccatcagtgcaaatgacaacacattaaaaaaggcaattaagtatgaaatcagctttggtcttgcagatccataaaagggtctcattaatgataataaaaaaatgattacatattaaccctaatctaaatatgaaatttaatctaatctaaatattaaacactatgcttcaatcaatatgaaaagaaatttataatctatatctattacaaattctaagaataaataggacaagttcacacgatatataggaagatgctcaccatagaattattagtaataaaaaaattttaagttctaaataataaaaaacaggaaaaagttagataaagaagaataagttcctacaactaactttttactcagactttaaaaatcacattttcaaatattatttaattgcatagaaaaaaattcaaagtacaatgttagtgcaattcaaaattgtatacataggataattcccaattcactttataaaactagtattatcctgatattgaaatcatatgaagacagtacaaaaaacgaaactacactccaatagcccttataaatataaatataaaaatactttttaaaaaattttaaaacaataatttatttacttaatatgagaaagggtcttactatgttgactagcctggtcttgaactcctaggctcaaacaatattcctgcctcaggctcctaaatatctgggattacaggcacataccactgtatctggctaaacataaaaattatttccaaatgttaaaattttagaaattttataatttccaataaattttaaattttataaatttagcaacatatacaaagaattatacaccatgaccaagagacgttaatttcagatatgcaagcctggtacattattcaaactatcaaccaatatattaacaggctaaggaagaaaaatcacatgaacacatcaatatatgttgatcacatatctatctatagatatatatctgcatatattgatacagaaaaaaacatttgaaaatatacagcactcataaatcaaaaaaactgtaagaaaaaaatagaaatagaaggcaacttccccatcttcataaacagcatctacagaaacctacaactaacataatagtgaaagactgaatgctttccatgcaagacagtaaacaaggcaagaatgtccattctcattgctctgattcaacatggtgctggaaaattcaagtcagtgcaaccagacaagaaaaggagataaaaagtatacagacaagaaaggcagaaatataactgtctctatttgtatatgacatgactgtctatatagaaaatcccaaatagcctaaaaaaaaatctagaactaattatttcagcaaggttgaaagatacaaggtaaacatactagatcagttgtatttctacacactggcaataaatacttgaacactgaaactaaaactataatagcatttataatcactcaaaaagaaaataaaattgggtgtgaatctaaccaaaaatgtatagaacttgtgtatgaaaactacaaaatgctggatgaaagagctaaataaatgaagagcatacagtgttcagggaatacttcacacaataaagatgtcaattctccctaaattgacaaataagtttaacaaaattgttatcaaaataccagcaagttttttttgtagcaatagataagattattctaaaattatatggtaagataaaggaactagaataactaaaacaatttcaaaaaagaaaaatgtgaggtaatcagtctactcaatttcatggttcattattaactgcaataaccgaaagatggtgtagtattgtcagtgatagagatcaatggaacagaacaaaaaaatcccaaaatagaaccacacaaatatgtccaactgattttttacaaaagtgcaaaagcaattcaaattagagagataacttttcaacaaactcagtaaagttaggaaataaagtctccaagaaaaaagagttacttcccagaaggaagtctacacaatgaaaggataacacaaatttggggaaacagctagttttttctcatctatacatggtgtaagctagtcacatattattacacataatcctcacaacgctgctatggactgaatatttgtgaccctctgaaattaagatcctaactcccaatgtgataaaggtagggcctttgtggggaagaggtgattagatagcaagaacaaagcccatgtgaatggcattagtgcccttataaaagaagctccagagagttctcttgcctctttcaccatgtaaaggcacagtgagaaggtgtcatctatgaagaaaaccatgggccctgacctgaaactgaacctgcaggacctgatcttggacttcccactatggagaactgtgggaaatacatgtttgttgtttaagacatccagtctatggtatttatattgtagcagctcaaatgaactaagataatgcctatgaggaaagtactagtataatcttcattttatagatgttgagtatctatattcaaggattaaacaatatgccttaataactagtaagtgatagaactgaatttcaaacccagttttgcttgccccagagcctaagattatattataataaaataaataatcaaaatatttagttggcatatgtatgtacctcaattaaataatttatgtatatgcaaaaatatacatatgtgtatatatgtgtatatacagctatgaaacatctgtttgatcttctgaatatatactataaaatctttaacagagatggttatagaatgtatatgtagtaaattctgaattgttcagaggatcatcacttaacttactgattattcagactttaagatttctttccttcttaccattctgattcttatcaatttggcagaaaaaggaggaaaaaaagatcactttattgtttattaatagttctagaaaactgcttaatagagagaacatcattaaaaattaagttgttggccaggtgcggtggctcacgcctgtaatcccagcactttgggaggccaaaggtgggaggatgatgagatcaggagatcgagaccatcctggctaacacggtgaaacctcatctctactaaacaaaatacaaaaaattagctgggcatggtggtgggtgccagtagtcccagctactcgggaggctgaggaaggaggatggcgtgaacctgggaggcggagctttcagtgagccgagattgcaccactgcactccagcctggaccacagactgagactccatctcaaaaaaaaaaaaaaaaaaaattaagttgttaaaaagtagatgcatagtattcttcaaaattctaacaaaattggttttcatagttaataatctaatagttttattttgccacatgtatctatatcaaaaatatttcttgtgaaaataacttattctgatgttaaggtctttcctggcatcaatattttcccttgatatcacaatatctaccacctgggtgcggtggctcatgcctgtaatcctagcactttgggaggacaaggtgggtggatcacttgaggtcctgagttcaagcccagcctggccaacatggagaaaccctatctctactaaaaatacaaaaattagccagacatagtgccacatgcctgtaatcccagctacctgggaggctgaggcacaagaatcgcttgaacccaggaggcagagcttacagtgagccaagattatgccactgtcctccagcctgggtgacagaacaagattctgtctcagaacaacaacaacaaaaataaaacaaataaacagaaaatcatagtatctatcatctataatatacctcacagcaatcttgcagccaatgagccccttacactgtagaaacacttgaaaaatatcgttaccatgaatgttaaacttactggatgtaacagcaagatacagatgacaacaaaaccctactcacgagcatgagagcccatgaaaaggacactttggtgagcaaaacaacttacaaaactgaaatttaaagaagcgaccaggctgttgtacaagataattcactatcacctgtatgctttgcttcacaatccatataataaacaggggtggtgggaaataaaacgaaacgatttttaaaaatgaaaaaatgtcaacaaggaaatcttgcagtttattttggaaagaaactgaaagaaaagttttaatcgtgatgtagccaagagtacacgaactaataaaactggtgcctaaaatagacatgtttaatattaataaccataaccaatttaaatcaaattggaaggatatgatttcctttaaaatttaaatctagtgaaataaaattcaaagccattttaactaaaaaatagacgtgtatctttaaaacatgattagtgtaaagacaaatcaaaaaactagagattatgagagtttaatgttcaatgctaacatataaaagaaatcacaagtgttactaaagtcaacagaaggaatttaatactaatcttggcaaacatgcataacaaataaccttaggcataaaaaccaggtggaaaagctttctgtctcctagagagcaatatgttactaggcaataccacttcactgataatcttcctgtaatttttaatggaagcactcagattggtttaagctacaaatgtctatggttttctgccttgcaataaggaaaaatattgtagaattatattaaatcaattgcagacaagagtctggattccagaccatcctgggcaacatggtaaaacttcatgtctacaaaaaatatgaaaaaaaaaattagccaggtatgatggtgtgtgcctgtagtcccagatactcaggaggctaaggtgggaggatcactagggctcaggaggccaaggttgcagtgagctgagatggcacaactgcaatccagcctgggtgacagagcgagaccgtgtctcaaaaaagtaaaaacaaatcaaaataaataagagtttggattccacagaattgttaaattgggaaccagtaaggcacttaggtcttaatggatctcaaattaatccatcaggtgatcataaaacccacattagtagaaagtagcttttaaaagacagatttaattcatccaatagatttctgatcctccactaacaccacatacccaaatctgaaattcacatttttccttaccaatttcctaacaagaacaagctgtacattccttacaaggtagtaaaaagagtaaccaatagaactttattttatttgtatttttttttagaggtggggccttgctatgttactcaagctggacttgaactcctgggcttaagtgattcaactacctcagcctcccaagcagctaggactacaggcatgtgccaccatgcccagctaattattaaaaattatttgtagagacagggtctcactgttgcccagactggtatcaaactcctggcctgaagtgatcttcccacctgagcctcccaaagtgctgggattacaggcataagccactgcatctggtccagtataacaacacctttgtagatatacctacaatatggtgactttgtgtactgaaattcatcaagatgcaattaagtgagtagaaaataataaaaacaggctccataccatcatagggacagcagagaagacctatgggaatgaagatttccaggaaagagtagtcaggggttcctcctcactgtgaagaaagacaggctcagcatgcaaaggaagctaagaacagctataccttggttgaaataagatcacagttttaaaacaaggacagtctaagaaaaacaaaataaagtacggtactgagtagataggctggaaactgaaaactgtgtaagattgggtaaataggtcatatgaagtctaaagtcaaagtcaggttaatacagaaaagttaaccacacaatcacaaagtaaaattaagtttctacagcacagggtactgccagctatggatagagtgagctgcttcctaatcttaagaggccagtctctatgtggttggagtaagcaaatgtcccattagaagccaaatccatgtttctaggagattttcatgaatgttattatgcaggggctattctcattatatgaaaatctcagtttttaaaatttttttatttcaatagtttttggggtacaagtggttttggtcacacggatgaattatatagtggtgaagtctgagattttagtgcacccatcatccaagtagtgtacattgtacccaataagtagttttttaatccctcacccccctcaaccctccctcttctgagtcgccaaagtccatcatagaattctgtatgcctttgcatacccgtatcttggttcccacttataagtgagaacatacggtttttggtttttccattcctgagtacttcacttagaataatggcttctagctccatccaagttactgcaaaacacattatttcattatttttatggctgagtagtattccatggtgtatatatatcacattttctttatccactcattcgttaatggacacttagattggttccatacgtttgcaactgtgaattgtgttgcaataaacatatgcgtgcaagtgtctttaatataatcacttattttcctttgggtagatactgagtagtgggattgctgaatcaaatgacagatctacttttagttctttaagaaatctccatattgttttttatacagtttgtactaatttacattcctaccagcagtgtataggtgttcccttttcaccacatctatgccaacatctattattttttgactttttaataatggctatttttgcaggagtaaggcagtatctcattgtatttttaatttgcatattcctgatgatcagtgatgtttagcatttttcatatgttctttaccattcttatatcctcttttgagaaatgtctattcatgttatttgcccacattttgatgggatttttttttcttgttgatgtacttgagttcattgtagattctagatattagtcctttgctagatgtatagtttgcagatattttctcccactctgtgggttgtctatttattctgatagttatttcttttaatgtactgaagtttcttttatttaattaggtcctatttatttatttttattttagttgcatttgcttttggggtcctactcacgaattatttgcctaagccaatgtccagaatagtttttcctaggttatcttctataatttttatagtttcatgtcttagatttacatctttgaaccatcttgagatgatttttgtataaggtaagggataagcatccagtttcattcttctacatgtggttatccagttttcccagcattatttattaaataaggtgtcctttcctcagcctgtgtttctctatgctttgttgaagatcagttggttgtaagtatttggctttatttctgggttctctattctgttccactgctctatgtgcctacttttataccagcactatttttgtaactacagccttgtggcaaacatctgataatgtgatgcctctacgtctgttttcttgtttgtttgtttttttgcataggattgctttggctattcaggttctttttctggtttcatatgaattttagaattgttttttctaattctgtgaaaaatgatgttggtattttgataggaattgcactgaatcagtggattgctttgggtagtatggtcattttcatgatattgattattccaatccatgagcatgggatgtgtttccatttgtttgtgtcatctatgatttctatcagcagtgttttgtagttctccttgtagagatcttttacctccttggttaaatatattcctaggtaatttatttttttccagctgttgtgaaaaggactgagttcttgatctgattctcagcatggtcattgttggtgtatagcactgctactgatttgtgtatattgattttgtgacctgagactacggaattcatttgtcaaatccaggagtcttttggaggagtatttagggttttctaggtatacagtcatattattcatgaacagcaatagcttgatgtcctctttttcaatttggatgccctttgtttcttatccttgcctgattgctctggttaggacttccagcactatgctgaatagaagtggtgaaagtggcatccttgtcttgttccagttctcaaggggaatactttcaacttttccccatttattatgatgttagctgtgggtctgtcatatatggctttcattagttttaggtaaagttccttttatatctgtttgttgagtttttttatacggggatgctggattttatgaaatgctttttctgcatctattcagatgatcatagagtttttctttttaattccttttatcagatgtatcccatttattgacttgcatattttaaaccatccctgcatccctggaatgaaacctacttggtcatggtgtattatctttttgatgtgctgcttgaattagctagtattttgttgaggatttttgcatctatgttcatcaggggtattggtctgtagttttctttttttcttatgtcttttcctggttgtggtatcagaatgatactggcttcatagaatgagttagggaggatccctctttcttaatcttttggaatagtttcagtaggattggtcccagttctctgaatgtctggtaggattcagttgtgaatccatgtggccccaagctatttttttttcttggcaattgttttgattagtgattcaatcgcactgcttgttcttggtctgttcggggtttctatttcttcctggcttaatctaggagtgtttatgtttcctggaatttatccatttcctctagattttttagtttgtgtgcatagaggtgttcacagtggtctcaaatgatcttttttatttctgtggggttggttgtaaagtctccagtttcatttctaattgaacttactttaacctctcctggttaatctagctaatggtctatcaactttgtttatctttttgaaaaaccaacttttagtgtcattgatctttggtatttttgttgttgttgttgctgctgtttcaaattcatttagatctgctctgatctttgttatttcttttcttctgctagctttgggtttagtttgttctttctctagctccttgaggtatgatgttaggttgtcaatttatcatctttcagattttttaatgtaggtatttagcactataaattttccttttagtactgcttttactatattccagagattttgataacttgtgtcaatattatcattcctttcaaagaatttttaaaattccatcttgatttcactgttaactcaaaaatcatccaggagcagattgtttaatttctatgtatttgtatagttttgagggttacttttggagttgatttgtagttttattccactgtggtctgagaagatacctgataacatttcgatttttaaaaatttatagagacttgttttgtggcctagcatatggtctattgtggagaatgttctgtgtgctgattaaaagaatgtacaatctgcagttattaggtagaatgttcggcaaatatttgtcaggtccatttgttctagagtgcactttaggtccattatttctttgttgactttctgtcttgatgatctgtctagtgttgtcggtggactgttgcagtctcatactattattatttcatgtctatctcatgtcttaggtctaatagtaattgttttatgaatctgggagctccagtgttaagtgtatataaatttaggaatataatatcttcttgttggattgatccttttatcatcatataatgaccttctttgtctttttttactgttgttgctttaaaatctgttttatctgatataagactacctactcctgctcacttttggtttccatttggagtggaatatctttttgcactcctataccctaagtttatatgaatctttatgtattaggtgagtctcttgaagacagtatatatttggtttgtgatttttaaaatccattctgccaatctgtatcatttaagtggagaatttaagcaatttatatccaatgttaatattgagatgtgaggtactgttccagttatcctgttacttgttacctagatactctggtttctttttttttttttctttttttttttattatactttaagttttagggtacatgtgcacattgtgcaggttagttacatatgtatacatgtgccatgctggtgcactgcacccactaactcatcatctagcattaggtatatctcccaatgctatccctcccccctccccccaccccacaacagtccccagagtgtgatattccccttcctgtgtccatgtgatctcattgttcaattcccacctatgagtgagaatatgcagtgtttggttttttgttcttgcaacagtttactgagaatgatgttttccagtttcatccatgtccctacaaaggacatgaactcatcattttttatggctgcatagtattccatggtgtatatgtgccacattttcttaatccagtctatcattgttggacatttgggttggttccaagtctttgctatggtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcccctccagcacctgttgtttcctgactttttaatgattgccattctaactggtgtgagatggtatctcattgtggttttgatttgcatttctctgatggccagtgatgatgagcattttttcatgtgttttttggcagcataaatgtctccttttgagaagtgtctgttcatgtccttcacccactttttgatggggttgtttgtttttttcttaaaaatttgtttgagttcattgtagattctggatattagccctttgtcagaagagtaggttgcgaaaattttctcccattttgtaggttgcctgttcactctgatggtagtttcttttgctgtgcagaagctctttagtttaattagatcccatttgtcgattttgtcttttgctgccattgtttttggtgttttagacatgaagtcgtcgcctatgcctatgtcctgaatggtaatccctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcttccagctttgttcttttggcttaggattgacttggcgatgcgggctcttttttggttccatatgaactttaaagtagatttttccaattctgtgaagaaaggcattggtagcttgatggggatggcattgattctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcgcctgcaaacagggacaatttgacttcctcttttcctaattgaataccctttatttccttctcctgcctaattgcccgggccagaatttcaaacactatgttgaataggagtggtgagagagggcatccctgtcttgtgccagttttcaaacggaatgcttctagtttttgcccattcagtatgatactggctgtgggtttgtcatagatagctcttattattttgaaatacgtcccatcaatacctaatttattgagagtttttagcataaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattccttttgccagtattttattgaggatttttgcatcaatgttcatcaacgatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattcttgccacaatttcagatcctgttattgttctattcagagattcaacttcttcctggtttagtcttgggagagtgtatgtgtcgaggaatttatccatttcttctcgattttctagtttatttgcgtagaggtgtttgtagtattctctgatggtagtttgtatttctgtgggattggtggtgatatcccctttatcagtttttattgcgtctattagattcttctctctttttttctttattagtcttgctagtggtctatcaattttgttgatcctttcaaaaaaccagctcctggattcattaattttttgaagggttttttgtatctctatttccttcagttctgctctgattttagttatttcttgccttctgctagcttttgaatgtgtttgctcttgcttttctagttcttttaattgtgatgttagggtgtcaattttggatctttcctgctttctcttgtggccatttagtgctataaatttccctctacacactgcttcgaatgtgtcccagagattctggtatgttgtgtctttgttctcgttggtttcaaagaacatctttatttctgccttcatttcgctatgtacccagtagtcattcaggagcaggttgttcagtttccatgtagttgagcggttttgagtgagattcttaatcctgagttctagtttgattgcactgtggtgtgagagatagtttgttataatttctgttcttttacatttgctgaggagagctttacttccaactatgcggtcaattttggaataggtgtggtgtggtgctgaaaaaaatgtatattctgttgatttggggtggagagttctgtagatgtctattaggtccgcttggtgcagagctaagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcaatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattgcagaatttagtccatttacatttaaagttaatattgttatgtgtgaatttgatcctgtcattatgatgttagctggttattttgctcgttagttgatgcagtttcttcctagtcttgatggtctttacattttggcatgattttgcagcggctggtaccggttgctcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatggtgaatattggcccccactctcttctggcttgtagggtttctgccgagagatccactgttagtctgatgggctttcctttgagggtaacccgacctttctctctggctgcccttaacatttttaccttcatttcaactttggtgaatctgaccattatgtgtcttggagttgctcttctcgaggagtatctttgtggcattctctgtatttcctgaatctgaatgttggcctgccttgctagattggggaagttctcctggataatatcctacagagtgttttccaacttggttccattctccccatcactttcaggtacaccaatcagacgtagatttggtcttttcacatagtcccatatttcttggaggctttactcatttctttgtattcttttttctctaaactttccttctcgcttcatttcattcatttcatcttccatcactgaaaccctttcttccagttgatcgcatcgactcctgaggcttctgcgttcttcacgtagttctcgagccttggttttcagctccatcagctcctttaagcacttctctgtattggttattctagttatacattcttctaaatctttttcaaagttttcaacttctttgcctttggtttgaatgccctccagtagctcagagtaatttgatcgtctgaagccttcttctctcagctcgtcaaagtcattctccatccagctttgttccgttgccggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgctcttgctggggggtgcctcccagttaggctgcttgggggtcaggggtcagggacccacttgaggaggcagtctgcccattctcagatctccagctgcatgctgggagaaccactgctctcttcaaagctgtcagacagcgacatttaagtctgcagaggttactgctgtctttttgtttgtctgtgccctgcccccagaggtggagcctacagaggcaggcaggcctccttgagctgtggtgggctccgcccaggtggagcttcctggctgctttgtttacctaatcaagcctgagcaatggcgggcgcccctcccccagcctcgctgccaccttgcagtttgatctcagactgctgtgctggcaatcggcgagactccgtgggcataggaccctccaagccaggtgcgggatataatctcgtggtgcgccattttttaagcctgtcagaaaagcgcagtatttggttgggagtgacccgattttccaggtgctgtccggcatccctttctttgactcagaaagggaactccctgaccccttgcgcttcccaagtgaggcaatgcctcgccctgcttcggcttgcgaacggtacgcgcacccactgacctgcgcccactgtctggcactccctagtgagatgaacccagtacctcagatgtaaatgcagaaatcacccgtcttctgcgtcgctcacgctgggagctgtagaccggagctgttcctattcggccatcttggctcctccccctctggtttctttattgttattgttttataggccccattagttttatgctttcaagaggttctattctggttcataattgcctttttcttttaaagtttaaaactccttttagcattttcaatagagctggtctagtagtaacaaattctctcagcatttgtttgtctgaaaatgactttaattctccttcatttacaaaacttagttttgttctggatacaaaattcttgactgacagttattctctttaagaaggctaaagataaaactccaatcccttctggcttaaaaggtttctgctgaggaaatctcttagtttttcaagcaaacacaatgaaagaagactgaaatgataattcaagaccatggatccattaactttaacatgaacaacacaaagtaaataaatgttgttccttacctataattagtttgagtgtttgtttctattttaaaaagacataggcctggcacagtggctcatacctataattccaacactttgaggggccaagtcaggaggactccttgagtccaggagtttgtggccagcctgggaaccatagtgagaccctgtctctacaaaaaataagaaattagctaggtgttgtggcacgtgtctgtagtgccagctgctctgcttgggaggctgaggtggaaggatcacttgactgcaggaggttgtggttgaggttccagtgagctatgatcaggtcactgcactcagcctggatgacagagtaagaccttgtctcaaaaaaaataaaataaaataaaataaaacatatatatatatatatatatatatatatatacacacacacacacacacatacacacacacatatatcttctcattctcaaagttagcctttgcacaacattttttttaataaacaggtacgttgatttttacttattctaactttccaaagtcacagttaaggaaattcacaaatttagacatcttattataagaacactgtttcttttgtttgttttaaatggctctgattccctcagcactggcaaggcttatattgccattcatagatagacttaaaaatagactaataccacaacacggatcacaaggtatataattcttgctccttttctgttgtaagcatatactatatacactgaatatgggcctccattttcttctgttattccccagcatggttctatagataggtacagctttgctatctggtgattctcaaagtgtggtccatgcaaaaatatctttagcatgacctgggaacttattacaaatgcagattcttgggctctaaaccagatattccaaatcagatactttggagtcagggcccaggaatctatatttaatccaagtgatcctgatgcacactaacgtttcagaaccattactgcgagtaaggtctctgagaacaacaaagcatcacaactactcctttggccatggaaaaggtgatatagctgaaaatttttatattttaaattgtaaaatattgaatacattttacattgtaaaatataaaatatacttttatggtaaaatatataacagatatgctcagattaaataattttaaagtgaacatctacagttatcatcacccacatcaaaagcccaccctcgaagccctctatatatgcctcccaatcatgaccctttcttctcttaggggagacacctacctgactttggaataaacttttctttatagtttaccacctacatatgaattcttgaaatatgtggttgatttttgcctatatttgaactttttgtgattagagtaatacagcatatatgcttcatgtctttcttattttgctcaagttcattactatgaaattcattcattttgttgtgtttccttctatttgaaagggaaggaagaaaatgcaacaatgtaaacagttagaatctctggatggtaggagtaagtgatttttaaaatagacatttgtctgtatttctaaatttttctactaagatgaattcctgagtaaaacttagcatttcccacctctgtatcaaataatttgaggtgcatgttttgaatcacattaacagattaaataaaaatctatgatgcaaagccaaaccttgtttcatttattaaactttcatttcatatatgaaacttcatattctgattcagcccaatacttaaataagatttggcttaaagattttctgacctcaaattcaggatattctgaagaataacttttaaaaacggagaagaaagtctgtggcacagacctgtaaccacaatttcaagagtcatttttaagcacactagagtcactttagttccttccaatctgcttaaattgaaatccttaatattatcctagaagactaccctccctttgataacaaggctgttcttcaataaccaccatgaaactgctctggtgaaataactgggatgagtaactcacttcctattttgcacacatagaagtcacagtacgtatgctaagtgttaaaagagacatagtagatgtaagttggtgataggttagaaaagaactaataactaaaataagttagaactttgaaccataggttttctagagtaagtaagatgtgtgaatatatagaaaagcaaagaagggtaccatttattaatccattcaaaaatcaattacactgaccatgtcccttcaatatttttcatgtcaactcctcccatgttttaacttattatttggaaacccaagcttttcatagacttttctgaaagatactaccttttctttagaaatcgtccctctttcttcctcctaagaatcaattataattatcttgccagaatgtcagcatttataatctgccatgtaacttgaatcattttttcaagtcttataaaatgagatcatgctactttgggttttcatgttttaaaacatatcttgataaagtaacatcatgtgttctgaatcctggatcacagattcataaagattagcccagctcttgggtagaagaaaaaaaaaaaagcctgaaaagcagaaccacagcatggtaggaggaaactcttgtcttccttttgtcattgtgcaattacgcagatgtttaatctgcagaggaaagggttaggaggatacatagaaaaccagtactagaggatcctccaaagcagaggagtgggcacattctatctttgctacaaactcttttttaagatatgttttcctcaggtctaaatcatgtgtagctatgctcagcattagttaccatgagttctaaaatggcatggtcctctaacagacaagtgaatgaaaaacaggcaagaggagtggcactgtcatcaaaattctgcataaagcttacattaatgttgttcttcctagaagtatctgtgcatacatagaacctactgggtcaacaaatgaatattccaaaggcatgtgtgtcaggttgcctcaataacatcattccctgaatcaccgtgactctgaatcttaaaatagaaaaaaaaaagtgaaaaacaggaattatctaaatttcttttataaatgtttactgaaacaaaacactgaaattaaatattattcaaaataaaaaactgaaaaggtataaagaaacttagataattaagcttataagtgatatttattgtttgtggtatttatagttctgaagttattaaagcttaaaactgtgctatgacttttgagaaaaccccatgttacatttttgccagtgctatttctttccatgaaactgggtttcattccaatctcactagagaaagatcaatctaagcactgtctagcaacagatcaagatttaccgttattttcattaaacaactgctataaagaagtaaacgtgcattagagaagctacttgtgtaaagcagagtgtcccaactactcacattttccattactccaaaaaattctcaccaacctaaaatccagcacagggatctgagttataagaacagctgaaaatcaaaaggtgactcttccctaaccatctccttggttgctattgacctgccatagtgaacaaactaggaatcttcaatcatgtatcaacttttataaggcttgactctgatgatggcagattactaaaggaaatgcaagatggtccctgcccagaatttctcataagtggctcttgtactgggtgtttatcaggaaaacccagggattcttttaaaaatgcatattcttgggctctactccagatatactgaaaaaagattctaaaattagggtccatgaataataattttaaacagtctccccaagtggttctgttgcacactaaagtttgagaagcactatctagcatcttagtgtcacaatactactggttcaggttctagtctcacgtcccaaccacatgaaggacttaagatgccttataccacttgaggtagaatgatacattggtggtccagtgaaccataattcctggtattcatgtgcttgtagagtctcctcctatactgactctggacctggccatgtgactttccttagctgtgatgcaaacagagacatgatgagcaatttccattgaggattatcttggaatgttactcttagaagccagaaaccatccggtaaagaagctcaggctatactactgaatgatgagaggccacatggaaagagtcttttgagaatgagattcagtcttgtacactccagctccagtacagctcccagatgaatgaagccacatgaataactcaagcaaggcatagcacagaagaatcatcaattgataacccacagaattgtgaaaaataatacatcatttttccctttttctttttagcctctatttcttaatgatgagataaatcattgtttttaagaaactaagtttttggatatctgggggcagggctaagatggtagactggaagtagttcatgtgtgccactcccagggggagaaaacaaaagtgctagtgaacacgggttctgcaggctgatcatctgagaaaccatgatgagatacatcaaggcagcaggggaacacagagaacaaagaggggcaaagctgggcaccagtctgtcggggctcagtgcagagccaggaaaacctcttcaacacgggaaagggtgagtgagtgacagcccccagggggactcacccttaccacatggacccatgcaagactgagaaggagagaatcaacctggcttccccacaattccccaacatacttctagattgaggcagtgagccactcagatgttttgcagaggcaactcccatgtccccccaggaagcacacagatagtagattagggcaacttggctaggatagggcttgtcactcaactgcagccccagtctgagggagccccttggaccagaataaccaacaaaagaaatgcagacacaaaggcagtaataactggggcctcctgcaagacccaggagcagactagaattgaagccagacaaccaaacccaccttataccacaatcaaacccccaagggcatcaaataaaaaaaaagcaaaacaatccatccagaagacatcaacttcaaaaactggaggaatatcagcccacacaaatgagaaagaaccagtacaagaactcttacaatggaaaaagctgaagtgccttctttcttccaaacaaccacactagttctccagttaagggttattaactgggttgagatggctgaaatgacagaaacagaattcagaatgtggataggaatgaagatcatcaagattcagaagaatgttgaaacccaatccaaggaagctaagaatcacaataaaacaatacaggagatgaaagtcaaaatagctcatatagaaaataatacaaccaatctgatagagctgaaaaacacactacaagaatttcataatgcaaccacaaatattaacagcagaatagaacaagtggagaaaagaatctcagagattgaagactggctttctgaaataatacagtcagacaggaagaaaacagaacaaaaaggaatgaataaaacctctgagaaatatggaattatgtaaaagaccaaatctatgactctctggcatacctgaaagaaatgggaagaaagaaaacaagttgaaaaacatatttcaggatatcatccatgagaatttcctcaacctagctagagagtccaacactcaaattcaggaaatgtggagaaccaccacaagatacttcaagatcacccccaagacacataatcatcaaattttccaagttcaaaatgaaagaaaaaatgttaaaagcagctagagagaaaggacaggtcacctaaaaagagaagcccatcagaataatagtgtacctatcagcagaaaccctacaagccagaagagactgagggcctatatgcaacattctttaagaaaaggaattccaaccaaaaatttcatatccagtcaaactaagcttcaaaagcaaaggaaaaataagatcctttcagacaagaaaatgctgagggaattcattaatgctagacctgccttataagagctcctgagagaagcactagatatggaaagggaagaccattaccagccactacaaaacacacttaagtacacagacaagtgatactatgaagcaaccacacaaagaagtctgcataattaccagctaagaacataatgacaggatcaaattcacacatatcaatactaaccttgaatataaatgggctaaatgccccaattaaaaggcacagagtagcaagttggataaagatgcaagatacatggtatgctgtcttcaggtaacccatctcacatgcaatggcacccacaggctcaaaacagaaatagagacaaatctaccaaacaaacggaaaacagaaaaaagcaggagttgcaagcctaatttcagaccaaacaatctttaagccaaatagatttttaaaagccagagaatgacattacataatggtaaagggtccaattcaacaattcttaaatcctaaaaatttaggattcaactatcctaaatctataggcacccaatacaggtgcacccagattcaaaaaacaagttcttagagacctatgaagagacttagattcatacacaataatagtgggagacatcaacaccctactgacagtaatagatcattgaggcagaaaattaatagtatcaggatctgaactaaactcttgaccaaatggatctaatagacatctacagaactcatcaccctaagaagacagaatatatattcttttcattatcacatgtattagtccgtactcatgctgctaataaagacatatctgagaccgggtaatttataaaggaaagaagtttaattgactcacagttcagcatggctagggaggcctcaggaaacttacaatcatggcagaaggggaagcaaacatgtccttcacatggcggcaacaaagagaagtgcagagtaaaagagggaaaagccccttataaaaccatcagatctcgtgagaactcactaattatcatgagaacagcagtgtgggggtaactgctaccaagattcaaatatctcctaccaggtccctcccatgacatgtcagaattataggaaccacaattcaagatgagatttggttggggacacgccaaaccatatcaccacatgatacatactctaaaatcaaccacggaatcagacataagacaaccctcagcaaactcaagaaaactgaaatcataaccaaccatactcttctgtgcaattaaaacagaaatcaaggccatgaaaattgctcaaagccatacaattgcatggaaattaaacaacctgctcctgaatgactcttaggtaaataatgaaattaaggcagaaatcaagaagttctttgaaatgaatgagaacaaagacacaacaaatcagtatttctgggacacagctaaggcagtgttaagagggaaattatagcactaaacacccacatcaaaaagttggaaagatctcaagttaacaatcaaacatcacaactagtagaacttgagaaccaagaacaaaccaaccccaaagctagcagaagacaagaaataaccaaaatcaagagctaaaatggaggagatagagacaaaaaatcatacaaaaggttaatgaatccaggagttgtttttttttttaaagtaagataaattgacagctagacaaataaagaaaaaagatacaaataaacacaatcagaaatgacaaaggagacattaccactgaccccacagaaatacaaagaaccatcagagactactatgaacaccgttatgcacataagctagaaaatctaaaataaatgagtaattcctggacatgtacatcctcccaacactgaaccaagaagaaattgaatcctcaagcagaccaatagtgacctctgaaactgaatcagtaaaagcctaccaatcaaacaaaaggcccaggaccagacggattcatagccatattctaccagatgtacaaagaagagctaggatcattcctacagaagctattccaaaaaattgaggaggagggaatcctcctcaactcattctatgaggccatcatcatcctgataccaaaatatgacagagacacaacaaaaaaagaaaacttcaggccaatgtccttgatgtacatctatataaaaattttcaacaaaatactcgcaagccaaatccagcagcacatcaaaaagtgaatccaccatgatcaagtaggctttatccttgggatacaaggttagttcaacatacacaaatcaataaatgtgactcatcacataaacagaactaaagacaggaaccacagatgcagaaaaagcctttgataaaattcagcatcccctcatgttaaaaaccctcaaataaactaggcattgaggaacatacttcaaaataataatagtcatcaatgacaaacccacagtcaacatcatgctgaatgagcaaaagctgaaagcattctccttgaaaaccaaaacaagacaaggatgccctctatcaccaaatctattgaacatagtattcgaagtcctggccagagcaatcaggcaagagaaagatataaaaggcatccaaatagagagaaaggaagtcaacctatccctgtttgaagatgacatgattctatatctaaaaaacctcattagtctctgcccaaaagcttcttgagatgacaagcaacttcagcgaagtttcaggatacaaaatcaatttataaaaatcagggccaggtgcagtggctcacacctgtaatcccaggactttgggaggccgagacaggtggatcacttgaggtcaggagttcgagaccagcctggccaacatagtgaaactctgtctctattaataatataaaaattagctgagcatggtggtgcgtgcctgtaatcccagctacttgggaggctgaggcacaagaatcgcttgaacctgggaggtggaggttgccgtgagccgagatcatgccactgcactccagcctgggtgacaaagtgaaactgtgtctcaaaaaacaaacgaacaaacaaaaacaatttataaaaatcagtagcattcttacacagcgcccaagctgagagccaaatcaggaatacaatcccatttacaattgccacaaaaagagtaaaatatctaggaatacagctaaccaaggaagttaaagatctctataatgaaaattacaaaacactgctcaaagaaatcagagataacacaaacaaatgtaagaacattccatgctcttagatgggaagaatcaatatcattaaaatggtcatactgcctaaagcaatttacagattcaatgctattcctttccatgtaccagtgacattcttcacaaactggaaaaaaactattttaatgttcatattgaaccaaaaaagagcctgaattgccaagggaaccctaagcaaaaagatcaaagctggaggaatcatattgtccaacttcacactgtagtacaaggctacagtaaccaaaaacaacatggtactggtataaaaacagacacacagaccaatggagcaggatagagagcccagatataaacccacacacctacaaccatctgatctttgacaaagctgacaaaaacaagcaatggggaaaggactccctattcaataaatgattctgggataacgggctagctatatacagaagactaaaactggaccccttccttacaccatatacaaaaatcaactcaagatggatgaaagacctaaatgtaaaacctaaaacctaaataaaacctaaaacctaaataaaaaccctaaaggataacctaggaaatatcattttgtacataggaactggcaaagatttcatgacaaaaatgccaaaagcaattgcaacaaaagcaaaaattgataaatcaaaaataagctaaagagcttttgcatagcaaaagaaactatgaacagagtaaacagacaacctacagaatgagagaaaatatttgctaactatacgtctgacagaggtctaacatccagaatctatgaggaacttaaacaaatttacaggaaaaaaataaaaacaaccccataacacagtgggtgaaggacatgaacagacaattttcaaaagaagacacacatgcagccaacaaccatgaaaaaaagctcaatatcactgatcattagagaaatgcaaatcaaaaccacagtgagataccatctcacaccagtcagaatggctattactaaaaagtcaaaaaataacagatgctggttaggtggtggagaaaaaggaacacttatatacctgttgggggaagtgtaaattagttcagctattgtggaagacagtgtggcgattcctcaaaggcctaaagccataaataccatttgacacagcaatcccattactgggtacatacccagaggaatataaatcattctaccataaacacgcatgcaaatgttcactgaagcactattcacaatagtaaagacataaaagtaacctaaatgcccatcactggtagactggataaagaaaacatggtacatatacaccatggaatactctgcagccattaacaaaaaaaatgagatcatgtcctttataggaacacgaatggaactggaggccattatccttagcaaactaatgaaggaacagaaaaccaaataccacatgttctcacttacaagtggaagctaaataatgaaaagacatggacagaagttgaaaaacagacactggagccttcttaagggtggaggattggagaagggataggtttggaagaaaaaaaatacctacagagtactgtgcttggtaatggggtgacgaaataatctgttaactaaaccccgagtcaagagtttgcctacataacaaaactgcacatgtacccctgaacctaaaatagaagttaaaatatttttaagagttaaattaaatttaaaaaatattttaggatagtttgttatacagcaataatatctaaatttcactatttgtaaatgatttttcttaagcttaatacatacttacctcttcagggccattaaatgcaatccttcctcaaaattaggattcttttgtagggactaacagaactcttgagattccttctaaatcaataaatcaccagttttatttaaagtccctaaaacttacagatccttaggatattttcactgtctataattttatgtttcaaaaatgtatgctaagctctgtgcattcaaagtcagggtcctaacatgtagttcagtgtacttggtgcaattgataaaattccatccaactgtttactttttcagatagaacagaacacattcacaaaactccaaaatggtgacattctaagcaaaactgggaccacttctggaatttttgttaaaactgagttaaatatacgatgtttagctctctttataccaaaaaatgtcatgcctctttcacagtatcctagtggatgaactgcatgaaggaaatcaaatatgaaaaagctgagcacttaactgattcaatcggcccaaatttaggaggttgcatgcatctaccagggctcttggcttacacagcaccaaagctaccattacagtggatagtaaaactctgaaagaggctctgagtaagaataacccaatttctaaaagtgaggacatgataaataagacctagcgcctaccagtctcattttaattcttataccagagccaattctgatgctaaatttacaaattggtcaatattctaataaataatttgcttcctagtaaattaaatgcagacaaccacaaaatatctaaactttctttgaaacattctccatgaaaatagaattattttttacaaccaaaacacaacatcaaggtatagaatacaatttccaatttatttatttttctctatctctctctctttttaatatagacagggtcttgctatgccggcctggctgatttcaaacccctggcctcaagcaatcctcctacctcggcctcctagagtactgggattactggcatgagccaccatgcctggccaaaattttcctttataagaattttctacacagtttcacagaataatagaataactgggtttaaatgctcagataaaactttaaaacaatcttaactcattttactgatgaaactaaacttcaaaaaggactgttataaacaatgcagtaaaattgtttaatgcataaatctgttataaggaaaatttctaacaaaatttcagggttctactactcaataaaaagactaaattgtttctccattacaagtataaaagccactctcccagatttggctacctcctcttgcccagtgtcaaccataataggcaatcaaaaaatagctactgaatcaaccagatgtaagcaataaacctacttcatgcacttaaatcagacctaggctttaactggggaaaaaaattaaagcactttattcctttaacaatgactacatttttctccctgtagatgatgaatgtaaatgttggatttttgttagcattataaaactattactttgttacaagacagtcattcaactttgcttaaaaattaaaagataatgatattagtggcagcagcagtagtagtagtaatagagtagtaatcataatactaacaatgtgtaacacttatacagcactaaactacgtgctgggaactgtctagagcaccttccatacactaatgcacttaatccttagttaccccatgaaaaatgtatagaattattctcattttagaaataaggaaacaaggtagaaagagatgaagtaattaatccaatatcccatagctagtaagtggcagagccagaattcaaacctaaacagcctgatttcagagtaaaagtaatttattttatggatggaattaataactataacctataaacaatactgagaacataataaacacattgcataatttttaaagtaaaaagaacacaagaacattcaccttgtttttctttccttttaaaacctgagtcctaaaatgacaatatattttaatctgcatatctaaaaagaccacagatgcctcaaatataccttatttttcccacaatttatctcacagaccaagaactctttatgttctagctctcttagaaatgagaagtgaaaccactgcatccacatagattaactataggtctatgaactaaggccgcctacatacacatgactactacttgtgccaagaagtttcttgcccagaaagataaggcagtaaatcagtaaataacttcactgttggcttcaggaacttcccaaaaatccatttaccccaacaatagagtactcaaacagtcccctttcacagtactccctctactgctcaaacaactcatttatcaaacaactgtgtatttacaagacttggttaagatccttagcctgctgttgctacaaaccttcaaccattattatatcatgaacgctgtcgtctcaatcagacgactgcattgaaagctcttaaacatctcaaggttttgcaatatctacccctgaactctcccttgcagagtctactaaggctctatcaaggttgtgcttgccctttattgtattaaggaataaacttagctttgcttcatcaacaggatattctggcctttttttgggaagtcagcagtcaacagaagggataatcctattccatttcagctgctctcttatcagcaactccttttttaaaataaaaatctttaaaaataaaaataaaaatctttcatgcctatactatattacaggtaatattaaatatattaataccaggagatgggattattatagaaacagataaacataaaccagcaaatgaaagggggccatgtgaacctaataataaattcaatatgagacttcaaactatatttcattaaaatggcagtttaatctgaactgggttaattacatacttcaaaatggtcttaaattattccaaaaatacaggtttagaaataaaaggaaaaaaaagccttgggttgccaaagtttattctgccatctgagtagatttttacaaaaatttctttgccttaattaagttatatgacctaatgttatatatcaaatataaatatataaaatataatctataaatagctctaaaaaccattaaatcctgtataaacagaaaaataatatattaaaattattaatagttattttgatatcaactttcacttacatacagtattttttggttttagttacatgtgcaatttttattcttcaacttttattttaacttctgggacacatgtgcatgatgtgcaagtttgttacataggtaaatgtgtgctatggtggtttgctgcacatatcaactcattatctaggtattaaccccagcatccattagctattctttctgatgctctccctccccccgccccccatgacaggccgcagcgtgtgttgttccctgaccatgtgtccatgtattcctattgttcagctgccactggtaagtgaaaacatgcagtgtttggttttctgttcctgagtcagtttgctgaggataatggcttccagctccatccatgtctctgcaaaggatatgatcttgttcctttttatggctacatagtattctatcatgtatatgtaccacattttctatatccagtctatcattgatgggcatttgggttgattccatgtctttgctattgtgaaccgtgctgcaatgaacatacacgtgcatgtatttttataatagaacgatttacattcctttgggtatatacccagtaatggcattgctgggtcaaatggtatttctgcctctagatctttgaggaatcaccacactgtcatacacaatgaaggaactaattttactctcccagtaacagtgtaaaagtgttcctttttctccacagcctcaccagcaacggctgtttcttgacttttcaatgatcaccattcgaactggcgtgagatggtatctcattgtggttttgacttgcatttctttaatgatcagtgatgttgagctttttttaaaattattatactttaagttctaagttacatgtgcagaatgtgcagttttgttacataggtatacacgtgccctgctggttagctgcacccatcaacctatcacatataattaggtatttctcctaatgtcatccctcccctagcctcccaccccctgacaggccccagtgtgtgatgttcccctccctgtgtccatgtgttttcattgttcaactcagacttatgagtgagaacatgcagtgtttagttttctgatcttgtgatagtttgctgagaatgacagtttccagcttcatccatgtccaatcaaaggaaatgaagtcatcactttttaaggctgcatagtattccatggcgtatatgcaccacactttcttttctatttttttcttaatttttttttattattatactttaagttttagggtacatgcgcacaatgtgcaggttagttacatatgtatacatgtgccatgctggtgtgctgcacccattgactcgtcatttagcattaggtatatctcctaatgctatccctccccactccccctaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttaggtatatattataccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtatcctgactttttaatgattgccattctaactggtgtgagatggtatgtcattgtggttttgatttgcatttctctgatggccagtgatgatgagcattttttcatgtgtcttttggctgcataaatgtcttcttttgagaagtgtctgttcatattctttgtccactttttgatggggttgtttgtttttttcttgtaaatttgtttgagttcattgtagattctggatattagccctttgtcagaagagtaggttgcgaaaattttctcccattttgtaggttgcctgttcactctgatggtagtttcttttgctgtgcagaagctctttagtttaattagatcccatctgtcaattttggcttttgttgccattgcttttggtgttttagacatgaagtcgtcgcctatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccacttattaaatagggaatccttttcccattgcttgtttttctcaggtttgtcaaagatcagatagttgtagatatgtggcattatttctgagggctctgttgtgttccattcatctatctctctgttttggtaccagtaccatgctgttttggttactgtagccttgtagtatagtttgaagtcaggtagcgtgatgcctccagctttgttcttttggcttaggattgagttggcgatgtgggctcttttttggttccatatgaaatttaaagtagttttttccaattctgtgaagaaaggcattggtagcttgatggggatggcattgaatctataaattaccttaggcagtatggccattttcacgatattgattcttcccacccatgagcatggaatgttcttccacttgtttgtatcctcttttatttcactgagcaatggtttgtagttctccttgaagaggtccttcacgtcccttataagtcggattcctacgtattttattctctttgaagcaattgtgaatgggagctcactcatgatttggctctctgtttgtctgttattggtgtataagaacacggtgaaaccccgtctctactaaaaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagaatgcttgtgatttttgtacattgattttgtatcctgagactttgctgaagttgcttatcagcttaaggagattttgggctgagataatggggatttctagatatacaatcatgtcacctgcaaacaggtacaatttgacttcctctttccctaattgaataccctttatttccttctcctgcctaattgccctggccagaacttccaacactatgttgaataggagtggtgagagagggcatccctgtcctgtgccagttttcaaatggaatgcttccagtttttgcccattcagtgtgatactggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccggccttgcatcccagggatgaagcccacttgatcatggtggataagctttttgatgtgcttgctggattcagtttgccagtattttattgaggatttttgcatcaatgttcatcaaggatattggtctaaaattctcttttttggttgtgtctctgcccgactttggtatcaggatgatgctggcctcataaaatgagttagggaggattccctctttttttattcagtggaatagtttcagaaggaatggtaccagttcctccttgtacctctggtacaattcggctgtgaatccatctggtcctggactctttttggttggtaagctattgattattgctacaatttctgagcctgttattggtgtattcagagattcgacttcttcctcgtttagtcttgggagagtgtatgtgtcgaggaatttatccatttcttctcgattttctagtttatttgcgtagaggtgtttgtagtattctctgatggtagtttgtatttctgtgggatcggtggtgatatcccctttatcagtttttattgcgtctattagattcttctctctttttttctttattagtcttgctagcggtctatcaattttgctgatcctttcaaaaaaccagctcctggattcgttgattttttgaagggttttttggtctctatttccttcagttctgctctgatcttagttatttcttgccttctgctagcttttgaatgttgtttgctcttgcttttctagttcttttaattgtgatgttagggtgtcaattttggatctttcctgctttctcttgtggccatttagtgctataaatttccctctacacactgctttgaatgtgtcccagagattctggtatgttgtctctttgttctcgttggtttcaaagaacatctttatttctgccttcatttcgttatgtacccagtagtcattcaggagcagactgttcagtttccatgtagttgagtggttttgagtgagtttcttaatcctgagttctagtttgattgcactgtggtctgagagacagtttgttataatttctgttcttttacacttgctgaggagagctttacttccaactatgtggtcaattttggaataggtgtggggtggtgctgaaaatatgtatattctgttgatttggggtggagagttctgtagatgtctattaggtccgcttggtgcagagctaagttcaattcctgggtatgcttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcaatatatttaggatagttagctcttcttgttgaattgatccctttaccaatatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatatgtgaatttgatcctgtcattatgatgttagctggttattttgctcgttagttgatgcagtttcttcctagtcttgatggtctttacattttggcatgattttgcagcggctggtaccagttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatggtgaatattggcccccactctcttctgacttgtagagtttctgccgagagatccgctgttagtctgatgggcttccctttgtgggtaacccgacctttctctctggctgcccttaacattttttccttcatttcaactttggtgaatctgacaattatatgtcttggagttgctcttctcgaggagtatctttgtggcattctctgtatttcctgaatctgaatgttggcctgccttgctcgtttggggaagttctcctggataatatcctgcagagtgttttccaacttggttccattctccccgtcactttcaggtacaccaatcagacatagatttggtcttttcacatagtcccatatttcttggaggctttgtttgtttctttttattcttttctctctaaacttcccttctcacttcatttcattcatttcatcttccatcactgaaaccctttcttccagttgatcgcatcgactcctgaggcttctgcattcttcacgtagttctcgagctttggctttcagctccatcagctcctttaagcacttctctgtattggttattctagttatacattcgtcgaaatttttttcaaagttttcaccttctttgcctttgatttgaatttcctcctatagcttgcagtagtttgatcatgtgaagccttctctcaactcgtcaaagtcattctccatccagctttgttccattgctggtgaggaactgcgttcctttggaggaggagaggcactctgctttttagagtttccagtttttctgctgtgttttttccccatctttgtggttttatctacttttgatctttgatgatggtgatgtacagatgggtttttggtgtggatgttctttctgtttgttagttttccttctaacagacaggaccctccgctgcaggtctgttggagtttgctagaggtccactccagaccctgtttgcctgggtatcagcagcggtgtctgcagaacagtggattttcatgaactgtgaatgctgctgactgattgttcctcttgaagttttgtctcagaggagtacctggccgtgtgaggtgtcagtctgcccctcctgtgggggtgcctcccagttaggctgcttgggggtcaggggtcagggacccacttgaggaggcagtctgcccgttctcagatctccccctgggtgctgggagaaccactgctctcttcaaagctgtcagacagggacatttaagtctgcagaggttaccgctgtctttttgtttgtctgtgctctgcccccagaggtggagcctacagaggcaggcaggcctccttgagctgtggtgggctccacccagttcgagcttccaggctgctttgtttacctaagcaagcctgggcaatggcaggatcccctcccccagccttgctgccaacttgcagtttgatctcacactgctgtgctagcaatcaacgagactctgtgggcataggaccctccaagccaggtgcgggatatgaccttctggtgcgccatttcctaagccatcagaaaagcacagtatttgggtgggagtgacccgattttccaggtgccgtctgtcacccctttccttgaccaggaaagggaactccctgaccccttgcacttcccgagtgaggcaatgcctcgccctgcttcggctcgcgcatgatgcgctgcacccactgtcctgcgcccactgtctggcactccctagtgagatgaacccggtacctcagatggaaatgcagaaatcacccatcttctgtgtcactcacactgggagctgtagactggagctgttcctattcggccatcttggctcctccccacattttcttaattcgtctatcattgatgggcatttggcttggttccaagtctgtgctattgtgaatagtgctgcgttaacatacatgtgaatctgtctttacagcagaatgatttataaccctttgggtatatgcctagtaatgggattgctgggccaaatggtatttccaattctagatccttgaggaatcaccacactgttttccacaatggttgaactaatttatactcccaccaacagtgtaaaagcgttcccatttttccacaacctctccagcatctgtcatgtcctgactttttaataatcaccaatctaactggtgtaagatggtatctcattgtaattttgatttgcatttctctaatgaccagggatgaggagcattttttcatatgtctgttggctgcacttcttttgagaagtgtctgttcatatcctttgcccattttttgatggggttgtttgtttttttcttgtaagtttgtttacattctttgtagattctagatattagccctttgtcagatggatagattgcaaaaattttctcctattctgtaggttgcctgttcactctgatgatagtttcttttgctgtgcagaaactctttagtttaattagatcccatatgtcaattatggcttttgttgccattgcttttggtgttttagacataaagtctttgcccattcctatgtcctgaatggtattgccaaggatttcttctaagatttttatggtcctaggtcttattaaagtctttgatccatcttgagttgatttttgtaaaaggtgtaaggaaggggtccagtttcagttttctgcatatggctagccagttttcccaacactatttattaaatagggaatcttttccccattgcttgtgtgtgtcaggtttgtcaaagatcagatggttgtagctgtgtggtgttatttctgaggcctacattctgttccttttgtctacatatctgttttggtataagtaccatgctgttttggttactgtagccttgtagtatagttagaagtcaggtagcataatgcctccagctttgttcttcatgcccaagattgtcttggctacgcaggctcttttttggttccatatgaagtttaaagtagtttttttccaattctgtgaagaaagtcaatggtagcttgatggggatagcattgaatctataaattactttcagcaatatggccattttcgtgatactgattcttcctatccatgagcatggaatgttttcccatttgtttgtgtcctctcttatttccttgagcagtggtttatagttctccctgaagaggtccttcatatcccttgtaagttgtattcctaggtattttattctcttagtagcaactgtgaatgggagttgatgcacaatttggctctctgtccattattggtgtgtaagaatgcttgtaatttttgcatactgattttgtatcctgagactttgctgaagttgcttatcagcataaggaggttttgggctaagacaatggggttttctaaatatacaataatgtcatctgtaaacagagacaatttgacttcttctcttcctatctgaataccctttattgctttctcttgccttattgccctggccagaacatccaatactatgttgaacaggagtggtgagagagggcatccttgtcttgtgccggttttcaaagggaatgcttcaagcttttgcccattcagtatgatattggctgtgggtttgtcataaatcgctcttattattttgagatatgttccatcaatacctagtttattgagagtttttagcatgaaggggtgctgaattttattgaaggccttttctgcatctattgaggtatgtgttttttgtcattggttttgtttatgtgatgaattacgtttatcgatttgtgtatgttgaaccagccttgcattccagcaatgaagccacttgattgtgatggataagctttttgatgtgctgctggattcggtttgccagtattttattgtggattttctcatagatgttcatcagggatattggcctgaaattttctttttttgttgtgtctcttccaggttttggtatcaggatgatgctggcctcattttatgagttaggaaggattccctctttttctattgtttggaacagtttcagaaggaatggtaccagctcctctttgtacctctggtagaatttggctgtgaatctgtctggtcctggactttttttggttggtaagctattaattattgcctcaatttcagaacctgttattggtctgttcaggggttctacttcttcctggcttagacttgggaggatgtatgtgtccaggaatttatccatttcttctagattttctagtttatttgcgtagaggtgtttaaaatattctctgacggtagtttgtgtttctacaggatcagtggtgatatcctctatatcattttttattgaatctatttgattcttctctcttttcttctttattagtctggctagcagtctatctattttgatgattttttcaaaaaaccagttcacggattcattgattttttgaagggttttttgtgtctctatctccttcagttctgctctgatgttagttatttcatgtcttctgctagcttttgaatttgtttgctgttgcttctctagttctttcaattttgatgttagggtatcaattttagatctttcctgctttctcttgtgggcatttagagctataattttccatctaaagactactttaaatgtgtccctgagattctggtatgatgtatcttcgttctcattggtttcaaagaacatctttatttctgcctttattttgttatttatccagtagtcattcaggagcaggttgttcagtttccatgtattttgtgcagttttgagtgagtttattaatcctgagttctaatttgattgcactgtggtctgagagactgttataatttccattcttttgcacttggtcaggagtgttttacttccaattatgtggtcaattttagaataagtgtgatgaggtgctgagaagaatgtatattctgttgatttgaggtggagagttctgtggaggtctattaggtctgcttggtttagagctgagttcaagtcctgaatatccttgttatttttctatctcgttgatctgtctaatattgacactggggtgttaaattctcccacttttattgtgtgggagtctaagtcactttgtaggcctctaagcatgtactttatgaatctgggtgcgcttgtattgggtgcatacatatttaggatagtcagtacttcttgtgcattgttccctttaccattaatgtaatgcccttctttgtctctttttatctttgttggtttaaagtctgttttatcagagattcggattacaactcctgctttttttgctttccatttgcttggtaaatattcctccatccctttactttgagcctatatgtgtctttgcaagtgagatgggtctcctgaatacagcacactgatgggtcttgactctttacccaatttgccagtctatgtcttttaactggggcatttagcttgtttacatttaaggttaatactgttagttgtgaatttgatcctgtcattatgatgttagctggttgttttgcccattagttaatgcagtttcttcatagtgtcgatgttctttacaatttggtatgtttttgcagtggctggtactggttgttccttttcatatttagtgcttctttcaagagctctcgtaaggcaggtctggtggtgacaaattccctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgcaaagatatctgctgttagtctgaatgggcttctctttgtgggtaacccaacctttctctctggctgcccttaacatttttttgttcatttcaaccttggtgaatctaatgattatgtgtcttggggttgctcttctcgaggagcatctttgtggtgttctctgtatttcctgaatttgaatgttggtctgttttgctagtttggggaagttctcctggataatatcctgaagagtgttttccgacttggtcccattctccccgtcactttcaggtacaccaatcaaacgcagatttgtcttttcacataatcccatatttcttggaggctttgttcatttctttttattcttttttctctaatctggtcttctctttttatttcattaagttgatcttcagtcactgacatcctttcttctacttgattgatttgactattgatagttgtgtattcttcacaaagttcttgtgctatgcttttcagctccatcaggtcattcatgttcttctctgcattggttattctagttagcaatttgacttcagctttttttcatgtgtttgttgggtgcatgaatgtcttcttttgagaagggtctgtccatgtcctttgaccactttttaatgaggttgttttttcttgtaaatttaagtcccttgtagattccagatattaaacctttgtgaaatggatagattgcaaaaattttctctcattctgtaggttgtctgttcactctgatgatagttcattttgctgtacagaagctctttagtttaattagatccaatctggcaatttttgtttttgttgtaattgcttttcacattttgttcacaaaattgttgcccatgcctatgtcctgaatgctattgactagattttctactagggtttttatagttttgggttttacatttaagtctttaattcatcttaagttaatttttgtatacggtataaggaaggggtcccgtgtcaattttctccatgtggctatcagttctcccagctatatgtgcaattattaaggtatacaactagtatttattctagtaccactttattttatttcactctccttgcaacatatttttccttgaaaaggattagatcaggtaaattgaataaaacattttagggtgtcaaggataagctttttaaaaagttgatgcctataaacaagaactttttcaaaatgtgagtgtactatgtgtgtttatgtatatatgtatatgtacacaaatatacacgggtgtatgtatgtgcatgtgtgtgtgtacaggttgaatattccttacagaaatgcttgtgacaagcagtgttttggatttcaattttttttttgattttgaaatatctgtagatacgtatttgtggagcatacccaattcaaaaatccaataaacataaaccagtggttgaaaatgctacaacgaccatttcctttgagcttcatgtctgtgctcaaaaagttttggagtttggagtaatttgggtttcagatttttggattagggataccacacctgtgtagacactcacatacacatacacaatctctccagctaagaaaaatgagtgaaacataaaatcccaggtttttttccataaattttcaacaccagccatttcaaatattactatcacttcctatggaattgttactaatcatgtgccatgtgacttttttgtggctattgctattagggcaatagagtatagagggaacagaatggagattaaaaacaaacaaacaaacaaacagggtttgcatcctcaatttccattccaaattaggagaaacaacttaatctcatggaaccttagcttgcctatctggaaaagagcaacaaatttacctacttgacatacttgctgtgaagattaaaaataatgtataaggaaccagtctgccacctggcacataatggtatattctccataagtgtttgttatccatgctgcatgttagttacttataatcatggtcctaaggatttacaatatactaaaatacttcctaaaaaattaaagaagtattaattatgcagcaagatctttaaggctcatatccttccaacaagtaattctatttctaggaaactagccagaggaaaagattagagatatcatcaaatatttacgtataaagatattcttcaaagttttaattttaatatcaaaacactgaaaacaacctaagtatccaaataccatactacatctatacaattgctgttaaatattaaagaatctattaaaatattaatgaggacttaacagcagccagaaatgctcacaaaaattatatttaaacaacagcctatagacctacatctcaaccattacattcatgtgtagcagtgtacacacatgcacatacaaatgcagaaaaaaatgatttggaggaaatgcatcaaaacattaacaatgactatcttcaggtgatgggaattcagtatttttttacttcatttttaatggttttttatttccaattttctactatatacatggattacttggatacttaggagacataaaattttaaaatccaatcacttctgtatattatttagtatattctagttttttaagggtgatctttttaaccataccccatcttacttccaaaaagatttgagatacctaacaaaaatatatataccagactaaaataaataaaataaagaaattgagacaaaaataagaaaagaacttgcaaactctttctctttatatatgtatatatatgcaaacatgtatatacatacatatgtcaaagaactgtttcagatacaaagaactgaaggaaatttctccagccttctcagaaagggtatactagaggtatggcagacattgttttaatttgtacaacaggagtgctattggctgggcacagtggctcatgcctataatcccagcactttgggaggccgaggtgggtagatcatctgaggtcaggagtttgagaccagcctgaccaatatggtgaaaccctgtctctactaaaaatacaaaaattagctgggcatggtggcatgtgcctgtagtcccagctactcgggaggctgaggttgcagtaactcgagatcatgccactgcactccagcttggacaacagaactagactctgtctcaaaaaaaaaaaaaaaaagtgctattgaagtaaattaagtgaatcacaatttgtgattagaaagagagaaggcagactaaaagtcaattagccaagatctgtaacagtatgactgagcctgagcatgatcagcaactcaaagaacacctcctaaaaatccacaaagaaaagacaaatagagatttagacagattttcccttatattttgtcacctttactcaagtgccttcaaagaaaaaaaatggaaatactaaaagtatactttattttctatacataaagtacatcaagaaaataaacattgctctcctattaacaaaatgtactgaatatagtgtattcaacataccttcactgacagcatggggtttaacaatgcaacaggtacaattagtaaatttagcagtgtttgccggcccacaacctccacttgaaggaaaaaacaactccatttcctaaagacagagagaaatgattttgacaaatgtgatctcttatcttgaacttacaagatatttctgtgggggaggagaatcatgcaattacttttagagtttcatcatataaattttttgtttcagattttctaaaaatgagttttacaaagacacactgattaaattaaccctgtttcaagacttagaaccagaagagcatataaagaagtatcaatcaaagcaatgagaatatgtgtcattttgttccaggaatatagtggacaaagatttaataaattttgaatattggaaataccaatataaagttcttattctccccaaagcattagttaattagacacaaatttaattttaaatttttcattaaaatatgtaaaataaaatttaaaactaggaaattttataggaacagagattaatatcaggaatctgagaactacagctacttaaaactaactataggcctagtataaaataaaatcaaatgaaccatgttttataaacagattcaggctgtgttattcactttgcatgtggttcactaaaatgacaacacaacaatttgaactagccacaaagatgttcacactaatcagttcttttaattatttagatgctttcctgtctctaagctttcactgctattatttctactatttcctataaaaccctctgactcaagctccaaagaatcttaccaatgtgtaaagagccacctcaaataccactttccactaggaggcatttcctgatgcctccttccggcaacctttgttcccccaaagttatggttatttgggtacttatcttccatcaaatcataaatttgaaaaagagggaactaagttgtatagctctgtaggacccctagcacctaaaacaatgtctggctcaatgcaaatagcccttggtatacacaagggattggtactcaaatccctgtgtgtactcaaatccatgcatgctcaagtcctgcagtcagccctgtggaacctgcttataggaaaagtcaaatctctgtagatgtgagtttcacctcttgcaaatactgcattttcaatccttctgttgaaaaaaatccacatataagtagactcgtgcagttcaaacctgtgttgtttatggatcaactgtatttatttttcattaaatttaaaatgaaaagattatagaatgtgttaatgtgccacactgatgagcatttttttaaacacaaggatgatgaggaattattcaaatagtagtgtatacacctgagcatttccagtggtaagacactagaataaaaagtgttctattcctaagataccaactgcctttctatcatattgctgccattatttattattctttttaatcaataacaacagcaactaccccttttagtcctataccagatgctttgattgcatggtccgagagaacctttatggtacagatgaaaattcaaatacctacagggacctggcagatgatcaatgaaggaatgaagtagaagtggtgtgacaagagaatatgatagagtagcaaactagaaagggcatgctctttcgagagttcccattggtctgttcccttcacaacaaaattcaaaagaaatgtctttcttttccatttccatttttacttcctctcctacagtctcttttaaatccacaaccaattaggttttcattccaccaaagctgctcattaaaatcccttactacctccatgttgctaagtccactggttaattattctcagccctcaccttacctgaccaacagtatttgacacagtttgtcacatcctacactctggaatgctttcattacttgcctttcttcctacctcactggctactccctctcagtctccttcgatggttttctcctatctagctgacctctatgtgttggagagcaccagggcttagtccatctttattacttgttcactagcagtttctcaatgaatatttgggaatgactgaaattcagcacctaataaattctgcatgtgctaaacaaaataaatatatccacagtgtacaaatgagaaaaatgagactcagaaagcttaagtaacaagcccttacaagttagcaagtggcaaagccaggattcaaatccaagtgactgtagctccaaaaaccatgtactttttctattatctgtctttccaaagtaaaaagcagtgataaattgttctgtctctagtttaacaaattatttaacaattaattgaccaattatttttgtctcaactttcctttgatttcttttctcgctcaatttttaaaaataaaaatgccagctttccaactacccagattttcaagtaccatatttacctatgctgaataaatatttatttataaagcataaagattttacataaatatatcttcttagtgaaacgtgaataagagcgcttttactaggtcattgttatggcaattaattcaaagtctttataaaacaaagtcacaaaaataatatccaggcttctttgggatttgaggggctaaaatattttgtataaagatcctgttcttccaaagattcctgctattactcttggccttttacattttcctaaattccctagtaggaaagaataaatatttatagctttacaaaaaattaaaaattcagactgaattcgaaagctttaggtatataatttttaaatttttaaacaaattataaagtatatagttgtactacttcataaattttcacgctgataggatttcctggtaatttcactaaagcatttgtaattaatctatactaataattttattatgataataaaagtatggctaaatggtggccagttaaaagtttctccaaaactttgtacttgtaatagtaatttaaaatgaatatcatttctgtaaatgtcccaaattaaaacagtatagatcaatggaacagaacagaggcctcacaagtaaaggcacacatctccaaccatctgatctttgacaaacctgacaaaaacaagcaatggtgaaaggattccctatttaataaatggtattgggaaaactggctagccatatgcagaaaacagaaactggaccccttcctttcatcttatacaaaaattaactcaagatggataaagacataaatgtaagacctaaaaccataaaaactctagaagaaaacctcagcaatatcattcaggatataggcataggcaaagacttcatgactaaaagaccaaaagcaatggcaacaaaagccaaaattgacaaatgcgatctaattaaactaaaaagcttctgcatagcaaaagagaaattatcatcagagtgaacaggcaacctatagaatgggagaaaatttttgcaatctgttcatctgacaaagggctactgtccagaatctacaaggaacttaaacacatttacaagaaaaaaacaaacagccccatcaaaaagtgggcaaagtatatgaacagacacttctcaaatgaagacatttatgcagccaacatatgaaaaaaagctcatcactggtcattagagaaatgcaaatcaaaaccacaatgagataccatctcatgccagttagaatgatgatcattaaaaaatcaggaaacaacagatgctggagaggatgtggagaaatagaaacgcttttacactgttggtgagagtgtaaattagttcaacctttgtggaagacagtgtggtaattcctcaaggatctagaaccagaaatagcatttgacccagcaatcccatttctggatatacacccaaaggattataaaccattctgttgtaaagacacatgcacacgtatgtttattgcagcactattcacaatagcaaagacttggaaccaacccaaatgcccatcagtgatagactggataaagaaaatggggcacatatacagcatagaatactatgcaaccataaaaatggatgagttcatgtcctttgcatggacatggatgaagctggaaaccatcattctcagcaaactaacacaggaagagaaaaccaaacactgtatgttctcactcatatgtgggagttgaacaatgagaacacaaggaggggaacatcacacaccgtggcatgttgcggggtggggggctaggggaaggatagcattgggagaaatacctaatgtagatgatggggtgatgggtgcagcaaaccaccatggcacgtgtatacctacataataaacctgcacgttacgcacatgtatcccagaacttaaagtataataataataataataataataaaaagaaatagacacagccacttcaacctttggcaaaaacaaccctgatcaatcagcagacatcaacatcaaagtaagatcagcaaaaagattatgactcgctgaaggctcagatgattgttagcatgcattttttagcaatgaagtatttttaattgatatattcatagttttttttagacacaatgctattgcatttagtagcctacagtataaacataacttttatataccaggaaactaaaaaattcatgggactccctatatagccatattcactccactgtggtggtctgaaccaaatctacattatctctgaggtatgcttgtagatgaatagaacacaacaaatcgctgaaattgacccagatatatatattcaatacattttcaacaaaggtgcaaaagcaattaattaaagaaataaggtcttttcagcataatgctggaagaatatatgtctaaagaataacaaattgtgatcataccttgcaccttacataaaaattaactcaaaatgcatcatagagttaagtataaaaactaaaactataaaacttctagaagcaaataatgaaatattggtgaccttaggtgtgggaacagtttgttagacttgacacctaaagcacaatacattaaagaacaactgatactggacttcatcagaagtaaaaattgctcatccaaagatattgttaaagaggatgaaaatgcaaaccacataccatgagaaaatacttgcaaatcatatctctggataaagaatttgtatgcataatataaagaactctgagctgagtgttaaaaggcaaataaaaattacctgggcaaaggcagaattggaattccaaggcagaggggtagaatgagtaaaagcaacagagtaagaatcccacagtatacagaaggtgaggcaggatataaggctggaggaggggctgggagacagatcactggaacgccttggaaaccatgtcaaggagcttgaacttgattctgggaataatggagtactttaaaaatttttaatagtcatgagattgacggattaatatttttagacaacttgttctgaagcctatgtggaagatatatttgaggtagaaaagtatattccaggactcttgcagcagcccaggtcagaactagaagagtgatggtaggaatacagagaaagggaataattcaagaaaatgttcagaaggaaaaacctacaagatcttttgctgattctattaaggggataaacagggcagaagaaagaatactggctcccaaatttctttcctagagatgtacagaatacaaaaggaatactttggtaaattataatcagtgcaggctgggcatgatggcttatgcctgtaatcccagcattttgggaggccaagaaggaggctcactggagaccaggagtttgagaccagactgggcaatatcacaagaccctgtctttagaaaaaataaaaaaaaatagctggacatggtggtacaggcctgtagtcctagctacttgggaggctgaggcaagtggatggcttgagcccatgggttcaaagttatagagaactattatcacaccaaccactgaactccagcttgggcagcagagtgagactcttgtctccaaaaaaaaaaaaaaaaaattgtagtcagttcagtttcaaatgtattatttctatataagtctgaaactctaaggagaatcctagatagaaacttaagaagttaatttacacttttccatataaaattatctcacacaatttattgactaatcaatctatcccttgtccactgatttataatggcaccaacttctcattatatttgggtcatctcttgagcactctagactgttacactgatatacttacctactcccatgctaataccacagtttttcctactaaagctttataaaaagtcatgatatccttaaaataagtctcaccttatcatcaccacatctttttctccctcttcaaaactgtcttaactgttttggacccttggctgtttcataagtttgttaaacttcatgaaaatctgtgctaagattttgaatgaaattacccaatttatagatcaacttggaaagaactgatatcttcaggatactgactcttcccattcataaacatggcatatatcttcatttatttatgtctttccttattctctaaaataaatatttataattttctccatacagatctcccacatcttttgttcaatttattctaggtgtcatagacttttttttaaccgtatgaatggaaatctcttctaaaattacattttctaactggttatttcaagtatatcaagattactattgatttttgtatactaatattacatccagtacaaattacagatacaggtttgggaagcaccatgcaagtaaaatattaataataaaagataacatccattcattaaatactatgttctaggtactatactaagcactgaaataatttcatttaatcctcaaagacctctataatgcaggttcaatcattatcttattttacagactaggaaactgaaaattagagcaagaaaagcagtaaaccaagaaaagaagcctgcacaataccagcatctgaaaggacaagtgaaggaagaaaaaccaattagtaagacacaagtcatggtctccaaagacagtattttcaggaatgatgaaaataatgctaaattttaacaattgctcacaaatgagtagtcaaagatagctgaggaatgaaaatagtgagtataagtctatgttttggtaaaatctggaaagatggaatgaaaaattagacaataactaataggaattcaaggtaaagaagaggctgtttggggctgcataagtttggggctgtgatgtttttcaattttttaagacctgtggtctttgcttcttcacataagctcattttccagctacaatatttttccttaattcctagagccacctaacataatgtcaacaacactcactcttccccagacaagggtaaaaaaatatatatcctaaagggttcatacaaataataggatatttcaggaactaatggcagaaagaggttaaaaaaattaaatgcacaaaatataaacgaatatgtttaagacatttctttaggtgaaatggcaatggtagctgctctggattggatgtttgttccttccaaatctcacgttgaaatttgatccccaatgttggagatagggcctaatgggaggtttggatagtaggggtaaatcccatgaatagattaatgccctccctccaaggtgagcgaattttccctctattagttcctctgaaagctggttgttaaaaacagcctgacacctctcccggtggcttgcttcttctcttaccatgtgatctgtgcacacgcaggctcccttttaccttccacctcaggcagtggaagctgcctgagaccctcacgagatgcagatgcccaatcttgatgtcccagccatcaggactatgagccaaataaacctttttcctttataaatgacccagcctcaggtattccttcacagcaacacaaaatggactgagacagtagctaacttaacaaaagttgctccactacaagatatgctaaaatctaacaagtatatttatgctcaaatttattaaataatctagtagaaataaaaaagaaatggatggcataaggtggtaatagggtgaaataggcaggaaatatcagtaaacatggtagtgactttcagttcagcctcaattatttccttcattaattagatatgtttattatttttataatgctttaaaatatgattggaaatttaactatacaaaacaataccacatttacaataaatgtctactactaagatatggtcaaagactataattgctctcttgcatgtatctttaacttccttaacacttccgtcacatttgtttcacaaaaccacagccatggttaaaagccagctctccacctactccttaccttcagccatgcagttgaacaggctggagaaccacactcatagttcatggccatgaacactacatgggccattaattcagtatagcaatcacacaccacatttccctgatctattccttttccagatcaccatttcacatattcttctctcccttcagaccaaccaataccttatacctcatcctcactttcagctgttttgatcttgcttcctacttaagaatcagcatctgtgttcacatattctcccttcccatctgttgctatagacgagtacctgagaggcacacctgcctaatctctccacctgggttctaatttccatttccttttgcctaattaatgaaattgctccaacaagtcttcctctttttcctacatcatcaattttttacccaatacctctcctcttaaaaaaaattgatactacttttcttgacagctaccacctcatctctttgcaggaaaactcctcaaaaaaactcctcaaaaaaaaagttgtctatattcactaactacaattcccgtcccacaattttcttttaagtctactccacacagggttttgcctccacctccccatcaacattcaccttacaaagttcaccaatgatatccacattgcaaaatttaacaatccattcttagtcctcttcttacttgccttatttgacaccactggtcattctctcattttagaatatttgattcacttggcctccaggacataattatctctcagtttttcctcttacctctctggtggctcctcttcaacctcctttgctgccttcttctccttaccttttatcaagatgtagcttcatctttggtcctctttacttctctatctataccttctccttggtaatctcaaccagtctcccggctttaaataccatttatgtgctgataactctaagctgtcacactaatttttttcatcagtctaattggaaaactaacaaacaggttaagtttataaatgtccaaaacgttaactcctgattgtccattcattctgactctagccacagttttcctcatttcagtttacgtaaattctatccttctgataatcaggctaagaactttggagtaatacttggtatctttttctcatactctacattcaatctagcagaaaatcttgtttatttgaccttcaaccgttaatatatattttaaaatatatttgtatacttctttcattattaccacccaggtccaagccatcatctcactgggttattccaacagactcctgattaggctccctgttgctgtttttgccctctatagtcattcttttttttttcccccgagatggagtctcactctgtcacccaggctagagcacagtggcatgatctcagttcactgcaacctccacctccctggttcaagcaattctcccaccttagcctctggagtagctgggattacaggtgggcgccaccacacccagctaatttttgtatttttagtagaaacagggttttaccatattggccaggctggtctcgaactcctggcctcaaatgatctgcccgccttggcctcccaaagtgctgggattacaggtgtgagccaccactcccagcctctatagtcattcttaatgcaacagccagaatgatccttttaaatggcaagtggaagatatcagtcctttgttcaaaaccctaaaatggctctctattttttcagagaaaaatctaaaagtactactacggcctataagaccatataatctttcccctaattacctctgtaacctcatcaccctcttcctccctctctcattcctatccaaccacactgtcctctttgctgttagttgaccattccagacagaaatatgctattcaaggaatagcgagatggttagtgtgcctggaacacaatgattaagatagagattgatcaaagatacagttagagatagatatgggccagactagatagagcattggaggccacaataaagactttagattttattctagaagagacagaaattcactgaagggttttcagcaggtgaatgttaatctgatttgtctttaaaagatcactgggcatagctgattttacttgggtaaggtaaaattttcattaattgagtgtaagaaaagaggaaaaaagaatttggaggctattgtagcagttctggcaaaatataatagtgattcagaccacaatgatcagattcagggtttattttgaaagagctgaagggacttgctgatgaaatggtaggaaaaagaaagaaatcaattataaaactgtctaatattgtttcattgcaaacacaaccagattaaaaactaccttaagtgagacacttctcacgatgctaaaaataaacttacacttctttaattcaacctcagtataaatccaataaatgctttatttatatggatttaaaaataaggagtagagaaactttcataaacactagctatatataggaaaataataggatgttaagcttgaaagcacagtgttacgtctgaatcaaaaggaaatatctcaaattatatcttctttttaatatctactagccataaactggtattcttacatgaattcaataattcaaacatttaggagcctcagtaatttaagtcttgggaacaagaaacaggatgagaagtgttttaattggagaaaacttacgttgatcatgatcaggttaccagttcacaaaggagacacactgaatcactgtttgatagtaggcaagatgtcaaaggttttctctactactagagcagcagcataaatccaccctaagtcaccagtgatagaaatgctttcctttgatataaaacatttaacagaactagaagagcattaaaatatttttaaaacaccttactctggccgcagaagcaaaagaatcagggccatgcgctgcatttcttatgccatctgttccaaagagggctctaatgctttcagaagcatctgtgcgtgccactccagagtttgcaggtcccagcagtcttttccattcacatatagcatcatctcttaaaatctccatggcaataataggaccagttgtaataaactggatcagctcactacaaaacagatagaagattagtttgcttcttttttctgtcaactaggtatttgtcttaacgacaggatatatttaaattggattatttcaacatagacatgaatattataatcttagaaccattaagcatagttaattttacatgggcaggagaaatttttcataaattgagtgtcttgcagtggctcaattcacttcaaatcactagtaatgtcaaattactgttaccagaaaaatcactgttctgttgaattaagactatttcatgacttaaaatgcatactgttgacctatgcttttcccagtgctctaacaggtacagaggattttcctttttatttacatgtgtttaccactgcagtcaagtacaatttcacaatatatagggatggatgccttgtaacatatttttagtaagaatttatttatttttgtgtaaaactattagaattcaaagactgacaaagaactctcttaatcaataaacactgagctggtttggtgataaaaaaaaaaatccccagcaggcttcaagaaatatccttttattagcgtaaaaactactctgggttatttctgtattaaattattaaagtgtacgcatcggttcttgactaaaaatccagcactgagtcacagtcccccaaggtataaaagacaatacttcattttattttctacttttatatgtgtacaggatgcaatgacaagtttaactatgaaataagtgacatcctccctctgactatattaagcagggacacagtactttttagagtaagcccatggttttctctcatccaaagtagagagaagagatcctcctggagaaaggagcatggtgtgacaggctcttttgtgcccactaacttatgactattttttacacacttccttccaccctgcatgttatatgtcagctcccctcagtacttcctttttaaaacactcccattcattttgaagaatatttctaaaaaacagcatgtacaaaaaagtattcttgtcttctatcctaagagttctataatacctcctcatacattttctgccagacctttgctgccaaaacaaacaaaacccccaagaccaaccactagatttaaaaaaacccaaatcaaaggagcaaaccatgtttattcactcaataagcatttaataattgcctataacatatcagcgtctgtgccacaaaaaagatcccccttcaagacacttacaatctaacgccctattaatacaaaattctcaaaacacacaattgaataagcctatgaatatggcatgtaacaatatagggaaggatgtgcctgatcatagatactgcttcatgaaaatttaattacttcacctagtcttttgttacatcattctcattaacaggcaactagttaattcattcctttaataaaatttactgcatgcaaatcacacataaatcattagactaggagttgtaagttaatgctataaacatatacaaagtttataccaaaagataatttccaccaattttctagaaaagtgtatatagctattctaagaaggcttaggaatattttataacacttgatttgaaataatctatagcataataattttcttacatacaaatttttttaaaaacccactactcagtgcaggatatcaaataacatgtctactgtggccatttagtttggctgatgtaacattctttcttattagaagtgtaaacagtctttggcaacagtaataataatatgagcatgcaaaatattcacttaaatttaattacatgtcaaatatttagaatacataaagtgtaacatatattatctgttctatgtcaaggaacaaaatatatatcaaactagttaaaatagaaaggttccatgaacattgctttatgtatacaagactaccaaaatagtttaaaagtacaacaggctacagtaaccaaaacatcatggtactggtacaaaaacagacacatagatcactggaacataatagagaacccagaaataaagccacacatctacagccatctgaactttgacaaagtcaacaaaaataagcaatggagaaaggattctctattcaataaatggtgctgggatacctgtctagccataagcagaagaaagaaactggccccttaacattaaccatatacaaaactttactcaagatggattaaagatttaaaagtaagacctcaaactataagaatcctagaagaaaacctaggaaacaccattctggacattggcctggggaaagaatttatgactaagtcctcaaaagtaatggcaacgaaaacaaaaattgacgagtgggactaaagagcttctgcacagaaagcttctgcactagcaacagagtaaaaagacaatccacagaatgagagaaaatattcacaaactatgcattcaacaaaggactaatatgcagaatctgtaacgaccttaaataatcaaacaagcatgaaacaaccccactaaaaaaagagcaaaagacataaatacacacttctcaaaagaacatacaagcagccaataagcatacgaaaaaacgctcaatatcactaatcatcggagaaatgcaaatcaaaaccacaatgagataccatttcacaccagtcagaatggttattattaaaaagtcaaaaaataacatgctggcaagactatagaggaaagagaatgcttatacacggttggtgggaatattaattactccagccattgtggaaagcagtgtggatatttctcaaagaacttaaaacagagctaccatttaacctagcaattccattactgggtatatacccaaaagaaaagaaattctgccaaaaagacacatgccctcatacactcattgctgtgctattcacaatagcaaatacatggaaataactcaagtgcccatcagtggcagattggataaagaaaatgtggtatatatatataacacagaattctacacagccataaaaaaataaaattatgtccttggcaataatatggacacaattggaggccataatcctaaacaaattaatccacaaacagaaaaccaaatgctgcatgttcgcacttacaagtaggagctaaacattaaacacacatagacacaaatttgggggtaatagacactgtggactactagaggagagaaggcaggtggtttgaaaaactacctattgggtactatactcactacctggatgatgggatccatactccaaacctcagcatcacacaatattcccacgtaacaaatctgcatgtgtaccccctgtatctaaaatagaagttgatttttttttaaaaaaaaagtcaaaaaacgacagatatgctggcaagtctgtagagaaagggaacacacttatacactgttgatggaaatgcaaattagtacctcaaccactgtagaaaatagtttggagttttttcaaaggacttaaaacagaactaccatttgaaccttaaatcccattactgctatatatccaaaagaaaacaaacctttctaccaaaaagatacatgcacttgcctgttcattgcagcactatacaaaatagcaaagacatggaatcaacccaggcgcccatcagtggtgaactggataaaaaaaatgtggtacatatacaccatggaataccatgctgcaataaaaaagaatgaaatcatggtctctgcaacaacatgaatggagatggaggccattatcctaagcaaattaacgcagaacagaaaaccaaataccacatgttcttacttataagtgggaactaaataatggctactcatggacaataatatctattgatggcaacaacagacactggggactactagagtgggagaaagggaagggagcaagggttgaaaaactaactattgggtattacgctcagtacctgggtaatgggatcaattgtaccccaaacctcagcatcacacaatatacccaggtaacaaacctgcacatgtaccccctgaatctaaagtaaaagttgacataaaaaataaaaattaaaaaaattaaaagccccacaaacacaaaagcataataaaaatattgaacatcaaatataattatcactccatttttaatcaaccaaaaattttaaaagttatccttcttgtaatgtaaacaaatctttctatttgcaactgattaaactttaagatttttaatgataaaatataggaattcttacttaataaaaagacagagaatataattcttagaattctgtgcagttgcaagatgttgctatggcccttttgacagattattctcaagtaataaattttacaaatgtaactccatagttttctaggatatcctcctttacataccactaatccccaaattaaggacctacttgaaaaagggtcttgactggtgatctacatgaaaatccaatgcttctttcctataaaataatcaaaaaggcaatagttaagaattataaaattaaacacttattattttagcttacattaataaaattaagataaaatcctctcaatttatactaatttatattttaattaataatttttcaccaaatattctgtcaaagccactcttttaaaatattttttaagtatgagtaatatcaatgtaaataaaaattaatgtaggaggcaatgtttacttttctacttatgttatatattgtctatcttcttctttttttttttttttttttttttagattgagttacccaggccagagtgcagtggcacgatcttggcgctcgctacaacctccacctcctgggttcaagcagttctcctgttttagcctcccaagtcgctggaattacaggcgtgtgccacaatgcccagctaatttttgtacttttactagagatggggtttcaccatgctggccaggctggtctcaaactcctgacctcaggtgatccacccacctcggcctctcaaagtgctgggattacaggcatgagccaccgcacctggccttatccatctttttacacagcatcctgaacgttctagaaacaaaggttaatatttgaccagtgagaatatttgttctttaaagtctaaataagttgcatcaaaaaaatgcaaagccatcttctaattaaaaatttgtcatttttttccacaggctttaaacttaagagcttaggctagaattttaatttaatgtttatagctttttttcttagctaggtctctccaaaggaaagactacagtcgtgtttttaaaagctgcctgagaaattatgtatcttaatatgtttttattttattggttactaatgctttaactgacatcactaaaaaaggggagaatatggaaacatttagaattcagagtttattaattgtaacagggatttatttttacatttatattaccactaaagaatatctacagcggcaataaaagaatgcattttaaactgattagctaaaaagtctaaaaaactttttttaaaagcaaaccagatgactctcctaacactgtgtagttttcttaaaggctttgaactgggttcacagtatgtgacaaatatatgtaaacattaactacttttaaaactggaaactgttccctagcaaagaatcaacctttcaggcttgagaattcatttgatatgcaatgcttttaagattttatcaggatattacaaaatgaatttacataacaagttatatcacgcatactctcattctaaccaaatgtacttaaacattcatttggctatgaagagattatgaaatatgtaatgccaatatagagaataaaattcatcccgagacatggaaaggagaaaaaaatcaaaattttctagagccaattatagccatgattaaattattatatttattccttacaacaatatattgaaataggtgtgatcacctttattttacatcggaaaagaataaagttcagcatggttacataagttgtccagttcacaaagctagtaaggacaagacaagaagatttgaacccaaagctctctgattgcaaatttctgactgcttatgctcttgctactactaactgtagaacaacattctagagggtaaagagaaaaactcacaaaaaaagagatacgtatatactgcattacagcctaaaatggggtaaaactgaataactgaaaaacttacatggagagtaaattagaagagttagcagaagaatactaaaacaaccaattctaagcttttcaaacgcaaaaaactgaactacaagaaaggaaaaagcaatcataatctttaacgtcattgaaaagaaaaacctcaatccattactaaaaatgtttcattgttttcatccaacatgtccctgattccatagttatctccattcaaaatctaaaattgaaaccacgatgagagttcataaattttttcccatcattcttatctaattctttgctttaaaggtttagaaggaaataggtattaacaagtgaatcactatctagagaagttttttgttgttttgttatgttttgttgtgtttttatgaagaaactaaccattctttcacaaagatctatccattaaccctttcaagaaatatttacttaatgccaaccttgattgaggcactgatccaagaactagaaatacaaagtcatacagaactcagcagctatcttctggatattgtcatcatggcggaaccgacatttgaacaaacaattttagaaaagatgcatacattgtgagaaattcctccaggtgagtttctctcttctaacttgtcttatcgggtatgccaagaatgcaaggacctgactgatcttcatcggtgtcgtttctcaggattgtgtttgcaacaagaaaccttgagggataaggtaaagcctctcttcagtataaagagtaggcttgtttattgcttgctaatggaacagctggtaacccaagctcactcctcctcagttgtgatgccaccctctagatacacagtatacacctgggcattggtcattttattcctgtaggatatggaggcaaggagaaccaatataaacacaatgctcatgctgcttgctctaccattataaagtcttttgtctctgacccagaagtctcatgtcatctgctaacatccatggaagagttacaggtaacttcctagcttataaattggatgaaatctcaagctcaacatactaataaaaatatatgaagtgatatgaatgattagataagcagttaagttttcttgggaattagtttccatgagacatttgagttggttctgaacgatgaataggaatggatgagacagaagacaaggcagagcattcaagacagtacaatattatgtacaagaaaactgagatgtgataaagcacaacatgttcagggaactgaaacctaagtatcctcttagagctattacagtaggtgagtacagatgactaagagtcttgtatactctatcaaagagcttgtctgcttgaccatattttcctgcatatgggaaaccactgacggatttaaggaagggaatggtaacatgttcaaattttcattttatgaggttcattctaatggcaataagaaaatggcatggagcaatcttgaggtaggaaatgagccatcaaggaatagaaggtagtaagtcaagaagtagacaaatcagtcagtagcctatgttgatacgttgaaagcctgaatatgagcctataaaatgcctaaactaaggggctgcaataggaattataaggagagaattgctcccagagatatacagaaagcagaagtaaaaatatttatatatcaggtaggtatgaggaatgggggagcagcaagatgaatctaggatcactttcagattgacagttgcagagagaagtcaaggctgaagatgtatttggaattcatctataagtaagtggtaggtgatcatatggacatgcatgggactactcaagtaaagttgtaaagaaaataacatacaacaagctggatgcagtggctcatgcctgtaattctagcactttgggagtacaaggcaggagactcacttgaggccagttcgagactagcctgggcaacaaagcgagaccacgttttttaaaaaaacaaaaagcaaggatctggaggaatacctaattgaaatcatagtgaccgtcactgagatgggaaagcaaatagagcagagccctggatgatcactgacagagatgttgaagtcatcccaactgtcaggagacactggaatagaaggagactataaacaaagtgcccaaatctttaacaaatgtggagtttgtgaactgtagaatggaaatgaggctcagtggatggtaaaacaactaaataacatgaatttccaaggatgaagaagagtatagatttttaggagagagctaaaatacgctatatcgtgaccctgtgacataagaaacatttgtgagtgagcagcctacagggctaaaaggaaaggaatgtccctggagaagggtcagatttcaactaaactaaaaatgtgcgggcaaagatacactctgttaagacactatggacatagggatatttgttcacaatgaaacttgatttccagaggggccagtgaaaatggtttggtaagagatttgtgttcagaagactatgggaaaaggaagtgcataactacaaatgaacaggtgtgtcaacaagtaattagaagggcttgcatctgtggtactccaaagaatgaagtatttcaaaaggcatgggtggaattaacaagacttaaggtttcaaagaaactagcaaatgtatgccctatggtgctcttgaagtgtttgctggttttagcatttttcttcatgtgctatagggccattatgataaacaagtagcatctttaccacaggaagttagataccaagtcatcagacactagaagtatagagacactaaactcatgtaaccctcacaactactttatgagataggtactattataaatcccattttaagccaggcgcggtggctcatgcctgtaatcccagcaatttgggaggctgaggcgggtgaatcatttgaggtcaggagttcaagactagcttggccaacatggcgaaactccgtctctactaaaaatacaaaaattacccgggcgtggtggtgtgctcctgtagttccagctacttgggaggccaaggcaggagaattgcttgaacctgggaggtggaggttgcagtgagccgaaatcgtgccactacactccagcctgggcaacagagcaagactccatctcaaaaaaaaaaaaaaaaatcccattttgcaaatgaagaaataaacacagtggtcaactgttcagtcacacacctagtaagtagcacagttacaagcaatctggtctaaatactgtgctctgaaatgtaagcctcctgtctctctagaaaatatgtaaactaggagatcatacataagggaaaaattccaattaaacatgtcattgtcagggtaaaatggagggttttgtgttaaagtttctcggaatcagatgtattgaagctgacttgaatgtctactgctccccattgtccctgctctcacagaaacaaaaatgcaactgacccatggaataaatccagaaatgaatgatttattgaagcattaagaagatatctgaccaaaaacaaacaaaaactagtggagaaacataagaacactattggagccagatctgcctaactgctacattcctgtccctagagacactctgtgttacactcagccaaccagagggtgatcccaggaaacaaaggcctctgtcctatactcatctcccttcttcatcttccagaatgtttcagtctttgctttgtccatttggtaggaaattttttaaaaacaaatgtccaatatcatggaaaaatcactagttttttttctaaaggatctctaaaaaaaactgaagagaaggttttccctatcctttgtttgtacgttgttaatattctccttgccattcttacggggttagagttacttacttcatgatagaaagggataagtaaatgtataagtcttattttcactaaataacttagaaaatatctggtcaaacaggttgtactgcttgttagataggtatatttacctatctaggtaaaaaataaataggtatatttgcctattatttataataagaagagctaaatgtaaacatttccaaatgcatcatctttggaaatctcaacagtaaatcctcttgtcaaataaaaataatcagacatcatttcctctattaattttatacagtgtgttatccttatatattaagaaatgattataattatcaagcactggtgttataaaagcagatggggttttgaaagacaataataattaaatgaggcatgcataatttgacaactcctaattacttagacttcagtggttatttatgcatctgattacttggtgtcttattgttcttttctttcttctttttctttttgttgcctggtgtaatgcctacatgacagctgaatttctaccctgtcctaactttgcttatctttaagaaacaggacttctgcaataaaaggttccctttacaaccagaccagttaagactggttagaaccaagatatgcaaccaaatgacatcaaaaagacctcgggcttcattataatctcattttcatactatatggcactcccaccagcaccatgacagctgaaaatcaccatgacaatgaccggaagaggccataaaaagacaaaaaggaaagcagcactgcgattcaccatcaattgtgaaactggtggaagttcaccaccaatttccagaaaagacatgcatattgctcctcttgcttttcatgtcctttattagagaaatcctttattttaaccccctcacccctcactagttgagaagttgatttgtgagccacactcctgtttctcaattccacagacactgaataaagcctgcactgcttgatactcactttcggttttgtatatgggcttcatgacactgaataggaaaagatcaaatcttttagggggccggctttgtcagtaacattctagatgaactcctgtcagttcccattttggttaagttactattctattctttgtcattcaatacgaggttttttaattttaaacaatgacaagaaagacagaaaatgattttttaaaaaggaatcagacattacataactgaaaatgataaaaaaattaccttgaaagcatcatcattttgagtttggttatagtaaatccagctttgtttattatttcaattatttctccagcctttgatattgcatctggtttaattagggctagcgttctataaggaaacaaaaaataagtttgcaaataaaaatagttcaacagtttttatttataattcccaagcagcagtattctcaacaatcatcctagatcatcaaaatttgaaattaattgtatagaaaagtgtattaaagacatcccttaaaaacttacacaaagtaagcttagtatttttcccatgaacatcaaaattagatactaaacttgggggagggagaagcttaggaaaaaaagcactaaaatttaattatttttaatatatccaaatgagaaaacacaggcatttagaatctccatttcttagaatacattttatacaaaggactaatctctaaaacattgcattaaatatattatgagcttggtttttggtctcttagacttcaacatatgtatgctatatagtcagttcaacattgatttggaaataattataaattcttctattgactctttattcataacatgggtgactgcatgaagaatcaaatgtcttcttatacaacaatgtatatgaatacgtaacaacatgctaacttttaaaatcatgtttttctccaggaggatacatcagaacaatgcattctccactctccccctctgaagattcagaattaagagaaatttggagatgaagatcacctgagtgtcctcattttactaatgatgaaactaggcctaccaaggtaacatgacaaaggttacacagctggtcagcaacattttcaggacaaaacacccagtttaccagactcctaggtctgtccttccacatcacaaataatgttactattaatattattaaaaaggggcatcatcaccaaatcctcaagaatactatttgcaaatgcaacataaaaactatattagctggagtaattctgcttttgtgataaagaattgctgctacttttccctctgcatttccagttgttcttataacactggcattaattcaaggaatccataaaaggagaaaggttggtcttttcattttggatttttttcaccaataagacaaacttagctcaggataaaattcaaatatcctggccgggcgcggtggctcacgcctgtaatcccagcactttgggaggccgaggcaggcggatcaagaggtcaggagatcgagaccatcctggctaacacggtgaaaccccgtctctactaaaaatacaaaaaattagccaggcaaggtggcgggctactactagtcccagctactaaggaggttgaggcaggagaatgatgtgaacccgggggtcggagcctgcagtgagccaagatagcaccactgcactccagcctgggcgacagcgagactccatctcaaaaaaaaaaaaaaaaaaaaaaatcaaatatccttacttaaattggatatagcttatggctgagttttaaaactgtaataacaaaagaaattgttcatcttagtgtgtttattacaaattataccagataatgtttttctttattttaaagcagatgagtcagttatattactttatattgtctggcttcattgaaaacacacttaaaactcttcactttttaattcatattatttaaatattttaatccagactaacctataaactgtttatgctaaactctggaagaacatttcactgaccatggctcttaaagaaaaaataaaacatggcagtagtcatcaatgtctataaacaagaagcaatgtgaaaagtctaaaattgacaaacagcttaaaatgtaatctgattttctcttaaatgcctacaagagacaaaggattgactatgtgataaataactctaaataaattcctctgtcatgtctttgctgcttaatttttcagtaagtaatagtaaattgtattttggagggaaaataagagagagatcagcatcatatgtgttaatttaaaaataaagacagcacatgaagaaacaatagggtgacaaagatatatcagtagtatctctgttatctgtaactgcataacaaaccatccacatatgtagtggcgtaaaacaacaatttctcaaggttctgtaggtaggctgtgcaatggtttcacctaggatcattcacacagctgtattcagctagtgggccagctgggggctgtgctcagctgagacaactaggcttttctttcctgtggtccttaaggaggctagagcaggcctcttcaaataccaccacacatcaaccaatgtacaggcaattatcaagtgtccccttgagtcatttttgctgacatatctttggccaatgcaagtcacgtggtcaagctcagagtcactgtgagagaaaaccacaaggtatgattcattgagagccatcagtgtaacaatctaccacttagtaatcctcttgcctgcactgaggcaagcactgtaagatgcagcgtgagatattctcaaaagaaaacaaaacattataaaaaccactatttaagattaaaacttcttagcaatacacggtaactacttcttgtgaaaaaacagtatggccagccttcacgaacccagaatatagatttccagaaaataacaattctcacagagctatgcaataaatgtcttcatataccatcaggttctgagcaaaaattgcagcaaatatatttctgagaaagatgactgattgcagtacaataaatgtcccagacagtatagtgctattgctatgtaataaagtcttagatagtacagtgctattaaacatcttagatagtgcagtgctatggactctttaaatgccattgaccaaaaagaataaatatgtaaactttaatctatatgggattcatatttgtcttaagtaaatattctattctaaacctattctaaaagtaaacctattctaaacatcaaggctaaatttttggtttttctcatactttgtttacaagcataaagtgtatatctgccccatggataaaggaaaactgtctcaaatgaggcacctgtaatttggtggaaaattcagtgatcaagacttttgcttggcaacaatagcaaaattattcagaacaattcttccaccaaaaactaaaaaagttgatatttttaaaaaatcttttaaaaattaaagataaattgactagatcataaataattactgggacaaaagtgaaaaaaaaaaaaaaacaaccaaagaatgaaaagtaagaatgaaagttgtttttgacttgacagcattgcctatctggaaaatctgaactttgatttgcagtacatcattgggaaagggtaacagaacccaagagatgatccttcctaaaataatttggacccaaaggctataccacccccgcttaaggtgaatcagaaacaaccaggtcttgaatggcaatacaagttcacatcatctaagcagtctcaaaacttagaatttttgaactaccaatcatacagactgctaatgcctatgggaaaaagacagaagcaaagacaattaattccctcctagtaggaaagtaatgtcatcctgtacctcaaataattcatatgaaaatgcatatctcacatatattatttacatatatgcaatacacccacacatacacacatggcaatcatatagaaagataatcacacagacacatacacacatacagggaaaaggccaacatgagggaaaaccaggagaaacaacagaaaagagagagacccacaaatacttcagatactaggataatcagagaaaaactgtaaagtatctgtgcaaactatggttaaaggactaaaagacaagctacaaaacattatcaggtaatagaaaactgtaagctacaaaatggaataagcagatctgaaaaagaatatattagaatatcttgtgatgaaaatacaataatgaaaatgagaactagataaagggtttgacagaagaaagcagattcagaatgaagcacagagaaacaaaaagatacaacagagataagaaaatagtttcatgaatgtaagtgaaataaagacattttcagatgagtgcaaactgagttttctattagtaaacacactcaaaaggaaaatattttttaaaaatgtaatttaagcaaaggtaaaataatcccaaacagaatgtttgagataaaagaaaggataaaaagcaaaaagtgaagaaacctaaatgaatactcattacataaaacaataatagtaaatcattaggttcatggaaaaaaaacaaaaaaaaatacacaacaaaaacagcatataattcagcaaaaatcccaacaaaaattgagctaaagtcttctgagattcttagattttaaagaaggaggttaaaatattaattagatttaagctttatcaagttaagtacatatgttgtagtttctagtgtaaatactaactgtatatagaaaaaaaatagatgaaaaaaatcctcaagcaatccgaacaatcaaaaataagataataaaacaggcaggagaagaaagctcaggataagatgtcagagttaaagccaagtatattagtagttacgttacaaataagtgctctacagtagatgcagattataaaactgtatttataaaaaaatttttttaaaaagataatctgattggattttaaagcctagatgataggttgaaaggtgcagcaaaccaccatggcacatgtatacctatgtaataaacctgtacattctgcacacgtatcccggaacttaaagaaaaaaaaagatataaaaaacaaacaaacaaaaacaaaaactaatgaaaggcacacatagaagagaatactgaaaatctaaagtaaaaagaatggaaaaggtataccatgcgaatgttaactaaaagaaagccagtgcagctatagtaatatcagagaaagtacagtttaaagtaaaaggcattgctagagatgaagatggtctcttcatagtaataaaagattcaatttaccaagaagatataacaatttaaatcacctagtaacatacccttaaaattataatataaagactaacataactacaagaagaaatagacaaatgataattacattagaaaattttaataaaaccttggcaattgatagaataagctgcccaaaaattagtaaatatgtgaaagatttgaacatcacaattcacagacttcacctaatgaataaatatataaaactatacaaaacaactgcagactaaacattcctttcttttctttctttcttttttttttttctttttttttgagatggagtctcgctgtgtcacccaggctggagtgcagtggtgccatctcagctcactacaacctccacctcccgggttcaagcaattctcccactcagcctcccaagcagctgggactataggcacacgcctccacggccggctaatttttgtaattttttagtagagacaaggtttcaccacattggccaggctggtctccaactcctgacctcaactgatccacccgcctcagcctcccaaagtgctgggattacaagcgtgagccaccacacctggcctaaacattcttttctaacacacatagatcattaataattgactattctaagccagaggcaaatcttaaccagtttgaaaggcaaaaatcatgaagaatatgtcctctagacacatgcaattcagctagattccaatacaaaaagagaaaaacaaatctccgtatgtttggaaataaacataattctaaataaataataaaccaaagaagacaacacaaagaaagtaaaaaatgtttcaaactgaataaaaattacatatcaaaaataataggatatagttataagcagttagaaggaaatttatacccttaattgcatatattaaaaatattaaaaattgatagaatatataattctgtaactactaatagcagaaaaggggaataaagaaaattggtcaataaccatcaacttagaattgtgtgtctagcaatagtatcattaaagaaagagggtaaaataaaaaacgtgcagattaaaaagaaacgggtagtttacaatgaagaaatgaagaataacaagaagagaaaatattctaaaaggacaggttgatatgcaagaaaaattggtgaacaaatgtttaggtaaatctaagcaaatgttgtttctatcaaaataaataaataaataaataaaagaatgtctaacatgcaggcaaaaaaactgaatgtccaaaaacaacaataataacaaaactatgtaagatttaagagagaagattagagctaaagtgtcctaatcttgttgtatgagttgggagagagccatattattatagaactgtaagttaaatatatgaaaaaatttcaagcctaaccaataaagaacaagtataaaaatcacataacctctaaagcaacagagaatatagtaggcagaataacactacccctcaaaaatgtccacattataatctccagaacgtataaatatattacctcacctgccaaaaaggactttgcagatgtgattaagattacaggccttgagatagtagagattattctggattattcccctgggcccaatctcatcacatgagtccctaaagtcagagaatctttcctagctttagagaaccagagagatgtcagtgtgaggaggactcaagcctgctattggtggctttgaagatggagaaaggtggccccaaaccaaggaatgtggatggcttcaagatgttggaatgtgcaaggaaattgattctttcctagagcctcaagagaaatgcagtcttatcaacacctgatctttacctgatgagatctgattggacttctgacagaactgtaagatcataaatttgtattgtttaagtgactaacttggtagtaatttgttataacttcaatagaaaaccatataatagaaaaaaaaaactgaagagaggaagaaaaatttcttcaactaatccaaagaaaaggcaagaagaaaaaaatagaaaaacaggaaaacagtaaaatagaaacatatacaaaaataacaataatcacagcatatttcaatgtacatgtattaactttaccaatgaaaatataaccattccagattaaattgaaaaaaaacctatatgttatttacaagagacatatctaaagcataacagggcaagtataaaagagatggcaaaaagatattaattaacccaaatacgctatcaatcaaaccctttctaaggaaagatggctcaagctggagctgaaaaggaaattcaactctaatctgttaactgaccaaggaccatatgactgagaattgtagaatggaaaggcagaattcttattttacagaaaaaaatatcaatttctccctgggaatttaataatgagaaggcattcttcattgtattatttgggaggcagttacactgttgttgggtctatcgtataatcaatagcatgccatcttagacaacgatactatagataagtaaagatgagaaaaagattgggggtgagtttttagcaaggcctctgttactgaactaaggtattcctctaaggcattagggtgcccttctgcagccaaaactcaactgctcaccactggtcctaggacaatatacaaagcaacagtaattggtattgagggaaaggtttcccaaaggtgagagcaagactaaactaatattcatctggtctgttccccgagaagtagccatagtctactagagcatggcagccaattggcttaaaggtataaaacccagaaaacaactaggaatgtgtactcttgctcctcatgagtaaagtaacttctatccctgttcccataagaaagtgctctctctctctacttcttccatttgcttctccatgtccggccatatttaagggtttctggttatttgtggcccgacctcttttttctcagacctgcagaccctcaagtaggggatagtgtacaagtaagggatagcgtattgttctcctgctttcacatgttaagcacattggaatcagagtccggcacctgcagtggaagcctgtttctctctagtgctctctctcctgtgctccatgggctgggaggcaggatgagaaccctgggcaagtatgcccttagtttgttctgtagatccaacttttcctcaggcaggcctcaagttccagatcagtgtaagggatagaggaaataggaatagaaagaaagcctcaaccattctcaaacacgctttcacaagacagcctaagtaaaattaatacttaatattttgatctacatctatctcctgtgttagttcttcatcagttagtaatttggagggaagaatggagactaactgagctcaagagatgacaagaagctgttttaaggaggaatgtaaaagataaaaaagagaagagaaataagagagatctatgaaggagacaagtaaattggtaagattaggtccccatgtggatttagggataaaatacatatggaactcaaggacagccaccaattttgtaagtatgtaattaggtgaatattgtgttagtgcatacagaagtaggtttttcaatgaaagagaattaatttaattttgaatttgtcaattaattcaattttggatttttaagttcctgtgaaaaatctacatggaaacgttcaggaaaaagcttaaacatatggttttacagctggggtgatgacataaatttggaaagcaacacattgttgaagtcatggagtacatagaatcccctgggagagtatatagaatgagaaaaaaagggccatgaacagaaccctggggaataccaggagtcttttttgcctctgagaaggaatgactctgagaaaaaatagccagagagatagagatggaagcagcggtgggggtagcggtggtgaagtgccataacaaccaggggaagacagaataataatttttaaagtattctaaacttaatttattccagttgggatggaagaacagaagaggtacattttttgtatttattaaaattaaatttaatttaattttaattttaattttaattttaatttaatttttaaatttaattttaattaaaattaaaatgtcttttaagtcattcatacattatgatatcccaatactgtaatcctgctaaactatataatacctgaacactgaagttgtttcaaacttgatatagccaagattttatgacatttccttccaatgaaatttcttcaaacatatatctgatgatactgccaaatcttcacatagaaaaaacgtatagttcatatgagtcaaattctaatattagaaaatgtatgttcatccataagaattgttaaactacataagtctagaaaacatataaagtattatttcagtaccttttaaaaaattatcaattaagcaaatgcttggaatttttgggctgtatttaaaaattcaaaaggtgatttagttcaaaaggttatttaggtcaatctccctacctccagggagaagtattcttaagccccttccaagcacaggtctcatctaaaatacggcttgtttttttatccatataccatttcagtacatctccaagaggacaggaaaatgcatactgtgactgagttcctgctgtgatggagcctcaaataacttgggcttagaccttgggatcaaagattatacacacagttgacttcataatttttcttctgaaaaacaggggggtcttcctttcactgaaagttaatagatgggcacaagaatttcatgtatttaacatctactataatgttgttcacccaacctactgatgcctttctccctttaatttgattagatggcttgctttctggctgagactcaaaaggaatgaggattgctcaatgtaaatatgtggctcagtacttaaaattaatggatttttaaataggatactagcattatttttcattgatttttataaacttcttactaaagatataagctatcaaagtaaacatttaatacctcacttatcacatggggaatagctgtctattcatataaaattcctctatcattcatacacatgcatacatatacatattgactcatcatatgaaaactttaattatttctggtttgaggtaataaatttttagaaagacacaaattgtatcgtgtctccaaatctaaacaacaatcataaagcaccaattaattactagctaaaattaaaatcaaagactgactcattgacaacttgtaacctttatccatttgattagaggatctttataaagagaggataaaaatgtgaatcaaatgtcagatttctacagtcaaagggaattggaaagctgaagctagttcatgagttaagctgaattatattaaattatctggataactgctccccaattagctgataggctccatggggatcaatttcactcatcctcctcactacaggctttactatagaaagaaaagagttgaaaatgtaattggttcaaaaatttttctcaacactatacaaaactgagaactagactaaatcggttgttacatagaaggtgtttctgtggaacgctgatagacatacacacatatttccatatgcttactttttgccatttaaataaaacaataaatttttgaaactcttcggtttggaagaagtttatttaaatcacccaaatggttgttggatttactaacccatatgcaattaagaaagaataagaagagaaaatggtgaatcaatttgagtcagtaaaatatatactacatatattttcattttcattaactatataaagcccaaatacttcaaatttgtttttacattaaaatagaattcttctgttcatcctgttttaaaatcagtcccattcaacagtatttgccagcatattaattagaggtttagtagaaagagaatgaattttagggaaaaacaaaacacggttttctggtttccctttactttctagctgtgttactgtggacaagttacttacccattctataaaatagatttaacaacattcacttcagtcaaatcatagttaaaatacataaattataatttttatggttgttattttatttttcttaggtcagactgttaaccctgactccctaactcacttattttgctagtttaaataaaaatttaaagcagtcttccagcctgggcaagaaggccaaactccatctctagcaaaataccaaaaaattagccaggaatagtggtgcatggctgtagttccagctacctgggaggcttagatgggaggatcacttgagcatgggaagtcaagggtgcagtgggctatgatcatgccacttcacttcagcctgggtgacagagccagaccccacctcaaaaataacaataattaaataaaataaagtagtcttgaactgaggtgtatgtaaagtgcatatcatagtgtctggcacatagtatgtgctccataaatgaatgctacacatatttatgagttttaaataaaggaattatggttggcatttctttaatcccaaagacttttacataagatctcataacattaaaagattcctatttatttatctaatacctgaaatttctgtcctatttcaaagagagtctttggtcttcctttttaatgaggcatgcaccacccctctgatccatcaccatttgtgtactaacacccacactaagaatccaatcacctcaagagctataaagtgcttatacagaaagactatggaagtcacagaaagagatatcatattactataagagtgactcagacgttaggcaatcagctagtcatttgagtagtagatctcaaaaaatagtttgattgatttgttttccctattgaattaaatcatttttggagccttttatacatatagccttaacttctacaaataatccctattttaattacagcaccaatcactctacaggaaaaaaaaactccccaaaccatacaaagtataagctacagaaattaaagccaagaaagatgacaaaggaattaaaatttcacttcaaatataattaattctagtctcagaaagttgaaattcataaatgtagagactgaaaattaaaatgtcatcttgctaatactgaaaatcagtattcagaaggaaaacatcaaaaatccttgttttcttgttttctataagtctaattttcagctgtatctacaagttgttctttctcttccattttttttcttagccccttttacagatgactgtatctcttctaaatcaaaactgagaaaaagaatgatgaatgcagctttgacaaacaatagagagaagaacagggacacatgtggaggcaccatgtcacagtttctctcacagaaagagccacatgcagtgggaggaagatagggaggcggggatgccagccagtgggaaactcttcctttagacataccgtacctccagacatttcgatgacataaatttattcattcatatatttaacaaacttttgtgggtcacactctgtgaataatttactgtttgaggtatcactacaacagtttttagggatacagttatgaataagatacatcagtctccctgtatcataatttctttatatggtttcttttttttttcctttttacaacactcacattgtcatttttcaattgatccgttggtcaacatctattagatataaatatatatatatatatctgttaacaaaacttgacaataggcagcattagttacaaacaatctaggcaaaaacctcctggtcaactagatcaaagatcatcatttgaaaacagggagaaagtggaaaaaggaaagaatagatcatagattttaaattgtgattcattaattcgttcagctaatacagacaaggtgcttgcaatgtggatggagatgtgctaagtgccacaggagacataaacatgaattaagtcagatgagacatgcacaactatggtattatcaatttttttttaaattgaaaaaaagaaaaagaatgaagacaaccattttccaggtcctatccatcctcatatggttacatactcccagtcttgattcagattgactttgaacccaaagttagagcatgtaaaaagattatataattgttttcttacttttctttcctactgcccagctggcgagctgtatattgatccccatagtcaattaataccagttgtcgagaaaagacattcactttgttgcctataaataaatcttccaagtgcaggttatcatatttggtccgctttaaaaaggtgcgatgattctttacatcatgctagaaccagacacaacaatataacaaacaaacaaaaaaagttatgaataaggaaagttaatctcatcataaggtagaaataattcttaattctgtcttatcaaagataggttatattctgtttcttttttgttacaaatataaatcataatttttaataacttccatatttcctaatccaatctggtaataacataaaagcttcttattacaaatttaatactcttaaaaacctgaatagaaagatttgtttattaccaaatcatttcagcaaagtagtccttacaaaatgctaaagaaagagtcatacacccaaatttctgctttcttgtgtacacaaaatcccaataccaaaaagatctacttgttaaaattgtgttgccagtgaaagaacacaaagaaacagaagtctcttagcttgagcctcttcaatttgactttttgtagcaataacagctttcaataatgaggacgtatttatgaccataataatccttatctataatcacttgtttatttcttatccaaaacatgaataatcccatttcagtcttttttttttttttttttttttttttgagacaagagtctcatgcagtcgcccaggcaggacaggcaggagtgcagtggcgtgatctcagctcactgccacctccacctcctgagttcaagctattctcctgcctcagcctcccgagtagctgggattacaggcatgtgccaccacacccggctaattttttgtatctttagtagagatgggttttcaccatgttggccaggctagtctcgaactcctgacttcaagtaatctgcctgggtcggcctcccaaagtgctgggattacaggcatgaggcaccgcgcccagcccccacttcagtcttctaacaacaacaacaaaaaattcctatttttgacattaaaaataaaggcacaagttaacttcttatattggaattataatgaataagtttaaaaagaatttccatatgtatatatacacacacacatacatataaatgtgtttttaaaaagcaattatataaaaggcaatggttcccatgttcaccccctttgccaacattcaagcaaagaaaggcttatttaccatttcaacagatccatcccctgggtaaaataaaagctcataacgtcgaagaagtgaagcatttggatcataccactctgcaatgaaaacgaatctttcactatgattctgcaaagaaagacagaagaattttaacactaacatataaagaacaagcactcttctgtaagtcacacaaaatgaaattaccaatatgcaagaaacaaaattacttctacctattatattgaatgtttctgcttttcaacaaagtatcagttatcaacacaccctcagcaatatttcctttcaatttctcactaaatacccttagatatctcaaagatgacttatggattgctttttactttacagccatctaatcatcctgagtaaattaacgttttctgagaacatgagctcctgattttactattgtaacaattcagtccttctgaaagcaagtttacatacagactatcaataaactaatataagaataaatttctgaggagagctctcaattatatgaagttttgacttccctaaatttgagaatctagtagtatcagaatattaccattaaaattatagcaaacatttttttttccttagtaatttcatatgatagtatctttttatagaaatagagaatgtgttagtctaggacctctgaaaatgaatgtgaagacaagattgaacatacaagaatttcattaaggaaaattcccgtaatataaaatgatgagggagccaaggaagactagaaaagccgataaaaacaatagaagtttgacacagagtggtggagagatgcaaggaaggttaagtggaatcatcccacattgctacaccctctaagaaaggttctgtaagcccatcaggaagtgctagagccaggtgactcccaaggacagggaggggccagctttagtatccctgctcctctcaatcagtggctgggagcagcctttgggaagcaagtgctcagcacaaaagcagcagtggatttcagagaacagcagctgggacccttggtcacttaggttgcctgtagttggaggtctgtgaagtacactcttagggctaccacagagagcaaaaaatgaaaaaaataagtcaaagatgggtccttttcccttgactattgagcaggacttcccatcatatatgttagtaaaaataccctcgccccaaagatcttcattataataagcaaataaaagcatagggaagaagggaatctaggagttttattgctaattctggatttgccatctgatgctctggttagggaaaatttgggggttctttttaagttaataattgacttataaattctaatggtagaagttgtgtgtctaatgatgtttataatatatccataaactataacgtagatgacacttttatttttaagacacttttatttttcccacaatcatccaaagacatatttaaaccatgctgattactcaagagaaaataaatgtaaaataagagacatactatgacatttgtaaaagcctttcatcatatatatttttcatattgattataacaatacagcttttttgagtttaggtttcactgtgcattctagtattgtactcacctacaaataaaaatttaaatattagtagattattaaaatttttactatccataataaaatatttatttaaatacataattgaaatgttgccttcactaaaataaatataaaatagaagaaatgacacatctaactaaagcaaatgaaaaatccacgaaacctggtacttccatttatccatgtagcctatccaccaaacctgccaaccacactctttaattctgaattgggcagcagaattttgcactatactctatccagaaaagagttttaatacaaagaaaataaactgaggaactgttgcttctggctatgacaaagtagctcacagcaaaccaatgctacttctaagaacaactagaaaagtaggatatcaaagatttggagagcttttaaggcagccaggatctgaggatccaagatccagaaagacaggaagcccattgaagtgaaaccaacattcattgcgttgtctttactcgtaagacatgtgctgagtctcaagtcaagcagacaagtgactgagaagcctaagaagctggtagagggagcccaccaagggacagagaaacaggtacaaaagtgagctgaaacctgtgcttgttcagtagagcttttggaaacgaactcccaagctagtgctgtttcctctgtgggaaaaggtttattactccaagtacaaattatattcaaacttgatttaaacttaactttctggtttacctttacagtaaaaactgtgtttacttcctagagttaaaagatgtacctggagatataacagtggtacatctggacttgggataaaacatcacagtgaggttggcctttcaactacctgcctgacacacatgcacatacacacaccatccagaccaaagccacccttaaaatttaaagaaaatttacttttcagctttgttgagccaaatctagaaaaaaggaggaacttggtttccttcctcaaatgctattaaagctatatatcattttgttttaactcttcactttatggataaagaaactgaactccagataatataaatgactagcataaggtcacagagctggttaataactgagccaaaactggaaactacatttcctatgactcagatatttccatatcactagccttccagggccaactcaagagagagaaactaacactttagtagcacatagatacaccttgagttgtctgtcacagatgctctgatgagaatgccacaacctaatgattacacagacaatcattagctccttcttccctgaagattccaacttctatcaaaagtactttatgaggaacatttaaagattacactgcatcaaaaagagactttcttaaagaagccaaatcatttttcctcttttgaacattttaaatataagttatacataataaaagagttgatccctcacacataatcacactttgttccagaaatcttaaagtcttaaaggaaaatgtgtattattataccagaagtcttgaagtgacttgaactggacaatgtggtattattatacccagaagccttagtatcttaaagtcttaaggtctctgtctatacagagagaactttcctagagcaccagtcttactcgatggtaagtaacgtaaacaatttttacactgcaacatgcatatatgtgtatataaatatatgttattgagtggaatgtaaaattcatataagttttataacaaaaaataggtgattttatggaaatattgaccaatattggaattgcaagtgaaattatatttgaagattaaacaagtctttggagaaataaatcacaccaccacctctctctgctactgtttaaaggaaggtccagctttacagtggatcatatgaaattaacaatcttttccatacagatatactttaaaaaatccaaactctcagttcaagagtaagtttaagcgtatgttaccaagcaaaattgtaccttggcctcatttcaataatactgatcagaaagctattccattcctgatgatactatgatcatcaatcaacaaataccaactgggcctggtactactagcatgctgagtgcaacgagcacaccaatctgataagtctgctgctgctggtgctactgctgctatcatttgctggcagcctacagcaagagacatggccctgaaatgtgttgcttaaagagaagatccaggaaactataaaggggttttttggagggggggattatggaggaatatttgtgagagtccaaaagacctgggcaagacttaatgtctctaactctcattttccccatttgaaaaatggaaacagtactttcttcataaggtagttttggggattaaatgacttagtttacatgaagcacttaggatttctgttgcctatgtctcccaaagcgatgatggtggcttataggtccacctgtgactttagaactgcattgtacacactcatctccctcactgatctttttctgacatacaagaagagcaactctggatttgtgatgatgcagcctcagctgcaactaaccctaggtaaatagttttttaaaggtctttgcagaaaaaaatcagtatgaaggaaaaagggatttatgatggacaaaaaaatgactaaaattatatttataaatgaaaataaaaactattgaacatataatactaggtaaatttttttgtaaaggatatatcatattaataaatcagagccaaagtacaattcttaccttttggggagttcaaacagttatagatctgtttttgtcaataaaaattttagtaacaattttctttttaaattttataacactatctgttgcacattcatcattagttttataatggacttagggtgccccttaaagcagatatagcttagatcataatacccaagacttttcaaatacatgtaaagccttcctaagaaggatgggtacaaacatgccaagattgcagactacagtaaatacctaacttttcagtgcccagacacagatgaacatccacaagtatcaagatcatccaggaaaatatgaacttaccaaataaaccaaataaggcacaagggaccaatcctgaagaaacagagatatgtgacctttcagacagagtattcaaaatagctctgctataggtttcaaaatcaaccctggctaggggcctgaagcaaaccagtttagtgctaacaacaacaaaaaaaaaatctgatctaatttttttcactttactttctctcccacatattccttatttctcactctaccgctccaagcttcaacttccttgttcctaaatattttatgaaaaagttcaaaacactttttcttctggataagtaatatttgtgttttcttaatgtcatgctgtggtttgaattttcaaatttcatgaaaatttgtgtttcctgaaaaaaaaaaaaaaaaaaacctctgctaaggaaacccaagaaattcaagataacacagagaagaaattcagaattccatcaaataaatttaacaatgagattgaaataattaaaaagaatcaagcagaaattctggagctgaaaaatgcaaaaagcgtactgaagaaggcatcagagtcctttaatggcagaattgatcaagcagaagaattagtgagattgaagacaggttatttgaaaatacacagaggagacaaaaaaagaataaaaaacatgaagcacacctataggatctaggaaataggctggaaagggcaaatctaagttattggtcttaaagaagaagtagagaaagagataggggtagaaagtttattcaaagggctaataacagagaccttcccaaacctagagaaagatatcaatatccaaatacaagacgattatagaaaacattaaacagatttaatccaaagaagaccacctcaaggcatttaataatctaactctcaaaggtcaaggataaagaaagaattctaaaagcagcaagagtaaagaagcaaataaacaatggagctccaatacatctagcaacagacttttcaatgggaactttacaggccaggagagagtgtcattacatatttaaagtggtgaaggaaaaaaagactgttaccctataatagtatatttagttaaaatatccttcaaacatcaaggagaaataaagactttcccagacaaacagaagctgagaaatttcatcaacaccagacctgttctatgagaaatgttaaagggagtacttcaatcagaaagaaaaagacattaatgagcaacaaataatcacctgaaggtaaaaaactcactggtaatagtaagtacacagaaaaacacaggatattataacactgtaactgtggcgtatagagaaatgcaaatcaaaaccacaatgtggtaccatctcacaccagtcagaatggctactaagaagtcaaaatggctgggcgtggtggatcacacctgtaatcccagcactttgggaggttgaggcaaaaggatcacgaggtcaggagttcaagaccagcctggccaacatagtgaaacccccatctctactaaaaatacaaaaattagccaggcatggtggcaggcgcctgtagtcccagctatttgagagtctgaggcaggagaattgcttgaacccgggaggaggagattgcagggagccgagatcgcaccactgcactccagtctggtgacagagcaagactctgtctctaaataaataaataaataaaatccattacaaatgttactggagaaattaaaaaaatctttagtggctactacaagcaactatatgccaataaactgaaaactctagaagaaacagaaaaataaccagatatatacaatctaccaagattgaaccaggaagaaattcaaaacctaaagagaccaataacaagtaatgagatcaaagccataataaagactcccagtaaagaaaagtccaaaaaatagaggaggagggactacttccaaactcattctacgaggccagtattaccctgataccaaaaccagacaatgacacatcaaaataaataaataaataaaactacaggtcaatatctctgataaatattgatgcaaaacttgtcaacaaaatactagcaaactgaattcagcaatacattagaaagatcattcattatgaccgagtgggatatatccctgggatgcaaggatggttcaacataagcaaatcaatcaatgtgatatgtgatatcaaaagaatgaaagataaaaaccatacaatcatgtccattgatgttgtaaaagcatttgataaaactcaacataccttcatgatgaaaactctcaaaaaactgaatatagaagtaacatacctcaacataataaaagcatatttgacaaatatgacagacccacagctagtatcatactgaatggggaaaaactaaaagcctttcctctgagatctgaaacatgacgagggtgcccattatcactactgttgttcaacataataatggaagtcctagctagaacaatcagacaagagaaagatataaagggcatccaaattgaaaaggaagaagtcaaattatccttgtttacagatgatatgattttatatttggaaaaacctaaagactccactgaaagactcttagaactgataaattcagtaaagttgcaggatacgaaatcatacaaatatcagtggtatttctatatgccaacagtgaacaatcttaaaaagaaattttaaaaagttatcccatttacaatagccacaaataaaataaaatacctaagaattaacaaaagaaatgaagatctctacaatgaaaactatgaaacactgatgaaataatttgaaaaagaccaaaaaaaaaatgggaagctattccatgttcatggaattggaagaattaacattgttaaaatgtccacactacctaaagcaatctacagattcaatgcaatccctatcaaaataccaatgtcgttcttcaaagaatagaaatagaaaaaacaattctagaatttatatggaaccacaaaaaactcagaatagccaaaaccatcctaagcaaaaagaacaaaactgaaaaaatcacattaactgacttcaaattatactacagagctatagtaacccaaacatcatggtactgacataaaaacagacacatagaccaatggaacagaatagagaacccagaaaaaatccacacacctacagcgaacccattttcaacaaaagtgcaaacaagatacactggggaaaagacagcctctttaataaatggtgctgggaaaactagatgtctatatgcagaagaatgaaactagaccccctatctccagccatatacaaaaataaaataaaaatggattaaagtcttaaatctaagacctcaaactatgaaactactacaagaaaacatgggagaaaatctctaggacattggtctgggcaaaaatttcttgagcaatgccccacaaacataggcaatcaaagcaaaaacggacaaacaggatcatatcaagttaaaaaccttctgcacagcaaataaaacaatcaacaaagtgaagagacaacccacagaatgggagaaaatatttgcaaactaccaatctgacaagggattaataaccagaacacctaaggaactcaaacaactctacaggaagaaatctaataatccagctacaaaatgggcaaaagatctgaatagatatttcttaaaagaagacatacaaatggaaaataagcatatgaaaaggtgttcaacatcactgatcatcagagaaatgtcatcaaaactacaatgagatatcatcttatcccagttaaaatggctcttatccaaaagacaggcaataaaaaatgctggtgaggatgtggagaacaggggacccttgtacactgttgttaggaatgtaaattaaaacaaccactatggagaacagtttgaaggtttctcacagaactaaaaatgatccagcaatcccactgcagggtatatacccaaataaaagggaatcagtatattgaagagatatctgcactcctatgtttgttgcagcactgtttacaatagctaagatttgaaagcaacctaaatgtccatcaacagatgaataaagaaaatgtggtacatatacacaatgaagtaccattaagccataaaaaagaatgagatccagtcatttgcaacaacagggatggaactggagatcattatgttaagtgaaataagctaggcaaagaaagacaaacatcacatgttctcacttatctgtgggttctaaaaaatgaaaaaaaattgaactcatggacatggagagtagaaagatggttatcagaagttgggaagagtagtgggaggctgtagggaaggtgggggtgaataacaggtacaaaaaaaataaaattaaaaagaatgactaagacctaatatttgatagcagagtagggtgactgtagccaataataacttaattgtacattttaaaataacttaaagagtgtaactgcattgtttgtaacaaaaggatatcaaaaggataaatgtatcaaaaggataaatgcttgaggggacagagcacattcaccatgatatgcttatttcacattgcatgcctgtatcaaactatctcatgaaccccataaatatatatatctactatgtacccataaacatttaatattttaaaaaaaaagaaatttgccaagatcacacagcttataaacagaggtgaacccaggcagcttgactccagatctgctcttagacactctccttaactgtggcaagaagggatggaaactcccttctgagagacactggactaagcagcctatataagctgcagtgtttgctcgatttctagaaatagcaactatattctttcaatttaaccccctattaagacaaatcaggttttaaaaaccaacacaaccacaacaataaaaatcaggacatacttatcagacttgtaattctaacagtgcactgaaaaaaatgtacattgcatttttgtaatgctgtattttaggaaaaattacttcacaataggcagcaaaatatttttgttcatacaaaagtgctcccttctttaaatcatactaaatggattccataatgcatgatggagaaatatcttaaactaactagaagtcttattttcatgatttgcatgttgaagggtcagtaactagtcaatctatttcaagccaagtatctgcttctgtttgacttcaaagacattctggagtaaattatgtagatgataaaggttacagttcaacaagcttctaaagtttagtctgagtctccatgaacccacattcaccttgaatgacattataatagaaatcaacagcatgagtaatcaaaacagcatggtatgggtagcaaaacagacacatacaccaatggagcagaatagagacctcacaaataataccacacatctacaaccatctcatctttgacaaacctgacaaaaacaagcaatggggaaaggatctcctattcagtaaatggtgctgggcaaactgactagccatatgcagaaaaatgaaactggaacgcttccttacactttatagaaaaattaactcaagatggattaaagacttaaatgtaaaacccaaaaccataaaaaccctggaggaaaacctacacaataccattcaggacataggaatgggcaaagacttcatgacaaaaaggccgaatgcgattgcaacaaaagcaaaaattgacaataggatctaattaattaaactaaagagcttctgcacagcaaaagaaactatcatcagagtgaacaggcaacctatagaatgggagaaaatttttgcaatctacccatctgaaaaggtctaatatccagaatttacaaggaacttaaacatatttataagaaaaaaacaaacaaccccatccaaaagtgggcaaaggatatgaacagacacttctcaaaagaagacatttatgtggccaacaaacatgaaaaaaagctcaacatcactaatcatcagagaaatgcaaatccaaaccacaatgagataccatctcacaccagttagaatgacgattaaaaagtaggaaacaaggtgctggcgaggctgtggagaaataggaatgcttttacgttgttggtgggaatgtaaattagttcagccattgtggaagacagtatggtgattcctcaaggatttagaaccagaaataccatttgacccagtaatcccattactgggtatatacccaaaggaatataaattattctactataaagacacatgcacacatatgttttctgcagcactatttacaatagcaaagacatggaaccaacccaaatgcccatcaatgatagactggataaagaaaatgtggtacatatacaccatggaatactatgcagccataacaaggaatgagatcatgtcctttgcagggacatggatgaagctggaagccatcatcttcagcaaactagcacacgaacagaaaaccaaatactacacattctcactcataagtgggaggtgaacaatgagaacacatagagaggggaacaacacataccagggcctgttgtggggtgggggatgagggaagggaacttaggggacgagtcaataggtgcagcaaatcaccatggcacatgtgtacctatgtaacaaacctgcacgttctgcacatgtatcctgatttttttagaagaaatatatataatatatatgtttatatattttatatatattaaataaataatatatatttaatatatacttttatatattaaatatatatttatatatatgtttcagaagagatatatatatatacatatatatagaaagaaatcaacaccatctaagaacctgctccctcaagccagctgcttccagtaagggtgagtgaaaagtggcttctaaacaaggaaattttcactttgccttgaacattctgagaacatagtgtgtccggaattggtgggttcttggtctcaccgacttcaagaatgaagccgtggaccctcgcagtgagtgttacagctcttaaggtggcgcatccggagtctgtcccttctgatgttcagatgtgttcggagtttcttccttctggtgggttcgtggtctcgctggctcaggagtgaagctgcagacctttgcggtgagtgttacagctcttaagacagcgcgtccggagttgttcgttcctcccggtgggctcgtggtctcgctgggctcaggagtgaagctgcagatcttcacggtgagtgttacagctcataaaagcagcatggacccaaagagtgagcagtagcaagatttattgcaaagagcgaaagaacaaagcttccacagtgtggaaggggaccttcccttccacagctagctcaggcagcctgcttttattctcttatctggccccacccacatcctgctgattggtagagccgagtggcctgttttgtcagggcactgattggtgtgtttacaatccctgagctagatacaaaggttcttcacgtccccatcagattagttagatacagagtttggacacacaggttctccaagtccccaccagagcagctagatacagagtgtcgattggtgcattcacaaaccttgagctaaacacagggtgctgattggtgtgtttacaaaccttgagctagatacagagtgccgactggtgtatttacaatcccttagctagacataaaggttctccaaggccccacaagagcagctagatacagagtgtccattggtgcaatcgcaaaccttaagctaaacactgggtgctgattggtgtatttaaatccctgagctagacataaagattctccaaggccccaccagagcagctagatacagagtgtcgattggtgcactcacaaaccttgagctagacacagggtgctgattggtgtgtttacaaaccttgagctagatacagagtgccgattggtgtatttacaatccctgagctagacataaaggtcctccaaggccccaccagactcaggaacccagctggcttcacccagtggatcccgcaccggggctgcaggtggagctgcctgccagtcccagtgccgtgtgcccgcactcctcagcccttgggtggtcgatgggactgggcgccatggagcagggggcggcgcttgtaggggaggctcgggctgcacaggaacccacggagtgggtgggaggctcaggcatggcgggctgcaggtcccgagccgtgccccgtgggaaggcagctaaggcacgcggtgagaaatcgagcgcagcgccggtgggctggcactgctgggggacccagtacaccctccgcagctgctggcccgggtgctaagtccctcattgcccagggccagcagggctggccgactgctcccagtgcagggcccgccaagcccacgcccacccggaactccagctggcccgcaagcgccgcacacagccctggttcccgctcacgcctctccctccacacctccctgcaagctgagggagtgggctctggccttggccagcccagaaaggagctcccacagcgcagcggtgggctgaagggctcctcaagtgccgccaaagtgggagcccatgcagaggaggtgccaagagcgactgaggactgtgaggactgccagcatgctgtcacctctcaatagcagatcattaaaaatgtattatctacacagtaggcaaacaagcatagtaattcacattgctttacttagatgtcacagtgataagtacaatagaaataaaaacacaaggaaaaggtttatattatcccattgtcagaggctagattttaagcactaacttgttttgtacctatcctttatcaaatagtcttcctccagggcttccttcaaagaccaagaaattttcttacattgaatagtgtcaaatattaaccttactttagtgtgaccataaccagttttgagcctgtccaggttgttcacagagacctattccttcttcataaatctatcttgtaaagacagacagaaggcaaactcaagtaaaaagggtcttcacgtgtgaagaatctaatttgtcaactccaacttagcatttctcattaataaaggaaaacaaattataacagaaggaaaagttaggtgaatcattaaatttagttagctatcctatttcacttaaattctttaaacactaagtataccattgcaatcactttttgcttttaaaaaattacagtttaaaatttcttttgaaaaaatattttcaacagaattccacatatttccaagattgtgttttttaatgttacttcaagacaatatctcagaaatagaatgcattgtttttgtgtttacagaaaaaagtcagtgatgcaatgaacagaacacaaacacctgtatttccccaactgtgatgtttaagatgcactttcaacttaactcctgctaaattttgttagtgaaaaatgccagaaaagaaccatttccacagtatgaatatatagcaggaagctggtcaaacaagatggaatcgtttaaaaaggcacacatccagtttcaggggagaaacagctttttaaacttcttcaccttgggccccataatcttgaaaatttttgctctctgacttctgcagatcactgcccagtgaaaaaacaatgccacacaccatctatcaagggaaacctctctaaaaaggttgaactttcctttagacatctcaaagaaaacacagttattatgaagtcttcccagaccaaccccagccaatgtatatttctgttacttggaatttgattttcacagaatttcagagatcaaaggaacattaacaatgaggaaacagaaggtcagataagttaaatgacttggcaaaaatgatgttgacttgttaagtggcatagtttaacaaggacccttgtttcttcacgggcagactgatgttcccacagtagaacactgggttgtcgtctaattttgtattatacaatacaaattgtctctctaataaaattatgaaattctcaaagaagctgtaacatttatttctcttgaaacttcaaggtggctctcctagttctgggaccataaaatactcaaataaatatttaccaaaataaagatctaaaggagtaaataaatgtgcacagcaatagatcttgacaaaatggcaaaaatccactcttccatattcaaaaaactcccccccaaactctaatatttgtttgtaagtctgtttacttatatttccagaaagattctcaaagaggacatcttttcttacttttttggtaagtatgggcttctctgactaccatcttaaaagaatatacttgataaagtattaagtaactccaggacatgagttacccatgagagatcacttgccaacaattaactgaaccacaatattccaaaaagagagatggctcttaatcaataaataaattctgggtctaattataatggcatgaaaatatttaagcaattataaactactcaatgttcagatagaaaattgactttattattgagctagaaatcaaatgataacacagaaaataacaatataaatgctaaccttgagtttttccaaaaaagcaactgttgtcaaggtcacaaacacactgagccaagtcttgttattcctttatcccatagctattgtactacttggtctgaaagtggatgtgctagacattttccatttgtcattttccatttgtctctccagaccttcactctgctcttctccatcctgttctaagcctggtcagctgacctccatgaacttcatcaaaggacccccttgcccttggacttttacatgggtttggccagtagaagccagtggctacaaatcaaaggaagaacagagaggccaagatatttattctacttcctcctccttgccagatcacattggttaagtttctcctctgcaatgaagaccacagctcatgtcagacagcctttccattacagctgctctctggtagttctctccattttccctgataggtcaagaagtagtaaaggctccctgacttctgcttcctgtaccatcccttgttagtttctcttactctgcccatacctttgtaactagtcccttcagtaaactcttcagttattccatttgagtattgacatggtttggctctgggtccccagccaaatctcctcttgaattataatccccatgtgtcaagacaggggcctggtggaaggtgattggattacaggggcagtttcccccatgctgttcttgtgatagcgggttctcacgagatctgatggttttaaaagtggcagtttcccctgcacgttctctctcctgccgccttgtgaggaagatgcctgcttcccttttgcctactgccatgattgttaactttcctgaggcctccacagccatgcagaactgtgagtcagttaaacctcttaccttcaaaaattacccagtttcaggtattctttacagcagtgtgaaaatggactaattcagagaattggtaccagcagagtggggtactgctataaagataacctgacaatgtggaagcatctttggaactgggtaacaggcaggggttggaaaagtttggaaggctcagaagaaaagaagatgtgggaaagttgtggacttcctaaagaattgttgaatggttttgaccaaaatgctgacagtgatatggacaatgaagtccaggctgaggtggtctcagatgaagatgagaaacttagtgggaactggagtgaaggtcactcatgctatgctttagcaaagagactggcggcattttgcctctgccttagagatctgtggagctttgaactcaaaagatgatttagggtatctggcagaagaaatttctaagcagaaaagcattcaagaggtgacctggcattttctgaaagcattcagtcagatgtattcacagagatggtttgagattggaacttatgtaaaggtttggaaaacttgcagcctggccctgtggtagaaaagaaaaacccattttctagggaggaattcaagctggctgaagaaatttgcataaaaaatgaggaacggaatgttaataccaagacaatggggaaaatgcctccaggccgtgtcagagatcttcgtggcagcccctcctatcacagacctggaaggctaggagagaaaaatggttttgtgggctaggcctggggccccactgctctgtgtggccctggggcgtgacaccctaagtctcagtcactccagctcaagccgaggctaaaaggggccaagatacagcttggggcattgctttaaagggtgcaagccccaagccttggcagccgacacatggtgttgggattgcaggtacgcagaagacaagagctgagctttgggagcctccacctagatttcagaggatgtatgaaaacacctggatgtccaggcaaaagtctgctgctggggcagagccctcatggagagcctctactagggcaatgcagagggaaaatgtggggtcagggtgcccacacagagtccccactggggcactgcctggtggggctgtgagaagagggccaatgtcctccagaccccagaatggtagatccactcacagcttgcaccatgtgcctggaaaagccaggggcactcgatgccagcctttgaaagcagccatggggactgtcccctacagatccacagggaaggagctgccaatgccctgggagctcacctcttccatcagcatgccctgggtgtgagacatggaatcagaggagaccattctggagctttaatgaattaaaaaaaaatttttttaacaagtaccctgccaggttttggacttgtatagggcctgtggcctctttggtttggccaatttctcccatttcgaatgggaacatttacccaatgcctgtgcccccactgtatcttagaactaactaacttgcttttgattttataggctcacaggtagaaaagacttgccttgtctcagatgagactttggacttggactcttgagctaatgctggaatgagttaaggctttgggggactattggaaaggcatgattggttttgaaatttgaaaaggacatgagatttgggaggggccaggggtggaataatatggtttggctctgtatccccacccaaatctcatttcgaattgtaatccccacatgttgaggcagggacctagtgggaggtgactggatcatgggggcagtttcccccatgctgttctcatgatagtgagggagtcctcatgagatctaatggttttaaaagtggaagcttcccctgcacattctctctctcctgccaccttgtgaaaaagatgcctgcttcccctttgccttctggcatgattgtaagtttcctgaggcctccgcagccatgtggaactgtgagtcaattaaacttcttttctttataaattacccagtctcacgtagtacctttatagcagtgtgaacatggactaatacaagtacatatatatacttgtattagtatatatatatatacaagtacatatatatatagtatatatatacaagtacatatatatagtatatatatatatacaagtacatatatatagtatatatatatatacaagtacatatatatagtatatatatatacaagtacatatatatagtatatatatatacaagtacatatatatatagtatatatatatacaagtacatatatatagtatatatatatacaagtacatatatatatagtatatatatatacaagtacatatatatagtatatatatatacaagtacatatatatatagtatatatatatacaagtacatatatatatagtatatatatatacaagtacatatatatatagtatatatatatacaagtacatatatatagtatatatacatatatacaagtacatatatatagtgtatatatatatatacaagtacatatatatacttgtattagtatatatatatatatatacaagtacatatatatacttgtattagtatatatatatatatatgcatatatatatatacatacctgtgtccagctaggactcagaatgatcctttgggatagaggtccttcctgtctcacattgccagttccacacgattttttgttggggagggaatggcaacctttggtcacttgtgttttggtgtcatatctaagaaggctttgcctgacccaaggatacagagatatatatatttctatagtttcttctcagagctttatagttatagcccttacatttaggtctatgatccattttgaactccttttcatgcatggtgtgagattagtcgaaattgctctttctacatgtagatatataattgccctagcaccatctgttgaaaagactactcctcattgaatggtattgacatttttgtcaaaaatcaatttaccatgaagggtttatttctagactctcaattctgttccactaatctatatgtctatccctatgctatgccattacattgtctctttttttttttttttgagatagagtttcactcttgttgcccaggctggagtgcaatggcatgatcttggttcactgcaacctctgcctccccagttcaagcaattctcctgcctcagcttcccgagtagctgggactacaggcacatgccaccatgcctggctaattttttttgtatttttatagcagacagggcttcaccatgttggccgggctggtctcaaactcctgacctcaagtgatcctcctgcctcggcctcccaaagtgctgggattataggcatgagccactgcacttggcccacattgaattgattactgtagctttgtagtaagttttgaaaccagaaagtataagtcttccagttttgttgttcttgtttaaaacaccttggctaatctgggcccttcacatttccatatcaaatttaggatcagctcgtcaatttctgcaaaaatgcccactgggattttgataggaattgcactaaatctatctactaatttagagagaatcaccaccttaaccacattaagtcttctaatccatgaagtttgaatgtttccatttatttaggtctttaattttactcagcaatgttttgtagttttcagtgtacaattctttcagttattcctgagtattcttttggtgtcattgtaagtggagttaatttcttaatctctttttcagagtgttcattatagtatatggaaatataattaatttttgtgaaatcaattggtcttgtattctgcaactttgatgaacacattagttgtagtaacttttttgtggaatccttaggattttctatatacagggtcacatcctctgtgaataaaggcagttttatcctctccggtctagatgtctttcatttatttcttgcctgactgtaccagctagaacttccattccagtgttgtataaaattgtgagagcacacatcctagccttgttcccaatctcaggaagaaagcattcacacttgccatttaaatatgttgctagctgcagctttttcatgaatccccttagttcaaagttcacttctacttctaatttgttgagaatttttattatgaatggtatttgattttgtaaagtgtttttctgtgtctaacgataattatgtgtgttttatcctttatttcactattttttgtgttatattcattgatttttgatgttaaatctttttggcataaatcccactggatcatggtatataatccattctatgtattgctaatattgctgatattttactgaagattttttcacctctattcatgatgttggtctgcagttttcttttcttgcaatgtcttcatctggcttggtataggacaatactggcttcgctgagtgagttgtacttcctcctctgttttccagaaaagtttgtgaaagattgctattatttattatttaaatgttgaatagaattcatgagagtagtcatctgggtatgagctttgtagaatgatttttagttactaattcaattgctttatttagtataactctattcagattctctatttcttcttgagttttagtagttatgtctttcaatgattttgcccatttcctctaagttgtctaatttaatgggataaagttgttcatagtattcccttataatccttttaatttctgcagggataggagcgatgtctcctctttcattcctgattttgataatttgtatcttcagtcttttttcttggtcagtctaaccaaagttttgcctatgttaattgtttccaataactaatttttagtttcattgattttctccattttctattttactgttttctactccaatacttatctcctttcttttctatttcctttaggtttaatttgttcttatttttctttttctgttctctttttattttctagtagagatgggggggtctcactatgttgtctaggctagtttcaaactcctggcctcaagtgattctctaactttgcctccctaagtgctgggattacatgagtgaaccatcacactctgcctttttttgttttttgttttaaggtagaaccttaagttgctgatttgaaacctctcttctattccagtacaggcatttctccttggtttcttgatgttagagtgtcagcatactctacaacttggtctttggacccttaatctttagctacactcactctgttatcatcttatctagtctcatggctttaaatataatctacatattgacagtgctcaggccagaccactccctctaaattttagttgcatatatctatccaactgccttttatcttagatgttagacagctctagtttaacaagccccaagttgaaatcctgctcccagccccctaacacaaattggcttcttcaccagtcttccgcatcttagttaacagcaacgctatccttaccattgctcaggacaaaatcctagggtcatcttttaactctatccttgactcattttctctcagaccatagatctaattcatcaggaaatcctattagatctacctgcaaaacatatacacattctagccactttactacctccactgcaaaccccctactccaagccaccatactccctcacctagattatagcctcataactaacctctctacttccatctttgccccctacagcttctctcaaaaaaatacagccagagaggattctgtaaaaatataaattgtatcacctcattcctctgcttaaaatttgccaactcagcctatgagaataatgtcaacccactttcaatagcccacaaagccctccaagatctggcctccagtgatccgtctgacttcatctcccacaactgtcactcttgcttactttgccttagccacactgtttcttgaacatacggcatgctcccacctaaaaaagtctgtccgctgactgtcttatttcctggaatactttttccccaatatttacatggcttatcttttctcaccctcaagactttgctcaggtatcatcatcttctccacaagactaactctggccacttccctttaaattacattcaacaccactatcagtacccccaacattcattaccctgctcatttttttcccgtagcacttatttaccttcaaatataatgtatactatacttcatatgtttattgcttattgcatatctgccccaaaagaatgcaagcccttttagggcagagacttttgtctgttttatttatggatgcatcccaagggactaggtatatgcattgcatatatcagatatctattaagtatttgttgaatgaataaatttagaaagcagaactctgctagctatcatcaattgaaatattagttatgccttaaaagttgaatttattcatgccttcattcattcaacaaatactgaatggcttctctttgccaggcactgcaacagacactggggatattcaagacagaagacagacaaggccctgttgacatggagcttacttactaattttctgtctctccttatagaatgtaaaaataaaaaatatatataattcttgtaataatatgtgttatagccagacatcatagctcgtgcctgtaattgcagctactcaggaggctgaggcacgaagatcacttgagcccaggagttggagttatgaccatacccctgcgctccagcctgaccgacacagtgagacgccatctctaaaaatgtaagtaaataaataaattgtgttacaaaaacaataggataaataggtaaacatgccaattattggggtagtgagctagggagtaccccttcaactagaataacaactacacttgatctgagatgtcaaaacgggatgaggaaaagccagtcatgcagaaacctggggtaaaaatacattccaggtagacaaaaagtataaagctttgggaggaagatggacgttggcaagtttaacaaacaaagccagtatgatttgaaggtagagtatgaggagaagatacagtgggatggcatcctgtggcatctgtccattgtagaggccctaaacccaccctgacatttgtagtaaattagatgcatcctggaatggtacttttatatcaccttctctctcctgtgctccctcctctcgtattcttttttctttcaagaataagagccaatggcatagacgagcagtatcattgctaagaaatctgaaaagactattctttagtccatctagtactcctgtgcaaacagaaaaagttgtgccttcctgagaacactttactgccacgtgttagaaaaatacgtaataaataagaatatcagcaactcactcataattgtgcaatgtcctatatgtagtatgtagcagccctggttgcagagatagagaaaagtagctctatgcaaaatatgcaaaccaaaatggttccattttttcctgtatgtcatataccaaatgctgcagatgctaaatatacatatagatttacatgcattgcaaattactactattctgcattagctacagttggctactgattctgatagcattttcatcatgagaaaaagaatgagtctttttgaatattagtcaatggagaaaatactgtgtttacaataaagtgatacagacttaagtggctgtaaccactaatgtacctttataaaagtggtaaaagtcttaaatacatccacaagtgttagaagtagtgatcatcagacagtctatctgaagaagatattaagacagtgttttctttggaatgcatttgcctatattacctcatgtaattcaaacattatttttattttgtagtttcctgattaagtttttaaaaataagtcaaaggatattttggtaaagtaacagattccaaaaaaaagcaaaaaaaaaaaaaaacccacattttcaagcttaatcccaaagatgaccatttgtttcatcatttaggctaaagttttctaatttaggaaagaaaaacgtgtgtctttgactttatgagaaataatctgtgatactgtgtacatctgtgatttctagatgaatagcattcgaatgccacttcaatatgattaaaattaataagcaactaataaaatccataaaggatagcttttcctgaaagtgtccaatgatggaagagtgccacctagtgttcaatgtggatttaacatatcctgcccaaaaagccatttcacaaagccatttcacaaagccatttcacaaataccctcaattttagccctgtagttattcattaaaccatagtaattttgcagagccctagtcaagtatcaaaatatgaattatgaattcctgaaaaaaatgtatatcacctatatccactagaaactgagtttttgaaaaggaagttaaatttctatagctacataaaagcaaaagaaagagttaactcaaaaaaaaaaaaaattttaaacatcgtgaccctaagtagtaggctagaaagaacatgaggttctaggctaaataggttcaaatttgggccctaccgctttctagcgtataatcttgggtattttaaaaaactgaggtttccttatgtgaaaagaatatacagtaggcattcaataagtgatagatattaactattaagaaaaagagatttcccattcttttttaaagaataagttaataagtttctttttttaaagaaaagtgagagcaagtttattaagaaagtaaaggaataaaagaatgcctactccataggaagagcagcctccttttgtttttaatatatcccctccagtcatcgggactttaggaaacattttaatgaaaggatagcttgtgccaggtcaacaatttcatttctctctaattccttgcataaaagaggacccaatctggggtgggggggttatcctttgcccagtcagccccaaataagtttaaagtttttaaatttattgatgaaattatcaaacagccactcttatggaatatgcgtgacattcagtgaattctcttccattgctttctaacatctaataaattcctttcgcttgctttctaacatctaacaaattacataacagtatcttaaacaattaaaaacaataatttaaaaaatgctattaaatcatttcaagaatatctttctcatgacatttttaaaaaaggtttaatccacaatgtatgtctatttagtgtgtgtgtgttgtgtgtgtaacagaacctctttttttaaaaccctggattcattttatcaagctccttacaaattttccaaaattaagtccctttttagcctaatcctttctttaaggctatagatttctcatttgtattagtaagaatgtaactgtataaaaggaacagtatctcaaaagctcagtgtattaattagaatagttttctaagcaagctattactgagggactacaagagtgagtaagaaataagccctacctccatggtgtctcatgcctgtaatcccagcactttgggaggccgaggcagatggattgcctgaggacaggagttcgagaccagcctggccaacatagtgacaccctgcctctactaaaactacaaaaacatagcggagtgtggtggtgggtgcctgtaatcccagctactcaggaggctgaggcaggagaatcacttgaacctggaaggtggaggttgcagtgacccaagatcgtgccaagaaagaaagaaagaagaaagaaaggaaggaaaggaaggaaaggaaggaaagaaaggaaagaaagggagaaaagaaagaaagaaagaaagaaagaaggaaggaaggaaggaaggaaggaaggaaggaaggaaggaaagagccctgctctcaaggagctcactctccttagtacattactgagtcccaactcagagagccagacagcaggatagagaggtattaataaattcccaatgcatgtctttgaaagtagatggatccattctccaccagcactgccttcccagaagactacagcctgtgcaaaacgcagaggggatcttgaagaaagcaggagtgatggggcagagatgcctctacttctgcttggccctggatgtttctctcttttgtctcctagattttggatgtctgtccctctccctctttattggtcctggatttctttctctccctctctctagcttcacgttgtatatctttctttcctagagaaatagaaggatattcaagaaaagagggaaaaaaagaaaaataaggcaaacataaaagagattaaaaatagagaagtgatgtgagcacttactgatatggtattaactaaataaactttgtaatttctttccttcgtttggaaattagaattacttcaatgtggaatagtcatatacacatacagacatgcacatcacatgtaaatgggatcatcacactgaggtagaagacatgtgggcctttcagtatgtcccaactagtttctttagctataaaatttgggaataagactagatcaatagttcaaaaacattttcctgtttccttttttctttcttttttttcttttttctttttcccctatttcttaacctatagtaagaaccacagtttccattgggaccaatacacacccacacccacatccacccacaaccacacacacacatgccctacaactggaataaaattctcaaaaacaattcttattctcaatatgtgaaatgtactgatatttttatacctttttttaaaagctgtctattacttacaatttagcgcctacaatccagtgatacatcataacctcaatttcataatcactgatgttaaccaaaatcaaaggtctctttcagatctaagactttatgacttgaatgaccagtgggtcaatgaagaaattaaaaagaaaattgcaaattttcttgatacaaacgataaaggaaacacaatatactattagttatggaatgctactagctagggaattcagtgaaagcagtattaagagggaaatttatagctctaagtgcctacattaaaaaaaaagagagaaaaacttcaaataaatagcctaatgatgaaccttagaaaattacaaaacctggagcaaactgaaaccaaaattagaggaaaagaaataataagatcatggcagaaataaatgaatttgaaatgaaaaaaaaatacaaaagatcaatgaaacaaaaagttggttccttgaaaagataaacacaattgataatcctttagtcagagtaagaaaaatagacagaaggcccaaacaaataaaatcagagatgaaaaaggaaacattacaaatgatactgcagaaattcaaaagatcattgatggctactatgagcaactatatgccaataaatttaaaaatctgtaaaaaatcaaaaacttcctacacacataaaacctaccaagattgaactgggaagaaatccaaaacatgaaaacaccaataatgagtaacaagatcaaagccataataaaaagtctctgagtaaagaaaagcccaggacctgatggcttcactgctgaattctaccaaacatataaagaactaataccaatcctattcaaactattccaaaaaatagaggaagaggtaatatttccaagctcattctatgagctcagtattaccctgataccaaaaccagacaacaacacatcaaaaaaaaaagaatgaaaaagaaaactacagaacaatatctctaatattgatgcagaaatcttcaaaaatgctagaaaactgaattcagtaacacgttaaaaatatcattcatcatgaccaagtgggatttatccctgagatgcagggatggtacaacacatgcaaatcaatcaatgtgatacatcatatcaacagaatgtagaacagaaaccatacaatcatttccattgatgccgaaaaagcatttgataaaattcaacatcccttcttgttaaaaacatcaaaaaattggatatagaaggaacatatacttcaacataataaaagccatatatgacagccccacagctagtatcacaatgaaaggggaaaaactgaaagcatttcctctcagatctggaacatgacaaggttatacactttcaccactgttattcaacataggaggtcctagctatggcaatcagatgagagaaagggcatccaaattggaaaggaagaagtcaaagaatctttgtttgcagatgatatgagcttacctttggaaaaacctaaagactccaccaaaagactcttagaactgataaatccagtaaagttgcaggatacaaaatcatacaaatatcagtagcatttctatatgccaacagtgaacaatctgaaaaaaaattttttaagttatcctatttacaatagtcatgaacaaaataaaatacataggaattaacaaaagaagtgaaagatttatacaatgaaaactttaaaacacagataaaagaaattgaaaaagccactaaaaaattgaaagattccatgtttatggaaagaatcaatattgttaaaatgtccatactacctaaagcaatctacagattcaatgcaatcactatcaaaatatcaatgatattcttcaaagagtagaaatagaaaaaacaatcctaaaatttataaaagactcagaatagccaaaaccatcctaagtaaaaagatgaaaactgaaaaaaatcacactatctgacttcaaattatactacagagctatagtaaccaaaacagcgtggtactggcataaaaacagacacatagatcaatggaacagaatagagaaccctgaaacaaatccatacatctacaatgaactcattttcaacaaagtttccaagaacatatattggagaagacagcctcttcaataaatggtactggaaaaactgggtatttatacacagaagaatggaacaagacccctttctctggtcatatacaaaaataaaatcaaaatggatttggattaaagacttaaatttaatacctctaactatgaaactactacaagaaaacattgaggaaaattcccaaggtattggtctgggcaaaaatttcttgaccaccaccacacaggcacaggcaaccaaagcaatcatggataaattggggcacatcaagttaaaaagcttctgcatagcacaggaaacaatcaacaaagtcaagagacaacccacagaataggacaaaatatttgcaaactaaccatctaacaagacattaataatcagaatacacaaggagctcaaacaactctacaggaaaaaaaatctaataatctgactaaaaattgggcaaaaaatctcaatatacgtttctcaaaagaagacaaccagtggcaaacagggatatgaaaagttgctcaatatcattgatcatgagaaaaatgcaaatcaaaactacaatgaggtatcacctcaccccattttaaaaaagttttatccaaaggacaggcagtaacaaatgctggcaaggatgtggagaaaagggaacactcatacactgttgttgggaatgtaaattagtacaaccactattgagaacagtttagagcttcttcaaaaaactaaaaatagagctactttataatccaacaatcccaccaccgggtctatacccaaaagaaatcagtacaacaaagagttatctgcactcccatgtttattgcagcactattgacaacagtcaaaatttggaagcaacctaagtgtccatctaaagaatggaaaaggaaaatatggtacatataccaaatgaagtactatccagccataaaaaaatgtgattctgtcatttgcaaaaacataatggaattaaaggtcattatgttaagtgaaataagccaggcacaaaaacattgcacgttctcccttacttgtgagatgtgaaaatcaaaacaattgaactcatggagatagagagtagaaggctgggaaaggtagtagggggttgtggagttgaggatggttaatgggtacaaaaaaaattgaaagagtgagtaagacctagtattcaatagcataacagggtgactatagtcaataataatttaattatacattttaaaataactagaagagtgtaacttgattgtttgttaacacaaagaataaatacttgaggaaatggataccaaattttccacaatatgtttattatgcattgcatgcctgtaccaaaatatctggtgtacatatttatatattaaagtattaaatatatacttatatatttataaatattatatatagtgggtatatataaatgtatacatatatatatacacacatacacacacctagtatactatgggtgtgtatatatgttttatatatatatatgtgtgtgcacatatctattatatataatagatataatatatataatacataatagatatattatattatataatagatatataattataaacataataatatataatgaatataatataaaataaatataataaaatatataatatatctattatgtattatatattatatatgtttatatataatataattatatatgtttatatataatataattatatatgtttatatataatataattatatattatatattatagatataatatataatatactatatattatagatataatatataatatactatatattatagatataatatataatatactatatattatagatataatatataatatactatatattatagatataatatataatatactatatattatagatataatatataatatatattatatattatagatataatatataatatattatatattatatctatatataatatattgtatattatatataatatattgtatattatatataatatattgtatattatatataatatattgtatattatattatatatattaaatatatattatacacacacacacacacacacacacacatatacctgctatgtacccataaaaattttaattttgtttaaaaaagactgatttcatgccacataagccttgtatgatctggtctcaggctacctctttatctcatctgcctcacctgcctctgccaccctctccctcaccttctctgctccagttacactggccttcttgctggttactaaataaaccaagcaggctcccacctcagggtctttggatgtactatttcctctacctagacagctctagggctaggattcccagggctctccacatcatcacttcattcaggtctccactcatatgtcagcaatgtaaggaggcttctctgaccagctaactaaataccaacttcttcactctctgtcttgtttgattttttttccataacacttatcaaaacctcaaattatactacatatttgtttattctgcatctccccagaaattttagctccataagggtgggactttgtcactgattgctcagaacagtgcctggcactcaagagaaacttaaaaataattgttgaatgaatgaagctagagctctctctcagaataaaagagtccactgtttttgacccataattctagatttttctctagaggtgaacagcccttgatcaaaactgtttgtccactcctggtctctaccaagtaactagcagggaaattcagtggaaagttaccttcctttcttctcaactgtcttttcagaggattatctttcttccttggatgtttgtgcctttctgctccctgatgatattgatatcttttctctgtaaatacaatacctacttccaaggacactatcaattagttaagaatcttaaatgcctttaaaaatagaaaacattctctaagtgtcaggcactatcgttaaaatggcagatttgcaaagcttttgtcaggtgctaaagtgaaaaaagaaggtgaagctggtagggggacagagagcaactggagttgttactttagaaaggtggacaaggaagtcctctctgatgaggtgtcatttgaacatacatctgaaaaaacgtgtaggagcatttcaggcaaatggaatagtaagtgcagctgaagtgtatgtaaaactggaaaaaaaaagatgtaaactttgaaaatgtatatctcagaaggctaaaccaaaaagaattgcttaaaaattatatgaataagaactacctcaaataattctgaatagtcaccaactctgtgtatcttgtgtcctctcaaaactcacccaaagggacatctgggtcaatgaacaaaaatgtttaaaagaaagtggggtagggggcagcatctgtgaagcacttaattgtacaggacactaggctgaaccctgaagaatgaaccacaatgacggagtttcctacttcatttccaaatgcgttccagtaactttagggaatcaatgttgacattaatatgcataagtttaattttggatttatacatattcacatgttaaagaaaacctgaagctcagtgaatgaaaaattgcagagaaaaagcagtaaagtcaactaatcttgtttttaattagcgttctttcagtcattagcctctcttctgtgttcccacattcagtaggtctctatcttaacacttggaaataacaacagcagtagtaacagtaataacagcaaacattttttggatgcttacagtgtataaagcattgggctaaacagtttatcatttaattataataatatccctataagggaactagtattattattattattattatcctcattttacaaatgaagaaattgaatttctctaagttagtattacaatgttacagtgtatcatgtatttctcttcttctcttttttcttcctccaagactgtgagctttttaaaaaagaaatctagtcttgttcatctttgtatctcatatatatagcatgttgcaagaacccaaaagtgggcagaaagatgagttcaagagcctctgctctatatctgaatataaatgcttattatgtcaagtttgattctagaagtgttctaataatgcatgccacaacctaggtgttaagggtattgggagacaagataaaatcatcaggccaatactaatttttatgtggaaatgctagaaaaagtgatcataatattatagaagccattcattctttgcataaaaacttgaacatttttaattatgaaaaatattcagatatctaagatagacagatattcaccttttagagatctcagtgcatgcagtaaaatccaataaggtacctaaaaggcaatatggtttaacataaatgataaaactgtacttgccactagatgaagggattttcagtttttccagagccgaatttctgagtctaagtggcaagaaacagactgggtctgaacggtctcattgtactttcacagtcaaattactgaataataaaatctcacatgaccagcaataaaagtaaatgttcccagctaatccatttaaattgagtagatattcagggatctcacacctaatacctgctaaatacatatcacacatgtttagctgcccctatccacaaaagtatatgaccattattgaaactggtctcaagaccaatctctgccatttccctcccttttaccagctttttcttatttccattaggaaaatgaatctataagagaaatttaggaagagggaatttaatatataaaagtaaatttttcaatagccacaaaattgcataacaccattaacctcaaatatttatttttgaaggttgatattttaatctcttccattttcctcaactatcttctcattaggcagcaatctggttaatatgaaaataacacatttcatatgtatattacagtttataaattactttcatattaacttatttgatcttcacaaaaaatgctttaaggtaatctaaacagaaagtattattttgattttatggatgagaaaataactatccaaaaagattacataacacacagctcataagtgcttaagccaggactggaataaagactgaaattttagatttctagctctacatcagtttgtttgtacttcaacaagctacatcttgaaaataagtacacaagagaggactggaaaatctgtctacaaataatagttaaaaaaaggccaacttaatattcttcactacagtcagacaataaaccttgaattttaacaatttataatagatgtaaaacaataattacaaagaaatattgtaggtaagtattaacagtgcctttcatctatagaacatacagtaatttatatttctctcaatattctgagcaaagcaggtgacagttttattaaaagttcaaatctattgttagacatatgtatgtaatgtatagaaataccagtttagagtttagaagaaacaggcaccatggtatactgctagcagagtattcactggcaaaactattttgggagtagtctggcaatgtatattgaaagcctaaaaatgcacatgacctctcgcacctagttatttcctttttaatttattgtaaggaaataattatggatgtctataaaaatgtgttcgcaaaaatatgttagtattgtgttaacagaacaaattaataaatggattggttaaatcagagtaaatgaaagaataaaacgtagagctgtccctcagtatttgcaggggattggttccaggactcctacagataccagaatccttagacgctcaagtcccttacatacaatgatatagcatttgcatataacctatgcatatcctccagtatattttaattcatctctaaattacttacaacacgtaatacaatgcaaatgctatgtaaatacttgttatagtgctttgtttttatttgtattttttatcattgtattgttatttttttttttcaaatattttcaatcctcaattggttgaatctggatgcagaacccatggctacccagggctggctgtagttcttaaaactgatctggaaaaatgcaaaagatatattaagtgggataaaacagatttctaaacaatgaatataatagaatcatattttaaaggatatgtatctctgtgtgtgtgtgtatatatgtatgagtatatatgtgaccaggatattacacaaaaatattaatagcgattgtatacaggcagtgttattatagataaatgtaattttattacttttacttttatattttctcatttctaaaaatgactaagtaattttcctatatttctacaacagaataagttaaatatctttataaacatatataaaacatatatagcatatatatgtatcatgtaaatattgaaactatggaaaacaaaggataaaagttgaatttacatctatcagagagctctagagccattatgtgtgcatatgaagatacattttaaagagtatagaaatatgaagaaggcacagcacataagatgagtcaggagagagaacaacagcaacttattaaggcaaagtgtccagtatcagaaaataaatgtgaattaagcagtacattttaatagctacagtttctcacatctaattaacagaaagttttaaatattgacaactttggaagtgaagaagtttaggcagtttttgaaaaaaatgtgaatacaaagttcattgggaatgctggagatacttctggaaagtaagatacttcaatcatatgctatagcagcatcaagaaaggtactaggtgaagatcacagcagcaaacataactcccatgttgaaactataatgcatacccatctggaatatgtagctctgctcgccacaccttagagtagatattatagaaacaaaaaataagtccagaaatgggaaaataaattatgaaatggcaactataagggatgaaattaggagtctctgaagttcaaagacaaaagaagctcagaaaaatatttcccaaagcttataagatcataaattttacagataagataaaaataagcaccaagagaccaaattaatatggcaaaagtttaaggcaaatccaaggaaaataaaatattttgatggaataggtaaaatatataagatgtataatactactgcatttagaataaaatccaaaatccctcccaagttccataagtctcagtattcctggctccttcctgcctctcagatctcttctcctccagctgtcctctcattccctaggccccagccacactatctccctcctgttcctctaatgcacctctgtgctcactattgactctgcctggaatgctcttctcctaggtttcacctggcaagctgctttctatcattgacatctcagcttaaaagtcacatcctcatgaggaccgtccctgattgtcctactcaaggctacttgctcttggaaccaaccaatattgcattacttagtttaattttcctcatagtacttatcatcatatgaggtcatcattcgtttatttattcatgtaaactgtttttctctcaaactaaggaaaaaaacaattaaagagttttatcatcaaagagactttccctcaccaccccaggctagttcagatcactctattttattactaacttccacctcaccttgtcatttttcttttgtaatccaacttatacttgtaatttattttccaatatctgtttttctccataaattccatgagttaggggccactgtgtgctatcttattaatcaatgtatacccaccagttaccagtatatggaaagtactcaataaatactttctcgaatagaagaataactggtgaatgagaaagaattgggaataaaaaggcagaaaaaggaaagcaaaaataaataaaaagctacatgaaaaaaattatggcattatattaaccacttactattccgttctccaaataccactgtttcctactaaacaagaatataacaggctctaaactgcatttgtaatacaatatataggaaaataaacttttaagagtttcatatctgcaatttatgccctgtgctttctgattcactttttgtaaataaaatcctgtggatctttggaactgcaattcttccaaatcagcaattcaagtaacaaaaggaattctggatgactaaaaagcagatgctgtctgggtgccaagcttcatgcctataatcccagcagtttggaaggccgaggcaggcggatgacctgagatcaggagtttgagactagcctggccaaaatggcgaaaccccgtctctactaaaaatacaaaagttagccaggcgtggtggcatgcgccagtagtcccagctactcgggaggctggggcacaagaattgcttgaacccaggaggcagaggttgcagtgagtggaaatcgcgccactgcactccacagccgggtcgacagaacaaaactctgtctaaaaaaaaaaaaaggcaggtgctaaaaacaaaaccagaaaagctattaggagaaacgtcataaagttggaaactgaaaagcatttcatttcatggaataaaattttgttcttcagtaattatgaaactgtctttgaaaactctgttaaaaacaactttgactcatgcctgtaatcccagcacttggggaagccgaggcaagtggatcacttgaggtcaggagctcgagaccagcctggccaacatggtgaaaccctgtctccactaaaaacacaaaaattagccaggcatggtggcacatgcctgtaatccaagttactcacaaggtggaggcaggagaatcgcttgaacccaggaggcagaggttgcagtgacccgagatcacaccactgcactccagccagggtgatagagtgagactgtgtctcaaaaataaataaatacataaacaaacaaacaactttgagacattttacttcaaaggtttagattagttcttatggaacatagctaataatctttaaagtcctttattacactaacagttcatctggagtaatgatattctaataaatgctatattttagaagatacataatattaatatctttgtcaaatatatcttagaattaccttctctgtcctctttataatatgtaaaagaaattgatgagtccagcatacgcttcatcttaaatgaggtgtatgagaaacatgctaaactatggttccctatctctgcttcacaatataaaggtgattccagaatttggaagcctcaactataacaaactagatgaagacagaagctgattagataaactgcagtggtcaggaagcctcaccaacagagcaaacaacctccatcttcagctgcttattgagaggccataatcctttgctgcaatacatacaacagtggctagactgaacacagagaagggacatctgtttcttaggcctgttctttctcataaatgattgatggcaaatatggaggagagtgatctggatgcacaaagaaacttgaaaattttactctagccaattttaggctttcgttaattcaaagctgtatctgccatacaacaagaacattttcactagatcaaaagaggaataagaatatctgcaggccttgagatttcaactattttgccttttaaactatatattagctgaacgtggtggctaacataaacataatcccaacactttgagaggccaaggtgggaggatcacttgagcccaggggtccaagaccaggctgggcagcatagtgagaccctgtctctgaaaaaaaaaaaaaattagctgggcatcatggcacacacctattatcctagctgctcggaaggctgaggctggaggatcacttgaacttgggaggttgaggctgcagtgagccatgatctcaccactacattcctgctgggtgacagggcaatatcctgtctcaaaaaaaataaataaataaaaataaaataataagataaaacaaataaagtatatattattcaaagtaccctgtgtcttgaactttgtggatcaggactcacagtaagaaatatattttacatcagaatccagtacacatccaatacatatacaattaaacaaaagttcatgaacgttacccttacaacatgtagtgaatatgttaagttgctattttatgtcatctttttaatgctggctacataccacaaatttgagtaatgagtcatcaggtacagtttgagaaacactgctgtacgtatacgtgtggtctggcctctgcctacctccctaaccacatttcatggtattttgcaccatattttccctactgcagccacccctgcaccatcccaccacccagtttctattattttattacattgaaccataagttcctaaaatataccaatctcttttctgcctcagggtatttgatcttgttgttagcgtggcctggactcctccagatcactgcactttgtattatattatgcaggtctcaatataaaagttctttccacagagaggccttcattgaccacctaatttgaaagagccccagcctgcaatcccggcaggaggagtgggaacaggagttcattcattgcccttagcattcctgggaagtttgataacataatgtaagacaggcaaaaaccaaaaacagtattgagcaaatgtcactttctacctccctatgccattgcacaggtcatagaattctaactattgaaattctattccattttcttcatgacaacttttctgactctgactgagaagcagggactcaattgtacaatttgccccctattactttgtattctctcagaccacttagcgcattctttcttattttgtattcattccgcaaacatttgagtgcctaatatgatctaggcaatactgtgaacaacataagcatgaattcctccaacagttcacattttagtaagagtgacagatctataaacaaataatttcaaccgaatgaggcaagtacaataggagagatgtatactacataaaatggtgacaaaaagaatgaacaatcaacctctttttctttttttcttgatttcacagtgtggaggggaaagctctgaatatctgcatagattttaaatttgtatttatttatacttttttagagacaaggtctcgctatgttgctcaggctggccttgaactcttggcctcaagcaatcctctgacctcagcctcttcaatagctgggactacacacatatgccaccgcacctgactcgactcaaccctctttgagtagggaaggaaggcatcacagaaaagacacctacactgggtctggaagtgaatccacctttgcaaaaattataacagtgagagaaatctaacctaactgactccatattgcttctaacctcacaaagctaactgcccttgctcatacctgggcataggcaagctaactatgggagaaatttatagtttaactttgaagcaaggatggtaatagtcccttccaaaactgaccccctctagggactaaaacagccttgtaagactaatagaaggccgcaaggttaggactatgggagggacctaaaatctgctaaaatataggcataggtaagcaataaccagctactgttccttgcttttctataatttcttactattcagaagtcatgtagccagaggtcacaagatttgtaacttcaccaattgctcctttagataacatcactattgtaaaacctaagattggtcttgagatattttccaggcttctgcattctggcaaacctcctgatgccacccagatacatgcctcataccaagaaactgactctactagtcctatgactctcacctagacaactgactcagcacaggaagacagtttggaaacacctataaattcatccccaaccaatcagcagcgcccattccctaccaacctgcccacaaaattatccttgaaaaccacaacttccaagctgtcagggaggcggattttagaaatatttcccatccttccactcaactgccttgcctccattaaactctttctctgctgcaactcctgcattctcaatgtttggcctttctgggaagtgggcaagaagaacacgttggcctgtaataggagaataaataagtttggcaagcaacaagagggtgcaagtattctgtgtagaaggaattgcaagtgcaaagtagaaagaggaggcatactaccagtttgaagttgcttggtatgttcaatgaaaagcaagtagctaaaaggcaagagaattttttttttttaagtatggaaagggaaaggcaaaagctagacagaaaagtgcttgttcatggaggaacttgtgtgccattctagacattttactgtaggaaatagggaatctagagttttaaggaggtgagtaaatcaacaggttgggtttttaaaaattccttcttgtggcagagaaaataatggattggagaatttccagaccagactgtaaaagtcactattaaaataatcacgaaatgaggagatgacaaactaaaatttgatctagtgaacaactgaatatgggagaaatagaagagggaggaatgtaggataactctgatttctagtttaggttataatatagtagtagcattatttaacttggtgaaaataggagaaaccaggaggaaagatagcaagttcagttttggtcatattaagtttgaaggacatttgagacagatgtgtccgggaagcaactgagttaggcattagtagatctgagaggaaaattgaaatttagaagcaaaatcaaaggtgttagtagaatccatgtgagtggacaaaatcacccaaggaaaatgtctagactaagaaatgaaagtaatcaaggagttaattccaaagaatgacattcaaaaaccaggcacagccagtaaaaggaattaatgactatgaacctcagttgtcacaaagagactaagtaatgtaaattttgagaagtaattactgtatttggtatttaaaaggccattagaaacttaagcaagaacaactttcttgaagccattaaagaagccagacagaagacttttgtctgtttgatataagtaaaaataatatcctttcaagaagtttactgatagataggaggactaggaaataactggataaacacaggatggaggacatggttttgctttatttaattttcataagatgtgtgacttgagcactgaagagaagaaactggagaggaaaaggctgaacgcacaggaaagaaaaaaacaactggaagcgaaatgtaacagatggaagcaaatgagatcaagagcaaagatggatggattatcctttaatatccctttctctacactagaaatacaagactaaaggctcggcaaaaatatagagcaatgtgtaggttgggggcatgaggttgaagaaatggcctgttatactccatcatgtttagaaaggagaaatgaagagggcaaaagacagggtttgtaaagggaaggtttgaaaatgtcttcacagagaatgggtcaggggaaaactggggtaaccaaaaggattgctgagtagtatgaagaaacaaggggtggtgggtgagggctctgtttctaaattcatagctataactatctaaagatctttctatcctccagtccgttatccataagtgcttaaaagatatggtagttaagtgaattaactagaaccctctcaaacataggggtgaattaaaataacctataggcttatttaaaatgcaaataccgagctccattcctttcattcagaatttccaggggtgaagcccaaacagtgaattccagaagctctccaagcaatcccaggagaaatttctgtttaaaaaaaaaagaagaagaaagaaaagaaaagagaaaagaaaagcaagcacagacctagaaggtaaccaactggatagaagagcgctgatccaacatacacctgttaatggccctcgtgggggcgtggggcagtgctctgccactcagaaaagcaaaaagactccaagatctagggagattcagatcagtgttgagacagtcacatacacaccaccccatactcttaataaagcgcgttaatgtgaatctgtgaacatgaaaaatgccatgatgaacaatgcaaacacataatgtttgttcaaaacaggttattagactcgatgccttaccctaaattttctgtttcattactctagagacttagtaacattagtggaattcagggtgctgtaagaaatacggagagcgaggagactgcaggaacagcccgtgggaagggggaaagagataacggggagaaggtcgggaggaccggacaactttaagtgcccatccgcccgaagacttggaaagctaagtaagtaggaccccagagccgttcttctggcatcccctggcactcaccattgtctcaggatctcagcactagaaaataggtatcgttgagacaggaagacaccaccaccaccaccatcatacggttactcaggcaacaaagccccgcccactgtcgcacgaggcgtgggacgccaccgccccacctcttcgtccttagtggctgggagtaatctcagctgcgttcatccaatcgacagacccgcccctccacgctgtcgcctggggctacgagacgccattattctgtttccggcagttttacttccgtttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggtaaatccgaggacaagcaggtataactaaggatgttggaaagggacggaggtctggctggagctcggtggccagtagctttggatttagggaaagattgttccgggaagactttttcagacagggatgaaacttaggtttcgacttccccggacagcaaagttgacaggcttgtcgcttcccggcctatcgctttcatacctgctcactccccctacttacttcttcaccccctccgcttcatttggcatttgccagcaggcactcgctgtgcctgtacgtttcgcagagcagctatcaagggcagtttcagggatcgttactcttacgaagggttttttggatacctcttttcggagcagtagagtgtaagtgtagaaaagtttgtgactgttaagaaagttagtcgtcgggttcactaattgaactgagttgtatctagtactgagaacgatctttttttgtagtgaaaccagttgtcatctagtgtacagtttgtcatatttatatcattgcagtagcatcaccttcttatatgttctctggtaaatctgagtctgtactgtaagacaatgtatacatttctgaaagcatgggctcgatatgtttctctttttacttttggagctacactattttaattttaactttttattaccaaaaaagtataaattatgttatcttgagtaatattttttgtcgtttgttaaacatctaaacagaagctcctttttgatatgtgtgtgtgtgtatacaaattgtgtcggtatgtctcctaagaaagtaattactttaaaattcctcttgtcatatggatgacaaaaccaccacagtaacttcattccctttgcttggctaaaattcaggacatacttctgacaatttagagtgtattggtgaggatggtgaaacggagtatttagaagtaaaccacccctaatttttttttttgagacttttagtagacataacaatgccttctgtgagaatgggatataagggacatttctctttctaaatgcatgcgtactaaatacagaagcaattaaaatatcataacttttaaattggaggtactctatgtgtttatatgatatttttaaaattatttcatatgcatacatttctaggttgttcagcagaagtcttggagtgcattttcagtggttaaggtgaaaaaatgactactaaaaatttagaaaccaaaggtaagtggcttttttataattgtttttaaaacatgacatttatgacgatgtgaaggaacgtttgagccagataactagatctcatggacccccttgggaatcatttgttatttcagatccctttatgtttattttttagtgcagtgtttatatttcagtactttagatgtacaagtgaaatttaacatcattagttagaatttattaggtgactactcttaaacatttaatgttaatgcaaagtttttaacagctatattccctatacactagaagattacgatttaaataagaatacacattttaaagatttaagtagatagacaaagcaactagggtgtatcaaagatctctttcatgttgtattagtttgctggggttgctgtaacaaagtaccacaaactgcatggcttgaacaacaaaatgtattctctcagttctggaggctagaagtccaagatgaaaatgtcaacaaggctgtgctccttcggaaggcattagagacactctcctagcttccagtggcttgctggcagtctttggtgctccttgtcttgtagacgtaccacccttatctccgccttcatattcacatggcattctccctatgtgcatgtttctgtgtctaaatttaccctttttataaagacagcagtcatattgaaaaaaggaacccagtctactcctgtatgatttcatcttaactaattacatctgcagtgatcctgtttccaaatgaagtctcattctgaggtagtggggggttagtacttcaacaaataaagatttgggggacacaattcaacccctaaattgctaaatacagtagtcactttttagtcctagctgatttgtcctctctaatatttaatactgttgaccattccctgccttttgagatacgttcttttgatgacttccatgacatcacttttattttcagtctactctgtagcctttcactgtccaatgcggtaattacatgtggctatttgaatttaaattaatattttttaaaaattaaaaattcagtttctcaatgacgcttgccaaacttcaagtggtcggtaggcaaatatggcgagtagctatttcaatcattgaagaaaattctgttggacagccctgctgtagctgtatcttctctctttctttttcagcctcttctccttcttatttatcttttaaatatcaacactttccaccactgtttcttttctactctcatgacttcagtaattatctatataaatgacttccaaatctatctatatccctaatctccttctttatgattcatacccttatagactactgcctactggccatcttcacatagctgtaggcaacaattttaacatgtcccatagtgaacttctcctgacccagcttattctttggatgggttgagttctgcatgctagaaccatcagttaaagatggaaaactgttttctagatgccaatttttcagcaaactgacctccagccacaaaccctctctaaaagcaggttgaaataagtttaagaaacaaggaagaaagatcatgctaataaatatttaattgaatttaattcagctttgcaacagcatttcataagtcaccagaaggcttttataccattagataagcaagtcagagactgtaatgaaagtaataaactggggattaatgggaaataagagcagttaaataattaatgtgaaagcaaccaacatggtgcttgtcaaaaagcaaaaactaaatacaatattatgattagtcattagaagtactggcaagttctctgtgaaattaaattactttttaatatttattattacttgtttttaatgaggattagagttataaggcactttaacaaacattattttgtgtgatcttaattatccagtaaggaaaataattctattagccatatttctatttaatctgtcatctgatgttagtgaacaaaagttacttgtattgcatggcctgtgaaaaggtgtacttggttgacatttgtcagttgtctgtgcttcctgtaactgcctcaggagataagtacggttgtttggtatagcaacagaacttcctctcagaagacatttgagcagcactgtcatcataagagggttgtatcatggctgctagtgctgtttctgaaagggaaacatacagtaaatagtaacaattagaaacttaaaatccaaagcttttcttggatgtgggattaaaattgaaaataaagctattaaagtcaactagtttagtaatagtagaccaaatagaaaggtctgagacatttaaatatttttgattccataaaatagtctaacactagttctgtagaataataggtgttaggtaaaaaagatattccatgagcagataaatttgataaatgctgtattaaaagagaggctatactatgggacctctcagagtcctatagtataactttaatactaatgtacattgaaactctgtagagatgcagtatgcaacattgcccacacttatttgaccagggatctctatccatagagcctgtggtaagaagaatgcttagattccacttcagtaaatctcgatgttactcttaagtccattgtatgtaacttattttactaatttaataataactaaactttattaggtgatatgggtgacatttaaaaagactcttgatttaaaattaccacatgacaatccctaatttgtttaactgtatcatagctgaatttgtatatgttctggaaagtctttcagactataaccaagttaggaattaatgatttagggtagaggaaaaaaaataaagcagtttttaaatgggttagtttttggatgttaaaaatgaaacactctaggtagtgtattaacagactaatgagcttcagtaagcatttattcattttctctgtgacaaggaccattttattagttcatgacacaaagattaggaggcggtccataccctgaagagctcccaacagtctagtctacaagagaaacaaattatttttaaaatatatactaccatgtttgcattactctgaaagcaccaagggatgggaggaggatgaggttaagtgctttgtccaaggtcacacaatacatggcagtagggacttaagttattttaactcaggctctagtgagttagatttcttttcactaccccattctgctgacttagagtacctctcatcatagattgaagttttatgaataaaagagaaatatttgttcaatgacagacaataaatttttttttgcctcaatattctagagcaagggttggcaaattgtggccctcagcctcctgagaatatctgcaatcagtttgataatagtggacattaacactatttaagccaaacattatcctgaattaaaaaaaaatctgttcttcccattattagacctatgttatcaaaaaattgttttcaattattgttgttatagtttgaatttcatcaataaattttttttctcttattaaatacttacatggtatcctcaattttaccttttggttcacaaagcctaaaatatttactctctggtcctttacagaaaaagtttgccagctcccatcctagaatgttagactagtgaccttctttgttctttccctacatttcaccaatcctggtaggcaatacgaatgagcaaaccttagatatgttttaattcattgataattgatcacaggtggaagtaatgatgatgaataatttaaggattgttttgttggttcccttcaaatagtggggaagaataaggattggtgtttttcttgacttaagcgttactcataattatggagctgttaccataggtccttgtcttcccaattgagagaaggtaattattcgtaaatgtgtcctggattgtgcctactgcatatgtaataaaggtttctaggtatgtcacaaggaaaaatcgaattacgaaagttaccaggtgagaaaatgttaagccctggctcttacggcctgtttacctatgcacattagctagaatcatagttattactgagcgggagctctcacgtaatatataatacaactttgatattcataaatgcttgagtaagtagaacagtttaaataaagttaagagtaaattggggtggaaacaagttggttgaacttcttgattttccaacaaggtattttgttcaaaaagagatttctgttaaatacctattaatggttctttgccttttaaatttaactttaatcattttgtaatttgttcttgaatctctgttacttaaaattccaactcaaaaatgttacagcttgcctagaaattttatttgaccataatggaagtatcacacctgttttttatttcctcagcctcagtgggcctgaaccatggctgtagtgcgtgtttttattgttgatggtttttattaatttatagttaatacatgattctgtgttacttcttaaatgccagaatgtcttattgacaagattagacaagttagttaagtttagacaaacttaaaatcagattttaagaatacaggtagctgggtgtgatggctcacatctgtaatccaagcactttgggaggctgaggccagagaattgcttgagcctaggatttcaagaccattctggacaacatgatgaaaccctgtctctacaaaaaaaaaaaaaaatacaaaaaaaatacaaaaaattatttggtcatggtggcacatgcctgtagtcccatctacttgggaggctgaggtgggaggatcacctgagcccaggaagtcaaggctgcagtaagctgtttttaaatgattcagtggaagttctccttgtcagtgctaccatgctttgttttaactaatttaccaaacccagcatgttaggcctttatttcactttctgaagtattcctttgtttatctttttaaaagtagagtcaatcccaaggcccaaggggtgtttaaacttagtttacatttcatatggaaatgacacgattttattctaatgtaaaatgttttgtaaaatagaacacattaattatacctcagctatgtttccacctcctgtctaattaacataactcgaggttcccagaacatttctacatgggaaaaatttgaaaaaagtaaatctgttacttgaataaatagtcctatagtctagcaatataactttaagatttacataacagaatgaaagtcagaattgtattttatggcattaaataaattaactttatttctgtctatatcaacatccaaagtttattaggaatttatttaaagaataataaaagcaataggacctaacatttaatgagtgcttactgtgtcaaataccattctaaacagtttacatgtattcttatttatttttaagtacaatataaatcataggtattgagcatgcaaataaataaatagtaaggatattaggcatagatccacagatacactggtagagtgattttcgaaggcatttcggccgtacagatcttcaccaaacccattaattttatgcttgggaatttatttgaaaaaataactcagaagttaagaaaaatatgtaggcataaaagtgttcaataaagccttatttattatagtgaaaaattgtaaagagtctaaatattcaacagtagaataagaaagtaaatgctatattaacttgaagggaatatattctagccataaaataaaaaatatgttaagcttacgaaatttattactgttacaagtataaaaggaattctgttttaagtctttgttttaggagattacattacacacacacatatatatataaaacatatatataaaaaacatatatacatataaaacatatatatataaaacatatatatatatatatatatatatatatatatatatatggtctggctggacagtgatgaattcactgaagaccaatcagtagttcatgattgtccttaatgtttctatagacataaaatttctattgaaatatttttataccacttacctgcacacttattatatattatcctgtaatacattttatctttttatatgtatgttctgtcccctaaattaggtagtaaatttcttaagcatagtggtcttacctcatagaatgtctagccttcattaggtacccagcatcatgtttgctgcccgtgaccactcagagttcatcattataaccattgttactgatctgtgtgctcgtcttttgtccctccccttgttatcattcatttattgtttataacatatatacatatatatatatatacacacacactacatgcaaggcattttattgggaatacagtgcactcaaaataaattgaaagccactagagggaatgagagaacaataaaagaatttgggtatgatatggtgaaagtgaggtataaggatgtttaatctgacaatccagtgtagtttcacttgtgtaagcaggacataaactgttaggcctaagaataggattgaatcttttcttaataaatttttcggtgtaacatatatgttgcttcctcttactccaagagttcacaaaacagatgaatctcttatgatgtagatggtttcaaatatgcatctatatagctgacatttattttaactaacattattgagtgtctacagtatgccaagcatttcatcttattacattttttcttaccaaaattctatagcaaagttgttatgatctccgttttgcaaattaggaaatagagattcatggaagattaaattatttacccagggttatactagaaagtaaaagtcagaaccaaatattctgattccaaatctcttgtctactgaaggaaagtttaaacatgtatcttttgttgacacatgattgttttgaaaattactttttctctgattttttttttgcattctttttagtgccagtaattttgaatatagggtatagcatgtattagcattttcttggcatttcttcttggtaagtagtttctgttttgtttcctttttgttagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataacttactgtgtcttcattgtaaatgaaaaaaatctgtagcccttaagtgtgttgctttaatctttgcatcttagtaaaaattgccttgccccttcccttgtttctctattagaccatgcatcttttggctagatacaagtcttcataagtgagaccatggttagtgtttttatacaaatatatttttaaataactaatttctcattacaaaatgtagtacaaatttatgtgtaaaaattttagaaaatacagaaaaacacaatgaaaatagtgccacctgaatcatttcatccagctatacgtgcataaccatatacattgagttcatttagtgtcacaacccacttttttcagttattaatgttctgccatgtcacagaatattctattacagtgtcattgttaatagtaacagtgttcttcaatagctataccatataccaataactgttattggatatcttttaattttttgctcttttcagtaatgatgtaaagaacatacttagaaacatactggattactttgctttattttttaaaagtaaattcttaggatgcaatac

SEQ ID NO: 533 - DNA, 38319 bp, Homo sapiens
ccggagagggaggagaagggggaggttaaaggggaaggacccccggaagtgccccctcctcagtgcgggagagggagacgccgggggcggagtcccctgcctcccgcggcgtggttggtgcgtcccatgtgacgtcagaagcagcccgcccctgcctggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggtaaatcttggacaatcccatattgagccgcccacagatgaatctcttggctgcctccttctcactggcagcacgctcccttcatccccccgactcccgtccctcttttaacttcatcccagcctccactagccaggcacttttgtttccctttgtctttgctccccactccagagatgcttccggagctgcacaaatgtggatactattcctttgtccactgtccttgctgagttctcccaatccctctcccacccccatcctggtggggacccaggactcctccgtgaccccaactttccctctgtcaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggtgagatccccatctcatccctcacctgggctccccagtgtttccccgagttctttttctgggcccccaagtcttctctgaatccctctaccatcatgaataattcttccttttctttcatcccacacatttatagattgtctagactctagattataggaaaaacaggtttttggattaggcacacctgagtgtgaatttacttagctttgcagttactaattgtgatgtcttgggcacattaatctgtctgagcctcagttttctcatctgaacaatgatcacaatatttgtctcatgtagtgttgtaagaattagtaagcattcaataaattgtagctattgtgaggatgtgtttggctaactgtgctaggtagccactgaaaacacttagcagggttattacacatggtcccttaccacagggcatattgtctgacagggaggagactccctggagcatttacacctgggatacatattagagtgggctggatggtggtcacacacatccatccagcctacaaggcaggctccggtaatcagagctgctgtgaatacttgtacaggacgggtactaaataagggagctcagctgagtgggcaagtgggggctaaagtccagctcatgctctgacaaactctgggccttggcacaaagctgctttgcctagagaaaggcacacctttttctaatatgcataaaggtgccagatgggctagtggcccagtataatgggagtaagtgaccagtggctttgcagcaagagttacagaacttcagagaggagagtgagctctatgggctgggggcccaaagaaagcctccaggagaattgtaggtgagtgggaccagtgggggcaaatgagtcttgggggctggggttccaggttgagcagaggtagtgcaagacttgtgttctgcagcctccccctgcaatgggtgggtagacagggttgggagccagatggtccctcccattcctcccccaaactctgggctgaacaactgaagagtaggcaggaggaagtgccccccgcaagggttcaggacacgttctgggcctccaaggattctgtatcacctcaccccctccatatctgtacccactccctctgcatgttgctcaatgcagcctcatattccctctcctgggcttcctgacatcctacccctcttggatgtcactacgcccaggctcatggactctgagcccttgtccacgccctactcctctctctgatcacgagcctcctggactctcatacttccccccactcctggaagtgactctcctctgttatctttctttttggctctctctgactccttgacccccatctctgatttccatctttccaactattcagaatctccacttccctcaccctttcaagtatctctaatgggcctaatggccctataacctccttatttctgaaactccacaaacactgtttccttctctttgattctgtgtgacctcatgtaagccttagtgacctccacctcctctcacctccagttatgtcattaccttccatccctctgaccccctctattactcctagtcttgatccctggttactcctctctaattcccataacctcattatctgatcacccctccccatactgtgatcccagtaattccttgttttggtctcagtgttcctctctcttggaaatcgttttatactctcgatgattctatttctgtcaatctccctaacctacaaatacctcattttctgggacaactccccagtaatgctgctactctgtcctctttgtaacctttcagtggtgccattatctctgaagccctgtgacccccaaagactcatctttctgaacctgtgtgaccctcacctctcaagtttctttttttttttttttttgagacaagagtctcgctctgtcacccaggctggaatgcaatggtgcgatcttggtgcactgcaacctctgcctcctgggttcaagcgattctcctgcctcagcctcctgagtagctgggattacaggtgcgtgccaccatgcccggctaatttttcgtatttttagtagagacggggtttcaccgcgttggtcaggctggtctcaaactcctgacctcatgattcacccgccttggcctcccatagtgctgccaccacgcccggccctcgagtttattatgatttccaaatacctcatctctgtgagcaatcccttctcaaagaccccaatgactctttttctgatccccttgggaccccagtgacttctctctctgactcctatgatcccaaagacaccaatgcacgaattcactcttgactcaaaagatttatcctaactcctgtgatcctcaaatacatcaaccctcatgatctcaatggttatgtttgccttcccattgaccaccaacagccatatctctctaacctcccctgacctcaatggccccatcactgatgccgtcatgactccagtgaccctcaattctctgatcttagtgtctttgtctctggttcccctgggatcccatgtccttgaccccttggacctgctccctccagcctggtgccctcatcttggcccctcactagcccctgttcccctccaggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaaggtaagggggcacaggccaaggtggacatgagaggagtgggtggccagggatgggttgggggccaagtgactggggagtgggggacagcagcagaaggcctcgatggcggtagagagctgacttgctcagggtctgggaggatagcacccaggtgccatcattcattccacaacaacatatggagtgctggctccgcaccaaccccattccaggcaccagggatacagcagagataacacagacaaggttcctgtccttatggattcaaggcaggcaggagacagataacagagatgcaaacaaacatgattccagttgtgtagagtgatatgacagagacattgtgcaggataatgtgaaagaatgacctatggaagctattagagttagggtggtcagggaaggctgcttgaaggaggtgatatgtaagcaggcacttgaaggctaaggggccagccatgcaaagagctagagaagagggaacagcaagggcgagggccctgagaaggaatgagctcagcttgcttgaggaagtggggcaggagtatgggaggtgaggtgtgggagccagagtgattgcgtggaccctctgggtcataagaagcactccacattttattagaagggcaataagactttaaaccactggagagtttaaagtaggggaggatagaatctaatttagcttttgggatgctcattctgctgccgagtgtagaaagcattggagggagcaagtgtagggggaaaccagtgaagaagcagctgtgattgtccagtggaaagatgatgatggctggcctaggtgattgggagagggatgacagcctggaagggggtacctggaagcctagcaaccttccataaagacctatggaagaaaagaacaacagcgggaagtctcctctgagaggtaggagaccaggaaaggaagtgacagggtgggagtaaggggttatggacaagaggaatctggaagcctagagccacaggtgggatgagagagggagggctcaagggaaacaaggcgcaccgtcctctgagctccttctctacccatcccaccacagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccggtgagctccctgagcccatccagccagaatgagaaggaagtgtggaaactctttccaaacaggactgggctttccccacgggctggttgctatctagaaggcctgtttgtccatgaactgtttgtccatgcatcggagcccatgcaccaggggcttggcgggtccagctggtgggggaattgggggaaaggttcctgagtatgggttttaagtgggatatggtatgtggtggggtctcagggctgtggactctgggtctatggcagtctatagaagtgtcaggcttgtgggaattcaggaagaggtggcttttagggcaggattctgcggtgggactcacacctatgtttgctcccccacagagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaatggtggtctttggtggctggcactttcatgggccaggtacaagcactacagccctcggtccccagtgtcgctcactgcacaggggctccaggcaaggtctgcccccccacatcactcagagaggcaaggaaatgagctgtagcacttttattgttccttgtctctctacccctgcccagggtaagggcaaacgccttccaagctgtccaagggcacccgcctggcctggttaggttctcctagttgcctgcagaggaatgactccacatggggctggggagagaagggggtaccaccttcctctcccctggcagagcctggacaccagtacacaaagagctgggcccccaggttctgccctaccctttctgggccttggttagggctgtcttggcggcaggaaggtgggggtcagctaggggtggggcacagcgcggcacctgaagggaatgctgggatttgggatagaaggtgggatgtctcttatggggaagaggaaagaaagaggcttctgccaaggctgacatggaacttgctgagatgggcagaggcaagctgggcagagggcaggaaggaggagggacaggctggaggaaggcagtgttggtgaagtggggaggaaaggaactggtagaaacagggctgttcaagagagacaaacatggtccagtggcaggagagaggagaagcctggcaagaaggggcgtagaaaggtgggaacagctgaccaggagcagctgatctgagccaagcagttccagggctttccagccctgggtgtgctctacccctcccctcccccatccccacctcctacgtatcccaggacccgttgccaccccaagttctggaaagcctcccataggtgtggcttaacccatcagctcccaggcgccctcaccctcctgccgctgcccagttggctttactcaccctctaccagcagccgtgtgtgggtgctgtcctggccggcctggcagcagtaagtgccttggtcctcaggtcgaacgtcatggatgaccaggctgtgggtggggccgtggctgcgcatctcatacttatctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaaggcggcgcgtgccgagggcctggagccggagccgcgggctaggcgtaagcgcgttcccgtcctaggggcgggagttgcagagggtcggggcgagcccggctgggcacaggcgaccccggccctggcaggcggcgcaccctttgttgatgccaagcggtctcgaggcgcgtttatgcgtgtctcgtgttcccaggctggggtcggactgtccccaagcctttggggtcgtgccaggagcctctttgaaaaagcgtcaccctttggggaccttagggccgccaaggcactcgggaagcccagagccaggtatcgatcacaggggacatgggcacggattctggagttaggcaaacctggattcgaatatgggctctacctgttgtctgcccttgggtaggtaatttttcccactgagcatcagtttcctgataggtattacagtgacaagacctacctcctagagttgtccttggagtaagggattaaatataatgcaaatcttagcacagtgccaggcacatccgctcaaggaatattagctgtttctgtctggggcattattatcgttggtgttacactgaagtgggcttggctggggctgggatctgaccttctcccaggtaacatcagccaaagcttgggaaagctcgcactcgaacgtagctgtgtcgccctcggtcacctctaggtcgtgtggcccccgcacgatggtcactgggacctctgggggtgggagagggaggacagtgcagagggagcaggatggggacccatcttgcagggacaaggaggacatacacttgggcacaacaggcagtagaggacactagcgagtggggttcgagctgggacaagtggtccaagaaggatctgtcagtggtgggggtgggggggatgtaggtgggcagggccacagggccaatgggttaggagtggccaactgggagtcacactttaaggtggtcagtgggggagaagctgggggccagagggcaatggggaaacaagcagagatgccagtggagtggtcagtgggaacatcctgggactggaagtaaaaatgggggacactcaagcagacttgctagtgatgtcgcccgtaggcagtcagtggattcaagggactggagtggtcacggggcccacacttaggcgggcagagggagccacggcagacagtgtagccagtagggtcacagttagagtggtcagtggggtggtgtgcaggcgggcagacagcagtgaccacaatggcaaaggcatgctcttggtagcagagtcagtggttggctgagccttgggcagtcaggggccacacccaggcagaggactctggggccacacagggcctatgagtcagggggatcacactctggcagggatgtcaatgagggccacactgagacaggcatggtcagtgggggtcacacgagttgggggtcagtattcatgcctggggtaagtagggccacacaggtcagcaggcaggctgtggtcctggaggccacacctctcacaatgagtctggctgcgcagcgcagggaatccgctgtgaaggagacacagcctgagtcggccaggcccaggccattgagtaccagtcggtgacggtggccgtccgagtggatgtgacacttgggtcctggatacagctgtactccaccccgggcccactccccggtcacaccttcctgggacagctccagctggaaggtggcactgcccccctcactgatggtcacgtcctccagaggccgcagcaccctcagctgcctcgctggccgggggagatggagagagggaggatgaggcctccagctctgggcaggggttgcagtcaatcctcatcccttggccctgcctacacccctgaacacccaacctaaggtcctgaccaaaaaagttcggaaccagggtgcaggaagaaaggagcacggtggacagatttggcggggggagggctgtatcagggttaggagatgagggcacaggaagggggagaagtgtggttagggggtcgtggagtctgggtgaggggtgctgtgacacttgaaggagcacggaatttggagtcagacacactaggaatggaacctcgctctaccacatagtttgtgtgctatgtgatctttggcaaatggcctgacctctctggaccccagttgccccagctgtacaaggtgaataacattgggacacaggtttattgtgatgatttcttgaatgaaataagttagaagagatgtgtcacaaatgacaaccattcaccaagctctgtgtaagaattttcatgttatctcagttaatgttcccagagacacttgagacggggatcaaccccatttttaaaatttgagacagggtcttgctgtcacccaggctggaatgccgtgacatgatcatagctcactatagcctcaacctcctgggttcaagcaatccttctgcctcagcctccctagtaactaccatgcccggctaatttttatttttttttgtggagatgggttcttgctatgttgcccaggatggcctcgaactcctggcctcaagggatcctcctgccttggcctcccaaagtgttaggattataggcgtgagccactgcacctggtctcagccccatttttaaggagacttggctcaaagaggttaacttgcatgaggtcacataggaaacagagggctccagctttgggtgggaggtgtggggtgctgtttgacagccatccctgctacttaagtgggtatgtgtatccctagaatacatgcctgaaggatgcccatggcaagtctttctggagaatatttgtgtttatagcaaagccgacttggaaatatgcaatggaatgcaaaatccacatggacttctaaggtaaataaaaaatattagaaaaagaaaagttttgctttgggcaagctgctgctgggacggccatgggtgacttttctcagcgatgaggggcactttggtgggggcctgagggactccaggacagccagaaaaggctgtggtgtagggtgggtaatgcattaagagaggacggggcactcacgcctcacgctgagcctggccagggtgcgatcgtggtggctctcgcagccgtaggtgccctggtcggccagtatgacaccatggatgaagaggcggtggatgtgcccatcctgggccatggacaggcgagagtcgtggggcaggggctgcccacctcgcacccagcgcacggcccccgctgcacccactcggcctgtctccacttcgagacacacatcctggccttcctctgcccgcacatcctgcaaccgccgtaggaacagcagctctgtctctggtggggaagaaggaggccatggagtctggtggggttggaggctggccccttgctccatcccactggtctgtccctaggtggagaggcaaggctgctggaatcctggttgggagtacaggcacgggacacagagtatctcatcctcatcaggacctaacctcgaacatggagccgggcacttgtggccgtgctccctgcccgcaaagtcacggtccctgcatcccccagttggcagcctcgcaaggttaagatgcggcttgaaccattctgggccatctccacctggggccctggagtgacgacggccccattgcgcagccaggtgacatcggcatctggtggggagacttcacaccggaacgtggcatcatcgccctcgtggacagtgagtggtgtcagctccgagaccagcttcaccagcagtggctctaaggggcacggtaaggcagtgagctgggctgagtcttttcttctctctccttttcatcccctcctcaggatgcaggccctcgtccccagtcatttaacagaccttctgtgaggacctactatgtatcgaccacaccgatggcccaaaggacaagatgccagctccctgccactccttttagtcagttcctcataatcctagcctagcaccccaccttggtggcaccctaataatatcaattaccagggaccctatttacagcatttacttgtcacaacaggcctataagaaaagcactatcccctcttttcagagccggggctcagacaggttgaacaacttggccaatgtcacacagctactggggcacagaatctaggctggaacctggctgggtggactctagagcccctgcttttaaccactggtttatgctgctctcaacatgagggtttctggaaagaggagccctgagcccctatccaagtgatggtcatgcacgcactggttggagccagaagcagcaaagcgggggtggaggagtaagggggccctagaaagtggcagatggtccttggggtgccacagcccacagggtgtgaggggtacactgttaccttccacgctgacaaggaagatgcggctgtcctggggcgcatcgcacaggtactccccagcgtccccgctccgtgccccctgcacccgcagcacctgcctggccccggcctgctccagctgcacccgcccctggcttgccagtcgctccccgtccttgtaccagcgtacagggccccctggcccggagaggtgcaccaccagctctaggtccccgcctggggtgctccgaaccctcgtctgggctgcctcgggagctaccacccgcacagggggctctgtggagtcagagctggaggtcactgggagggagaggctcagggctttgaggagggcacggggaggcatgacggggaaggtactgagagaagtggggccagggatgggcaaggcatgctggaaaagcaggaatcccgcagagtttggggtgccactctcaggcttggtgccactctcaggcttaatgcccaggctgtactcaccagccacctggacggtgaagctgaggcttggggctccgggggctgctccagactggcaggtgtagagccctgcatgggctgggcctgcagcctggatgcagaggactcggcgggggccctcggcatggagctctaggccctcgccctcctgcacgggcctcccattgtggctccagaccacgggggcgccagcccgggacagttcacagctcagcaccactggctccccaggggccacacagagcgggcttggagttgtctctagagcaaggaactgcactggaggctctggagaagagaggaaggtgtcatcccatgcttgcccttgcctccctgccctgggttggccaggagcacccaccagccaggatgacattgaaggtgatggcctcatgccgggtctcacacacatactccccggcgtcctcaggctgggcgtggggcagggtcagggtgcgggtgggcccctcggcacccagctgcagggcatctgatgcctccacttccagcccgtccttgtaccagcgcacctgagacccagctggggccacctcacagcgcagctccacgcgccctggagccccaaaatgcagatccagggagcgggctgccgggtgcacaatcctctctggtggggctggtgggtgggcatggagaggggcacataggcttggccagcaggcctctcctgcctcacccgccagatcctcagccctccccactggcagcacagctcttgagaacagtgccagctgcagtccatggagcagctgctgtgtgccaggcactgtcctaagaaccctgtgttttttcaatcagttactctgaccaccctcaagaggtgcacagctgctggctgcacttcatggctgaggacctgaggcctctttagaagaaactgacttgcctaaggtcacacagacagaaagaggcagatctagactcacacccagatctacacaccccactccacacccatccccacttcctatcccctttccctgccttgcctctgatgcacttgttaccacctgacaaaccatctcttttattttttgtctgtccaccctcaccagagtttaaactctgtgaagacaagaggtttagtcttattggttcactgctgtatccccagcatctaaaacagtgccaagcacatagtagttgctcaatgagtattgaacgaatggatgaatgaacgaatggttctaattgctgggcaccctcccaccaggcctctggtcctgacctgatgtggctaagcaggattctgatggccaaacatgaggaagctggataaggggaaggctggggatggggtgggggaggtggggctaggtgggtgtctgtcccttagccccctacctctctacctcctctctgtgctgcagagactgcccacctgtgacagtgacagtgaagaaggccgagtcatctccagcatcacatacaaactcgcccccgtcctcgggctgagcagcaggtagcaccaggcggcagcgtggcccatccctctccagcaccagggcctcgctctcctccacttccagcccatccttgtaccagcgcacaggggcatcctcccgagacagttcacacatcagcaccacacactccaaggtcacggcgatcaaggtcacctcatcgcgagggtatatgatccgcactgggggttctgcagggtggggacaaccacagcctgtcacaagctcaccgtcagcctctctggagccattcggcagcatgaagtccctatcacccacataataatgagaataataagtaaaataataataagcaataataggtccacagtttgttctctgaaatccctggggccagagggtgttacagaatccagaatgctttggattccagaaatgatgcgtttctcatctatcacataccttcctcagcccccacgggagcctcccccttcatcggtcacgttaacatgtctgtggtataacacatactacattcaccctaagcaggatagattgaaagatacagaatcttacagatacaagcatatatctataagacactcatatcttatagatatacagctatagctatattcaccctcagcaggataattaaagcatagaaatagcttcagagcaatcaagctcaggttttcctgaaatgacttggaatacaaaacttacaaaaagccttttgattttgagagttttggaattttggaaccatggataagggatggtggatctacaatagcaaacattgatatgacacttcctaaggtccaggaacagtcccaagcacttgaaacatttaactctcacggcaatcctaagaggaaggtagtgttttgtccccattttccatataagggactgggcacagagtgattatacaacttccttaaggtcacagctggctacacccactctggggcaggaggaggaaataccctctgttaaagggaggctcagaccccacaggtagtggcaggaattccaagccaaggcttgcaggaactcagtaatgctttttgcattcaacgtctgtctgagagttccccaggggtgctaaatgctgattctgggagctcatctccaagttctggtcactcctctgcagaaagggaaccatgtcaatattagaggtgaccagcgcatggagcccaggcctgcccacacccctgctgcccccaggtccccccagaatcttcaagttttggggcgactactgctccattagcctctggccccctggtggctgggctgaggaactgctagcttcccaatcaggggccagggttgggggggtgggggctgggggtggtttataggggcatgcatgggccgaggtaaccacaagctcccactcagccccccagcctccacggagactcctgccttgagccacacaacccacctcccccatgggcttgcttgctctaagggtctgggggatgcaggctggtcctctggggccgagcaaggccaggagagaccagaatgcagctgcctgaggagtggggaaggtgatgagggcagtggggtgaggacagggtgcagtgatgggaccgggtggctgcccagccccgggacctcagcttggtgtcagacttgattcgctctggcctagagcagaggtggtgtttgtgtgaacttccctgtgaagagactggtgtttgtggggagcctgagcatgggctggagtttgtgtggctgtggccattctgtctggccatggctgggtgggagagggtgaagatgattacgacagggcagaatatgtgcagaaggcctcttaggcattgtgggcttgtgtgtgtagagtgcattagctggggtgcaaggagcaggggggccctaaacagctctgcatggggcgtgactttcagggcagggctgggagaggacaggactgtggccgcagtaggatgggggctccagtgcagccactggggttctgtgccccccagagctgcctagccctatggacccccagccccagacacacactgggctgggcgctgtgagccgtcaccccgaggtctccggcactgaacctccgtcacttccacagttgtcctgtgcttctcccgctttgaatattcccccacaccccaccccacttagctccagtatcagctttgaaagcacttcctgttgcctggccagggtggtggctcccagccccagggtccctagactggccctcaacaacccatgctctaagatcctggaatgcgtctggctttcctgccaggctgtgcagtcctagagggaagcggccgtgtctgcgtgctgctggctcccgtgtgtggaagggtgactttctcccaggcctccctgaccctcctgctctgtgctcttgagccctctgcccttggccctcacagtacttatcaccaggtgtcactgtacatttatttgcatgtttattggtttaacacaggggtcgcaaactcaaatgcccacaggggccaggttaggttagcggctgaagcagtctggggagaggcaaaaagcaatggcagggaggtgggacagaggaatgtgggccccaaactatgggggcagctgctactcagtgccagctgttcgtcgccatggggggaagcgggaccagagccgccgggtcttcggctttttcaagaggacgcataactccggattgttatttgaactgtcctgactttggtaagactctgcagaccaaacaaagcacatgtgtggaatgcgcagggccccaggactacccgtttgcgacccctggttaacagctgcctcctcacctagcctggcagctcattcagaatagggaccgtatttgcattactcacctgctactcccagtgcctgattcagggaaagtgctcagtaaatgagctgtggagcagagctaggcctggccttgggcaccggggaggggcttgtttccttgaataggggccctgggctcatctcagcaagaaccctggcacatgcacctgcagcccacacctccctcctccccggggtgctagctggggctatgtggccagctcctccagggctcagggctgtctctgtgaccccggggagctgggctgggcccacacctgtgacggtgacagtgaaggaggccgactcatcgtcaatttcacacaagtactcgccggagtcctcgagctggacagcgggcagcaccaggcggcggacagtgtcttccttctgcaggagcagcgcggggctctccaccacctcctctccatccttggtccagcgcacctctgcccagggccggcatagctcacaggtcagcaccacacgctccaggcgcacggctgccacatacaccttgccgctgggatacacgatccacgaggagacgtctggaggacagggacagccactgccgggcatgaggggtgtgccctgccgtcctccctgaccccgttgtgttccctacccctggaaagtaggccatgtgttgaagagggaccttcctgagaccaaatctcacagcagctgacagttactcacagctagagacacacgaatacagctgtcacaaaagcacagcagactttctgctgcgcaggagctgcacagaggggaccacggggtcagcctcggctgtagaaacgctccacattctctgggttgggacagggacggtatgaagggtggaactgatgagaggagggttggggggaggagctgggggtctcctcctccaagatgtttttgcccccctagtgcctgagaccaccagccctagactctgccctaccctgcaatagactcactgtccccagagatttcccttggtacaggttttcaggagaatagagaaagccaggcttccttagccaagaccaatgtgcttatgataacacgtttcctgaatgtgactagaccatagcttgaggagaaagggaggaggtccgatctgccagggggagggcagtaggggcggggaacagtggcctgggagtgaaggtgtggcagctgttccagtgggagcaggggcaccttcccctgtgcctccgaggcccacctggccccccacctgtgatggtgacagtgaagtaggcacactcatctccagcgacgcactgaaactcgcccccgtctgagggctgggtggcgggcagcaccaggcggcgatggggcccctcattctccagcaccacgaagtcactctcctccacctcctgcccgtccttgtaccaacgcacaggggcgtcctctcggtccacctcacaggccagcatgacacactcggaagttatggcatgcacgaacacatgttctcgggggtccacgatgtgcacgggaggatctgggtgggaagcagagatggcattgcacagacacccccgcacaatgagtccaaactagctgtgtggccaggagacactgtttctgcacaagaggacactggaggagggctaaggtcctgctgtgtagggactcagggacaatgacaaggaatgctgagggcatggcaggtgaggcatggcaggagatcatgtggcaccagagtgctctgtaggtccccaaaggatcagaggtggcggggtgagtacatagagagaaggaagcacagagagttcacagagtggcagccaccatttgtctaggctgaagggaggtcactgtcacaagtcacatcagggccatgcttactgcctctattacgagaaagaccccagggtgggcaggaggtgaaggatgatccaacaagtggcaacagtgagacagccactctccaggtagtgggttccctgtcactgggtgcattcaggcaggggccacagtgtggaaaacaggactcccactcagtgagatgagtgggatccatggttcccaagctgctctctcagagagtctgcacttgttaggaaaggatcttcaggctccaccctggatactggggctctggacagtccagggatttataaccagcttccaggagcttcctaaagcagccagcctacggactgccttgtgagaaccacggggtgactgcactcgatgcttctgtttgactctatctgaggcagcaggaacagaacaatcctgtgtgtgtcgccaagctatggtgtgacggaggtcacataacctcttacagcctccatttctttgcctgtgaactggagatatattgcccctcatcgagttgtgaagattaaatgaaagagtgtatattgaaaatacttagcatagtgcttggctcagagtaagtgtccaaaaagtgtttgctcccatctctcctccccttaattgcattttgttcccccacccaacccagcagaggctatgtggacagcgagacagtgttagtgtatcaggggtttaggaggcaaaggcacgctgtgcgtggcacacacctataatcccagctgctcaggaggctgaggaaggaggatcgtttgagcacaggagttcaaggccagcctgggcaacagtgagaccctcatcttaaaaaaagaaagaaagaaagaaagccaggcatggtggctcatacctataatcccagcattttagaaggctgaggcgggcagatcatttgaggtcaggggtgacctaaccaacatagtgaaaccgtctctaccaaataataaaaaaattagctgggcgtggtggcgcgcacctgtagtcccagctacttgggaggctgaggtgagagaatcgctttaacccaggaggcggaggttgcaatgagctgagatcacgccactgccctccagccagggcaacagagtgagagcctgtctccaaaaaaaacaagaaacaaaaaagcaagtgcagagttatctgaaacatgtcccctgggccactggactctccctgtaaaggactcccccaagtaggcagcagaccagagggcatggcttatgcggccccacaatcagccttggctggaggagcccaggctggcatgcttcctgaccttggacagtgacgccgaagaaggccgagaccccttctgtcctgcactcaaactcgccactgtcctggactttggcctcaggcaggatcagacggtgtttgcgcccatccatcttcaccaccagcaactcgctctcctccaccttctgcccatccttgtaccaggttgccgggaagtccacccttgagagctcacaagtcagcaccacccgctctgaggttgtgaaggtcaacgacaccctgtcctgggggctcaggatgtgcaccgggctctctgtgtggggagaagtacagataagcacccctccctccggtgcatgggctcagtgtcggatgcatcagagggaacaactgctgttgttggggtttttaaaaataggcttaggcttccacaccaacccttaagagcagtgctttggctgtgcataagaattcctagggagcctgctaaaaatgcagaattcttggattcccaagcacgcaggggccaggaaatctgcattataaaccagccctccaggtggttctgatgtcagtgaactgggatcccattttggaaatgctgctctggttgctggtcaggtctcacctggcccctctgcctgcgatgctgacagtgaatcaccccaagaccccgtgcatgggtgccgacagattccttgattggtcttacaaactccagcaatggtgacatggcaaatgctagcgtgatccttgaactttgagcgccccacctccagctgttctcctcagggatgcctcattcccctccttccccctttcaacaggtggcacagtgtgatcaggagcccgactgcctgggttcataattcagcacctgtgctcattagctccgtactttgagcaagtcacttaacgtatctgcctgtttccccagctataaaatgggaatgtcaaaagaacctatcttaagtttgagataagcctggccaacatggcgaagccccatctctactaaaatacaaaaacaagccgggcatggtgatgcatgtctgtagtcccagctactcgggaggctgaggcaggagaatctcttgaacccacaaggtggaggttgcagtgagccgagatcgcgccattgcactccagcctgggcgacagagtgagactctatctcaaaaaaaaaaaaagaacctatcttatagggccattgagaagattgtgttaatgtatgtaaggtgattaggactgcgcctggcacgtagaaagttgcgatgacaatgtcaacaattagacaacatggcaggaggcaggcagggactagcagccagggtctgtgtctttcaaatgagatgacaaatctgacaggattctgtaaaccacaaagcactccagagaattgggatatgatgctgacatatatcaagataacaaggggtgccctggatgttgcatgtgggttgaaattggccttccggacctctgagccctcaacctcagcccatcatggatgctccttgctctcctggcccagatacaagaaataaaaacagcatctgcctcgttttgccaacaggacttctgtgtcttgaccctttctgcccactcaggtccccactggcaccaaccttggattgtgagggcagctgagtcctgcacgccggggcagctgaagccgaccagggcaccgctgtcctggtgcttgacggcatgcaggatgagtctgtgctgcagacccttctgctctatacggtaccgcagggccccaggttccacctggccctccggctcgttactcttgagctcttccccattaaggaaccaggtaccctggatgatggtggagagatcgagggagaagacggcatcttccccgtcgtatacctgcacatcctccagacctgccaccaggcgagctgtgggcactgaggcagggacagagtgcagctgtcagaactagaaggtgtggcagagggcagaggctggcggatggcaagcctgtgagaggaccagcactgagggctggggaagggaggagaagtgatgggtgggtctggcaggaccaactcaccaaggtgagcagaaccgtggaacaccacgtggggactacggccatgtccgctgactgtgcagatgcggaagcggtagtcaccctcggagggcacacagtcgcccggcacctccacggctccggctttctcgatgctgaagcactgaatccagtcttcagagcccacttcctgccgctccagccggtagatgaatggggtctcgggagctggctcgggaggcttccaggtcaacaggaccgtgttcttgtggcccttgaacatctctgccaatatggggggtcctgggggactgtgcttgacacctgagaccaaggcagggatgtgttccggccttgcttgggcctccacagcccttccaccttaaatctacttcaccaacccagctccggcatctggccaacctcctgccctgcctcgcctgtccagaggccttcctgccctcacattttactctgagaagcgtagtggtacgggagttgcccaggctaaaggtgacctcgccagcatcctctcgggtgacccctggaaggaccagggcatgcatgtggcctgagctgctctggcagatgaccggcagctcctccccatcacggctccagcgtccctcgaccccggcctctagagtttccactagcagcacagcattctctccttccaggacgtcgagcttccggggcaggcgcttcaggatgggccctgagatgcggacaggaatccatcaacctggaatctgagcacctgcctgcctccgcctcagcctcttccccacgggccagctgacctttgactgtgacgttggccacggtgcgcacccggccccgcatctcgcacaggtagataccatcatcgtctgccttcagcctgtggatgatgaggcgccggacagtgccctcttcgatctgctcgtacttgcggcagggcagcagccgctggtcctcacggaaccaggccgtggggatgcgggagttgggtactttacattccagcacggcaatcccgtgctcacggccctccacgtcctgcaggggccgtgtgaaccggaggcggggctctgtggagaggggagagagagacaagagagggctctggagaaggcccagactaggagtaggatacctagaagcgcattagctcatgctgtgtgctcttcatgcagagccagcgggcactgtggaatcacagaaaactaccagaagggaagtggtggttcctaagatgacctgagttctcatccagccctgacactagccacatcaccttaagcaagtccatttcaatgcttctgggcctcagtctccttacttgtaaaatggggaaagggagagaaggggttggaccagattgatgatttccaaactgttccctggggtcctccaggccctagattggtgatttccaaactgttccctggctccccccgccccagtcatttcacatattctgcaagggtctgagtagaatttaaaatattttaactctttttttttttgagatggagtctcgctctgttgcccaggctggagtgcagtcgcgcaatctcggctcactgcaacctccacctcctgggttcaagcaattctggtgcctcagcctctcaagtagagctgggattacaggcaggcgccaccacgcctggctaatgattttgtatttttagtagagatggggttttgccatgttggccaggctgttctcgaactcctgacctcaaatgatccgcccaccttagtctcccaaagtgctgggattacagggtgagccactgtgcctagctattttaacccttttcaaaagtgtatttcaaaaaaaaaaaaagaaaagaaaagaaaacaggatgttggaaatcagaggattaactagggctgctggagaagcaagtttttgtgtgcgtgtgtgtatgcaactcggggaagctcctctagccttccctccgggcttttctttcctgatggaggtccagatcagcaccaacctgatgaatctgtgagcattgaactgtaacagtgaggccaccaccgcagcctgggggcaacatgcttgactgcatgctaggaaggactcaggagaatttaccaactttttttcctctaagagaaaaaactggacaataactagtgaaggtgtactcttttgcgttgtgatgaaatcctattatggggagcgttaccttctggtgagtttggggtgtgcttttttttcctttggaattttctgtttatgagaatgtaaccatttattggatattgttggtgattcaactttgaaatataaaccttctctccttcaccttcctcttcttgcaaacgtggggagcagtttaatcaaagaatagtaaaaacacgcaggacatttgtcctccctcaagtctagctttccactgaatcacttgtttctcaaggtgacagatgcagccaggccgtccccacagggttcagagcctggtctcatgaatgcagcctttaattcaaattcctgtattcaataaaatagcctccttattctcactgatggtttagaagtacctgttatatacgtagactcagcaatttacgcccataaactactcctttatctgtctcatatattggggctctggttgtgaattcagtgggggaaggaggagtaaaataacaaagacgttgaaaaccactagggaagaagagttctagggccctccggatttgtacatcaatcactccttagtggtgttccaccatctgcctcggaatcatttaaggagtttgctaagaagttcctgagtaccctggagacctactaaatccgaatccctggggagtgagaggcgggcgggtttggtattttaatattcccgcggaccacctctcctccagtcttgggggcagcgctgggcaccgaggagggctggagttcggagggcctcggaggacactcgaggcccctccctaggtcccgggctccgccgtacctttcacgtgcagctgcacggcactgagcgtctggcccgccgagttgcgcgcggcgcagacgtagagcccacgatccttggcctggcagtaaagcaccttgagcacgaagccgccgtcgcggtcgcggtacatgaggcggcggcggtccgggagcagcgggcggccctcccagtgccattcgatctcgggctcgggcttgcccatcacgtagcagcggaacttggcgtgcttgccctcgttcacccagaaggtcttaggcgcgcacttgagcggctccaccaccggcgcgggggcctcgtcggggtccgcgggcgggctctcggggggctggtgcacctggagcagcgcccccgcctgcgcgtggccgtgcgcgttgcgggcgtggcacacgtagacgccggaatccggcagccgagccgccaggatgcgcagtgccaggctcgcgccggggccgtcctcggcgcggcccggctggagcgcgaagtggctgctgtcccacacttcgtccagggccatcccgtccttctcccagtacagtgtgggctcggggaggccccccgcccggcacgtcagcaccacctccgccccccgcagcacccactgggatcgaggccccgtgaggaagaccggggcgccctccccggaccccggcgatggcagcgggcgctcggcgggctgcagctcggggtcggaggccggcggctccagcacggtgacggcggccgccgcgtaggcctcgccggccgcgttgcgggcgcggcacacgtagacccccgcgtcggtgggcagtgcggcggtcagcagcaggccgtgctccgcgccgtccgccgggaagctcaggcgttccgaggccgccagctgctgcccgcccttctcccacaccactacaggcggcggctcccccaggaccacgcacttgagctcggcctcggcgccacttaccacccgcacaggccgcgggaagcgcaggaagcacggggggctcccctgatcccccgagctcgccttcatcgcggcggccgaccgcctgcagcggcgaacggtgggggggcaggggggggtgcggagggcgagccgaggcccggggcggcggggtcggggcgcggctggggactgggcgcggggacccgcggagctctcccgggcctcccgctcccggctcgcctccttaccctcggccccgagctgcagctctgcggcggcggcggcggcgattcccgggcccgaagcctggcgctcagggggcagtccttcctgtttgcctctccagcgagtggccccgcagcctcccctgcccgctgcctggcttcctgctcttaggagcctctcttcccagccccctcccacagcttgggcctcttccccctcctccctcccacctccagccgccaggtccccagccgcccgccaggcttgggcctgagtggcagaggcgcctgcagctgccaatcccaaaaatattctctgatgacacagctggaggacaagagcccagactggctccactggtctaagtatagagcaggcaggaccacctgcccccggccctagccccggttctagccccggttccagccctgcccccaagggctggccggccagcagctgcttattgaaaggggccccagaaggtctgaggggtgatgcactttgtctccctgacaaataacactttctggggctggccggctacagctcccaggctcctgtcccacctgatgtcacctctggatgtgtctgtgtgtgtgtgtgtgagagagtgtgtgtgtgtgagaatttgtgtgtgtgtgagtgtgtgtgtgagtgtgtgtgtgagtgtgtgtgtgtgtagggagaaggtgttgtatgtttgcatgtgtgagtcaggtcgcttgaggcgaaatccttcccagcccctcccccacatccctggcgggagtgggagataaggctcatggccacagacatctgcgtcagagataggaggtctcaatgccacgggcaggggcaactcggactgtggggcgtggaaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacaggtaacgagggtgggggaaccggcaggatgactttgagaaaaagcaaggcacagcatgggtttgcaggccaggcggacctgggtttgaatcctagtcctgctactcagttgctttgcagcaataggccagttactaaacttccttatgcttctgtctccccatctgtaaaatgggctaatgcccacctctcaggattaagtgagaggctgtacctagagtgcatggcaggtgggaggcatttgggaagtatgcgctgggagaccgggggtctctaaagatggagatatttgggcttgagccccttcctgccacctttcctcctatctctgcctctgctcgctgctccaaaccctgtttctttactcccaggtagctgacactgagaagctatcagagatacaggcaaaagattagttgggaaacttttctggaaaactagtctatcttctcttgagttcctgtctcaacatatatgtgcccccttgttccactgactgaatggataagccctcctgtgggtgggctttcttgtcatctggtccacctttctcttagagaggacccctgcctccctcacttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatagtctatgagtgtgtcagtgtgaggatgctaactacacattcttgaaaggactgccctctgttctgagttacagccctcctccttctcttccccctcttccttgttctccattttcttccctttcccacttgcctttccctccttcttcttttttttttttttttggtgtaaacctgtcttttaaaaatggaattattttaaagaatttatcctacaatattcctgacatgccaaagatataaagagtaatataggccgggcgcggtggctcacgtctgtactcccagcactttgggaggccaaggcaggaggatcacaaggtcaagagatcgagactatcctggctaacatggtgaaccccgtctctactaaaaatacaaaaaattagccaggcatggtggcaccagctactcgggaagctgaggcaggagaattgcttgaacgtgggaggcggagcggaaggcagaggttgcagtgagccgagatggcgccactgcactccagcctgggcgacagagctagactccatctcaaaaaaaaaaaaaaaatggtaatatggctgggtgtgatggctcacgcctataatcccagcactttggaaggtgaaggcaggcagattgcttgagctcaggagtttgagatcagcctgggcaacatagcgagaccctgtctctacaaaacccacaaaagttagctaggtgtggtagcacacgcctgtggtctcagttactcaggaggctgaggtgggaggattgcttgagcccaggaggtagacgctgcagtgagccgtgatcatgccactgcactccagcctgggtgacacagtaagactctgtctcaaaaaaaaaaaaaaaaaagaatataacaaccatccatgtagacaccattcaggatactgtttcacactatctggtgagtaagcattgaagtctaatacaaagtcttagtgctggtgaagtggagagagggcctcttacacactgctgatgggcatgttaattggtaaaaccacttcagagagaagttggcaatgtcttctatttttttaagtcccttcatgatgaaattaaaaaatgggaagcctacagaagctctcccaaaactcaggagagtccccacgtcccggagggcgtggagcagagtgcagcccatcattggctcatgactggtggccacatccctcctgctgaagaggaggggtgccaggtcctgccagtcagggctgccctctcccttttcttctgtctcctgcagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttgacatatgttctccagcttctctgatatggagttgggcccccaggagcatgggactgtcagatctcaggtcactcagccacacttgacctcagagacatgaagttcaagagctataactggatgtgtattggttgggaatctacaacgcttgggggtgacataatagtgctccaagctccttggagagccaccttggagacagagctggacgcatgcaagctgaaccagacatgtcaatcaggttgcctgccctgcacacctaagggagactgctgcactcacatgaccacatccaaggcagccataagtcccctcccctgccattctctgccacagctgatgggcacttagcccgaggtcaggtgatttgtagcctggccagagactgtggcctttggagtcccactgagacaattgtccagagttggccagaccttggagttacttgggaagcttgggtgggatgtaagggagagatatatgtgttggcagcatcagaaagaaattaacaagggcaaagaggtggtgttgtgttaaggtcagacagatcacctgaccaaagacctgaggatttccttttgccaaaggcccttctttgaatccgtcactgactcttgctgtagactccgtgaggcctcctgcagtaggattctagttcatgaactctttgtctcccttgatgtcacctgtacatgtttacataatcccttaactcagcccttagcatcagaagagtggaaagactgaggctattgccagaaaatagaaaagctcttttgtgaatttgtgcatgcaggacatggtgcaaaacagcacttttcttttttcattgcgtttcctatcagtccattctgcctccggatttgggcatggggaagcccctctccgctggccttcctccctgcttttttcactctccttgttatccccctgggtctcgttatccttgtgctccaccccagggtccctgctatcagccactggttccatccagtctccaacacgtgtgtgtgtgtgtgtgtgtgtgtgtgtgtttgtgtgtgtgtgtttaggggaagggctgggatgttcaggtccatcagactggaacttgagagcactttctgatattgactgcacaactacagtgtgtatttatctaaccagagtcttttactggtcaaagactcctttctaccagcctggcttgatggggtggaagggtaagcgcctgctccagtgagcggtgcagcgggaaagaatcctatcccgtcacagttacaccaacacccctcccccaccggagctaacctgaatgagccactgttccctgcagcacaggagccttcagagccatgtacgtgctcctgtacacgccccagtctctgttgacactgagtcccccagaaggctgtcactgttctggagggggaaacctgcttgtttgcagtccccagcctctcccaggaccttcgtgttgactcagcattggaagcgctctgtgctcagagctctgtgcatccctattcaggcagtgggctggggagacagctgcttgggctctgccagtggtgggaaggggaggttttttccaagcctgtctatgttctacgtgctccctgcctggcttctctggctagatcctcccttcccaaacagtgaggtctttccctgggatcttcaattttcctactaggcttcagctcttcattcttcctgctggggccccctagaaccctgtgttatccagatgctccctgtcccagggatgaggatgggcgctgagggctgggggcagattactgaggggtacaggattctccacgaggccagttagcagattggtattgcaagtgaaaagcgtgcacatgtctgagacaaaatgagaaaaatgagtatgagggagtctttcacaaagccaaatatattcattttataaaggctatctttcaatgctacccattaccttttctgcttgtgggtgtgtgacagtgttagctctttcatgatgttatgaagagggtagaaagtagtggttttgtttgtttgcatttctacccaacaaaatttaaacttggcaattccagtttggaatgtaagatttttctttggaattttgttgccctgtgaaatctgtgagatcccaatgtctgacagtcactgttcggagccactccttctaaggtctctaatacctagattctgctaacgcagcaaattaggaaagatgttcacagatccctaagaggggctccacagtggctacggacatcgttttgttttctatcctcatcaagacaccagcccaagagcagtgaatttcaaagatgatccctgttcccaatgctaatcattagggacgtactgtgaatactcttagtttggagtcagtttaaacagaaaacccagctccaactggattagatcaaaaagtgtatttaagccaggcgcggtggctcacgcctgtaatcccagcactttgggaggctgaggtgggcggatcacctgaggttaggagttctgactccatctctacagaaaatatgaaaattagccgggcatggtggcacttgcctataatcccagctacttgggaggatgaggcaggagaatcacttgaactcaggaggcggagcttgcttgcagtgagcagagttcgcgctactgcactccagcctgggtgacagactgagacttcctctcaaaaaaaaaaaaaaaagtttttaaaactcaccagcactggctcattggctcatgataaatccacaggcacagctagctaaggtatggctcaattctgggctcaaaagatgctactaggatccatctataggctctagttccccccagatcagctccatcctgggtccatggcaactccaggcagcacaggctcccatcattatgcagcttggtccggcaggagggagttcacttacaaaagtcctgggacaaagataggcacagtggctcatgcttgtaatcccagcactttggggggccaaggcaggagaattgtatgaggccgggaatttaagaccagcctgggcaacaaagcgagaccttgtctctatttaaaacaatgcaaaacaaaacaaaagtcctaggacaggtcttgatggcctgattagatttattaatgtcatgtgctactccaggaaaggtggcctgcgttaatgccttagcctaggtcacttgtcctccccatagagcctcgagcctaaagcataagggctaaaagtgaaaaaaggtgatgtccccaaagcaggggacagttaccacaaaaaggtggggtagatactgagaagcaagtattgtttgttgttcctcctaagtatctttcaaatcaaccgctttgtctctccttacgtagacactattttgcaattcttgattgggcaatttagcagcctcctaaaccagtcactccctgccctccatccaccctcaacatggctgacacaggatttttctgatgtgatcatgttacttagggtggcttaaaaaattgtctccacaaagttcagcctccttcatgtggtcggaaagcccttgataaccaactctaaccctttccttgcagcctgatctacccagtcctcctttcctctccccacccaacacatcacccaaactctggtgacacaaattccagatacaaaatgttcttctcaagggcccatgtctttagcaacacctcttttttttctgttttgttttgtttcaagacagggtctggctctgtcacccaggctggaatgcagtggcatgatcttggctcactgcagctctgacctcctggaactcaagcaatcttcacatctcaacttccgaagtgctgggattacaggcatgagcggctgtgctcctacctcagtgcttcctttaagatccaattctgatgtcacgttttctgtgatcctccccttcactcccagatggcaaagctcttcaccccttcttcactacttcctgggcactttgttttttaatttttttttgagacagagtctcgttctgtcacccaggctggagtacaatggcgcaatcccggctcactgcaacctccgcctcccaggtcaagcgattttcctgcctcagcctcttgagtagctgggattacaggtgcgtgccatcacgcccggctaagttttgtatttttagtagagatgaggtttcaccatgttggtcaggctggtctcgaactcctgacctcatgatctgcccgcctcggcctcccaaagtgctgggattacagacctgagccactgcacctggcctgttttaaaatttttatttcaaaaaattacttgttcttgatttcataagccacaaagagatacattctcacagtggatattcaaatattaaagataaaactgaagttccccttgatcgttatttccaattctagtcccctccacagaggcaggtatccttctagacacatttccatgagttgacacccatgtgcgtatctggtagaaaaagtcttttctccccccacgaatggtgtcatgccatgtgtatggggctgccactattttactttatattctacgagtttgttttgaccttattttccagtctattagctttattttcttagcaattatattcctccgcttgaaagaaataagattctattatttaattttatttattaattttttttttgtagagatgggcttgttatattgcccaggctggtcttgaattcatagtctcaaatgatgctccttccttgacctcccaaagttctgagattacaggcgtgagtcaccaaacccagccagaaataagatccttttgttaattttattattattattattgttattattatttgagatggagtctcactctgtcatgcaggctggagtgcagtggcgcaagcttggctcactgcaacctctgcctcccgggttcaagtgattctcctgcctcagcttcctgagtagctgggattacaggcacacgccaccaggcccggctaatttttgtatttttagtagagacagggtttcaccatattggtcaggctggtctcgatctcctgacctcatgatctgcctgcctctgcctcccaaagtgctgggattacaggtgtgagccaccgtgcccagcaattttattatttatatactgaacacttatacagcactatgtgccttatgcatgttagaactaaaagctcatgcaatccttgtaacaaccatttgaggtaggcactcatattatacctattgcacagtagaggaaactgaggcacagagagataaaataacctagctgggagcagtggctcactcctataatcccagcactttgggaggctgaggtgggcagatcatgaggtcaggagatcgagaccatcctggccaacatggtgaaaccccgtctctactaaaaatacaaaaattagctgggcgtggtggcacatgcctgtaatcccagctactcgggaggttgaggcaggagaatcgcttggactagggagtcagaggttgcagtgagccaagattgtgccattgcactccagcctgggcgacggggcgagactccatctcaaaacaaaaacaaaaatgaaaaaacctatccagagtcacatccctagtaagtgatggagccaggatttggactccacaagtctggtataagaatccatgtatccaccactatatcatattacctctcctccactcctcaagcatacttcctgaggagacaaaattatttctgttggccaggtgcagtggctcacacctataatcccagcatttgggggaggctaagggaggttgcttgagcccaggaattcaagaccagtctgggcaacatgccaagatcctgtttctgcataaaaatttaaaaaattagccaggcatggtggtgcatgcctgtagtcccagctacttgggaggctgaggtgggatgattgcttaagccagggaggtcgagactacagtgagcctgatggcaccactgcactccagcctgattacattgttgaggtggcagccatcccgtatcatgggttccagtctggtggtgactattactgcacctttcaaaacatagaggtgtggctgggtgcggtggctcatgcctgtaatcccagcactttgggaggctgaggcaggtggatcatgaggtcaggagatcgagaccatcctggctaacacggtgaaaccctgtctctactaaaaatacaaaaaattagccgggtgtggtggcacgcacctgtagtcccagctacttgggaggctgaggcaggagaatggcttgaacccaggaggcagaggttgcagtgagccaagatcgtgccactgcactctagcctgggcgacagagtgagactccgtctcaaaaacaaacaaacaaacaaacaaaaaacacagaggcactttgctcaatacctgcacttgaacagctgtcatttgcccaagttcatcaagtatagcataacctaaagttgg
